United States Patent 11,098,302 (IDENTIFICATION OF POLYNUCLEOTIDES ASSOCIATED WITH A SAMPLE) - sequence listing, part 20

SEQ ID NO: 65413 - DNA, 565 bp, Homo sapiens
  misc_feature: GYAE6OF02FL5TX.31.78.H01.1.454.CMB.1.raw
  modified_base (311)..(311): a, c, t, g, unknown or other
  misc_feature (311)..(311): n is a, c, g, or t
  modified_base (439)..(439): a, c, t, g, unknown or other
  misc_feature (439)..(439): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagatgttttattggccccacaataacaactacttagcttggtaccagcagaaagtaggacagcctacctaaactcctgatttacnggcttcacccgggcatccggggttcctaaccgattcattggcagcgggtctgggacctatttcactctcaccatcagcagcctgcgaggctgaagtatggtggctagttttatacttgtacagcaaanatttatactttcttttcgtctacgtttcgggccggtaaggacccgtaagggtggagtactaccgtaaaacggacgtaggtacggtaccgtaggccctaaccgtataccgtgttacctttactaacc

SEQ ID NO: 65414 - DNA, 560 bp, Homo sapiens
  misc_feature: GYAE6OF02IAS93.31.78.H01.1.454.CMB.1.raw
  modified_base (423)..(423): a, c, t, g, unknown or other
  misc_feature (423)..(423): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgacaagtccagccagagttgttttatggccccacaataacaactacttagcttggtaccagcaagaaagtaggacagcctaccctaaactcctagatttacgtggtctcgtacccggctagtcccgggttacctaaccgtattcagttcggccagtcgggtctggggacctatttccactctcaccatcacgcagcctgcaggctagaantgtggtactagtttattactgacagcaactattactactttcttcgtctacgtttcggacggaggaaccgaaggtgacgtataacgaaacggtacgtggtcggtactagaccacctattccgtgttaccttctaacc

SEQ ID NO: 65415 - DNA, 575 bp, Homo sapiens
  misc_feature: GYAE6OF02IN3C0.31.78.H01.1.454.CMB.1.raw
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
  modified_base (453)..(453): a, c, t, g, unknown or other
  misc_feature (453)..(453): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctctgggcgagagggccaccatcaactgacaagtccagcccagtagttgttttattcggccccaacaataacaactacttagcttggtaccagacagaaagtacggacagcctacctaaactcctgatttacgtggcttccgtaccggctacgtccgggttactaaccgattcattggcagtcgggtctcgggactatttcactctcaccntcagcacgtcctgcaggctagaatntggtcgatagtttatactgtcagctaatnttaacttactttctttcgtcttaccgttcgggcgtacgggaaccgtaagggttgacgtaagtaacccgaaagtaacgttggtaccgcgtaccgactacctactccgtacttccttacgtacc

SEQ ID NO: 65416 - DNA, 518 bp, Homo sapiens
  misc_feature: GYAE6OF02F13M8.31.78.H01.1.454.CMB.1.raw
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactggcttctacccggcatccggggttcctaaccgattcattggcagcgggtctgggaccgatttcactctcaccatcagcagcctgcaggctgaagatgtggctagtttattactgtcagcaacattatactttctttacgtctactttcggcggtaggaccaaggtggagatacgaaacgactgtcggctgcacatctgtcttntacg

SEQ ID NO: 65417 - DNA, 626 bp, Homo sapiens
  misc_feature: GYAE6OF02JFDDR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggccccaacaataacaactacttagcttggtaccagcaagaaagtaggacagcctacctaaactcctagtatttacgtcgggtcttccgtacccgggctacgttccggggttacctaaccgtattcagttcggcaggtcgggtcgtacggggtacctactttccactcctaccaacctatccagccacgtcctgacgacggtctagaaacgtagttcggtaggactttagtttactacgttgtcgaacgtactaacttatttaacttactttcgtttacgttctaccgtttcgggacgggtacggtaacgtagggtagacgtacgtaacgaaacgtacgtggtacggctacgactaccgtattcgttacgttcttaccgtaccg

SEQ ID NO: 65418 - DNA, 674 bp, Homo sapiens
  misc_feature: GYAE6OF02ISVIJ.31.78.H01.1.454.CMB.1.raw
  modified_base (280)..(280): a, c, t, g, unknown or other
  misc_feature (280)..(280): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggacgggccaccatcaactgcaacgtccagccagtagttgttttattcggccccaacaataacaactacttagcttggtaccngacaagaaagtaggacagacctacctaaactcctgtactttacgcgggtcttcgtacccgggctacggtcccgggttacctaaccggattcgaattggacctaggtccgggtctacggggacctatttccactctaccaacctagtaccagtccgacgtcctcggaccacgggtctaggaaacgacgttcgggtcggtacgttaaggttttaacttacgttgtacacggtactaaacttatttaacttacctttacgttttccgtaccgttacgtttccgggaaccgggtaacggtaaccgtaagggtcggtaacgacgttaaccgaaaaccggtacgttcggtcggaccgtaggaccctaacctacgttccgtacgtttaccctacttaaccg

SEQ ID NO: 65419 - DNA, 543 bp, Homo sapiens
  misc_feature: GYAE6OF02F9UL8.31.78.H01.1.454.CMB.1.raw
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccacaataacactactagcttggtaccagcagaaagtaggacagcctactaaactcctgatttactgggcttcgacccgggcacgttccggggttacctaaccgattccagttcggcaggcgggtctgggaccatttcactctcaccatcagcagctgcaggctagaagtatggtcgctagtttacttactgtacagctaatattatactttctttctcttacgtttcggcggtacggacctaagggtggagtactacgtaaacgacttggtaggctgacactagtcttcgtcttntaccg

SEQ ID NO: 65420 - DNA, 774 bp, Homo sapiens
  misc_feature: GYAE6OF02H2YMY.31.78.H01.1.454.CMB.1.raw
  modified_base (200)..(200): a, c, t, g, unknown or other
  misc_feature (200)..(200): n is a, c, g, or t
  modified_base (253)..(253): a, c, t, g, unknown or other
  misc_feature (253)..(253): n is a, c, g, or t
  modified_base (352)..(352): a, c, t, g, unknown or other
  misc_feature (352)..(352): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaacggggacatcgtgatgagccagtttccagactccctggctgtgtctctgggcgagngggccaccatcaactgcaagtccagccagacgttgttttattcggcccccaanaaactaacaactacttagctggtaccagcaagaaagtcggacagccctacctaaactcctagtactttacgtcgggtaccttaccgtaaccccggggtntaaccggttcccgggggtttaaccctaaaccggatttaccgacgtttacggcctaaggtccgggggttacttacggggaacccgttatttaccaccgttactacccaacccgttataccgaaacggtccacgtcccgttacggaccgacgggtacgtaacggtaaaggtacgtaccggtaggtacgttaacggtttaacgtttaccgtagtaccgtacggtaacaaacttacgtttaacgttaaccgttttccctttacgtaccgttaccggtttaccggtaccgggtaaacggacccgttaagggtaccgggtaacgtaaccgtaaaccggtaaaccggtaaaccggttggtaaccggttacgtaccggtaaccctaacccggttacctttaaccggttcgttaaccggttacttaacccg

SEQ ID NO: 65421 - DNA, 716 bp, Homo sapiens
  misc_feature: GYAE6OF02JZBXW.31.78.H01.1.454.CMB.1.raw
tcagcagtagacgtcacgaccggtgctcgatttagtgtgagtagtttgggtttgggggtaggctacaacaggcaggcaggggcgagcaagatggtgttgcagacccaggtcttcatttctctgttgctctggatctctggtgcctacggggacatcgtgatgagccagtttccagacctccctggctgtgtctcgtgggcgagagggcccaccacgtcaactgcaagtccaagccagagttgttttattcggaccccctacaataacaactactagctaggtaccagcaagaagtaggacagaccctacctaaacctcctatactttacgtcggtcttaccgtaccccggggctaacgttcccggggtttacctaaccgtacgttaccgtacgttcggcctaacgggtccgggtccttacggggacccgtacgttttaccaccgttacctccgaaccctacgtactaacgcctacgtccgtgacctacgggtactacggaacgtagtaggtcggcgttaacgtttatttacgtcgtacgacgtacaaccttaagttacttaacctttcgtttaccgttaccgttaaccggtttaccgggtaccgggtaacgggtaacccgttaagggtacggtacggtacttaacgaaaccggttaactcggtacggttaccgtgaaccgtacctaccgtaacgttcgttaccgttccttaacccg

SEQ ID NO: 65422 - DNA, 625 bp, Homo sapiens
  misc_feature: GYAE6OF02GQB18.31.78.H01.1.454.CMB.1.raw
  modified_base (320)..(320): a, c, t, g, unknown or other
  misc_feature (320)..(320): n is a, c, g, or t
  modified_base (438)..(438): a, c, t, g, unknown or other
  misc_feature (438)..(438): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactacttagcttggtaccagcaagaaagtaggacagcctacctaaactcctagtactttacgngggtccttcgtacccgggctacgttcccggggttacctaaccggtattcagttcggcaggtcgggtctagggaccgtatttcactctcacctatcagcacgcctgcaggctagaagtntgtgctagtttactacgtgtacagtactaactattacttacctttcgtttaccgttacgttaccgtttcgggaccgggtaacgggtaaccgtaagggtacggtacgtaactaaccgtaaaacggtacgttcgggtacggtaccgtacgacctaaccgtagttacccgttcgttaccttacgtacccg

SEQ ID NO: 65423 - DNA, 590 bp, Homo sapiens
  misc_feature: GYAE6OF02F8QAK.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctggcgagagggccaccatcaactgcaagtccagccagagttgttttattcggccccacaataacaactacttagcttggtaccagcagaaagtaggacagcctacctaaactcctgatttacngggcttcgtacccgggctacgtcccggggttcctaaaccgtattccatttggccaggccgggtctggggacccgatttcgactctcaaccatcagcagcctgcaggctgaagatggtgactagtttactacgtgtcagtacataattatacctttctttcgtacttacgtttcgggcggtaacggtaccgtaagggttagggactacgaaccggtaaacgtacgttacgggtacgtcgtacgacctacgtaccgttacgtacgtttcctattacccg

SEQ ID NO: 65424 - DNA, 547 bp, Homo sapiens
  misc_feature: GYAE6OF02F35V5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctactaaactcctgtatttactgggcttcgtacccgggcacgtcccggggttacctaaccgattcattggcaggcgggtctgggaccgtatttcactctcaccatcagcagcctgcaggctgaagatggtgctagtttattacttgtcagacaactattaacttacttctttcgttctacgtttcggcggtaggaccgtaaggtggagagtacgaaacgtaacgtggtcgcgtagcaccgtatcgtcgttcttctac

SEQ ID NO: 65425 - DNA, 539 bp, Homo sapiens
  misc_feature: GYAE6OF02IPR7K.31.78.H01.1.454.CMB.1.raw
  modified_base (326)..(326): a, c, t, g, unknown or other
  misc_feature (326)..(326): n is a, c, g, or t
  modified_base (409)..(409): a, c, t, g, unknown or other
  misc_feature (409)..(409): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaaccatcaactgcaagtccagccagagtgttttattggccccacaataacaactacttagcttggtaccagcaagaaagtaggacagcctcctaaactcctgatttactggcttctaccggnatccgggttcctaacgattcatggcagcgggtctgggaccgtatttcactctcaccatcagcagcctgcaggctgaagatcgngctagtttattactgtacagacaactattagtacctttcgtttcgtcgtactttcgggcggaaggacctaaggtggagaatacgaaacgtacctgtacggtctaggacacctatcgtcgtacgttctacg

SEQ ID NO: 65426 - DNA, 555 bp, Homo sapiens
  misc_feature: GYAE6OF02HJ9JI.31.78.H01.1.454.CMB.1.raw
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagtgttttattcggccccaacaataacaactacttagcttggtaccagcaagaaagtaggacagcctacctaaactctgattacnggcttcaccggnatccgggttcaacgntcattgcagcggtctgggaccatttcactctcacatcagcagctgcagctgaagatgtgctaggtttacttacgtgtacagactaactattacttactttctttcgtactaccgtttcggcggtaacggtaccgtaaggtcggagtaacgtaccgtaaaacgtacgttcgtacggtacctacgtacaacccgtatttcgtacgttccttatacccg

SEQ ID NO: 65427 - DNA, 611 bp, Homo sapiens
  misc_feature: GYAE6OF02G8WH9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccgatcaactgacaacgtccagccagagttgttttattcggaccccacaataacaacttacttagcttggtaccagcaagaaagtaggacagcctactaaactcctgtactttacgtgggtccttccgtacccgggctacgttccccggggttacctaaaccgtattcgagttcggcaggcgggtctgggacctatttcactctccacatcagcacgcctgacaggctagaagacgtggtcgacttaagtttacttacgtagtcaagcctaattacgttacttaccgtttctttacgtccgttacgtttcggggacggtaacggaaccgtagggtggatacgtaacgaaacgtacgttggtacggtccgtacgacctaccgtattccgtcgtccttacgtacc

SEQ ID NO: 65428 - DNA, 523 bp, Homo sapiens
  misc_feature: GYAE6OF02FIW9Y.31.78.H01.1.454.CMB.1.raw
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatttggccccacaataacaactacttagcttggtaccagcagaaaagtaggacagcctcctaaactcctgatttactgggcttctacccggggcaattcccggggttcctaaacccgtattcattggcagcgggtctgggaccatttcactctcaccatcagcagctgcaggctgaagatggngctagtttatactgtcagcaacattatacttctttcgtctactttcggcgaggccaagggtgagatcaaacgactggtcgctagcacctatctcgttactctac

SEQ ID NO: 65429 - DNA, 617 bp, Homo sapiens
  misc_feature: GYAE6OF02HYWDW.31.78.H01.1.454.CMB.1.raw
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgtttttattcggccccaaccaaataacaaactacttagcttggtaccagcaagaaagtagacagcctactaaactcctgatttacgnggtcttccgtaccggntacgtccgggttcctaacgtntcattgcagtcgggtctgggacctattcactctcaccatcagcagcctgacgaggctaggaaagtagtcggtgtacctaagttttaacttacgtgtacaacgaccaaattactttaattacctttctttaccgttctaaccgttttcgggacgggtaacgggtaaccgtaaggggttacgagtacttaaccgaaaacggtaccgttaggtcggtactccggtacctaaccgatttaccgttggtttaccttacgtaaccg

SEQ ID NO: 65430 - DNA, 846 bp, Homo sapiens
  misc_feature: GYAE6OF02G6LGJ.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctactaaactcctagtactttacgngggtccttccgtacccgggctacgttcccggggtttaccctaaaccgtatttccaagtttcgggactacgggtccggggttcgttacgggggaacccctagtttttacccaactttcccgttaacccaaaccccgtaacgtttcccgaaacggtaccctaacggtccccttagggacccgtaaacggggtcccgttaagggaaaacggtacgttacgggttacggggtacgttaacggttttttaaactttaaccgtttacggttaacgaaaccggtaaccttaaaaccgttaatttttaaaccgtttaacccttttttcccgtttttaccggtttaacccgtttaacccggttttttccggggaacccggggttaaacggggtaacccgttaaagggggttacgggtaacggtaaccgttaaccggtaaaaaccggtaaccggtttacgggttaccgggtaccgtttacggaacccttaacccgttaacgtttacccgtttacggtttaccctttacccgttaaccg

SEQ ID NO: 65431 - DNA, 672 bp, Homo sapiens
  misc_feature: GYAE6OF02H791I.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtgacagcctaccctaaactcctagtactttacgtgggtcttccgtacccgggctacgttcccggggttacctaaccgtattccagtttcggccgtaggtccggggtcgtcggggacccgtacttttccaccgttctccaccgatccacgctacgccctggccagggtcctaggaaagtagtggtggtaccgttaagttttattaacgtgtacacgtacaactatttaattacctttctttaccgtaccttacgttttccgggacgggtaacgggaacccgtaaggggtaggtacggtaacgtaaccgtaaaacggtaaccgttgggtaacggtccttacgggtaccctaaccgtaccttacccgtttacggtttccttacccgttaaccg

SEQ ID NO: 65432 - DNA, 734 bp, Homo sapiens
  misc_feature: GYAE6OF02I92O9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggcccacctatccaactgactaagtccagccagtagttgttttacttcggacccccaactaataacaactacttagtcgttacggaccagacaagaaaggtacggacacgtaccctaccgtaaacctccgtagtaactttacgtcggtccttaccgtaccccgggtctacgttccggggttaccctaaaccggtacttcgacgttacggaccacgggtccgggtacgtacgggggtaaccttacgtttccgaaccgttcctaccgtaccctaagtccgacgtccgtacgtccctggaccgacggtacgtaggtaacgtgtaggtcggacgttaacgtttaacgttacgttacgacgtacgtactaaacttacgtttaacttaccgtttcgtttaccgttaccgttacggtttccgggacgggtaaccggtaacgtaagggttacggagtaacgtaaccgaaacggttacgtacgggtacgaccgtacgtaccgtacccgtacttaccgtacgtttcgtaccttacccg

SEQ ID NO: 65433 - DNA, 548 bp, Homo sapiens
  misc_feature: GYAE6OF02GVUIU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtcccggggttcctaaccgattcattcggcagcgggtctgggacctatttcactctcacctatcagcagcctgcaggctgaagatgtgctagtttattactgtcagcaactattatactttcgtttcgtctacgtttcggacggtaggaccgaaggtggagataccgaaaacgtacgttggtcggtacgtggacctaccagttccgtagttccttctacc

SEQ ID NO: 65434 - DNA, 535 bp, Homo sapiens
  misc_feature: GYAE6OF02GQQYP.31.78.H01.1.454.CMB.1.raw
  modified_base (372)..(372): a, c, t, g, unknown or other
  misc_feature (372)..(372): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtagacagcctcctaaactcctgatttactgggcttctacccgggcacgtccggggttcctaacgattcattggcagcgggtctgggaccgntttcactctcacatcagcagcctgcaggctgaagatgtggctagtttatactgtcagctaacattatactttctttcgtctacgtttcggcggtaggaccgaaggtcggagacgtacgaaacgtaacttcggtaggtctaggctaccattctagttcttctac

SEQ ID NO: 65435 - DNA, 771 bp, Homo sapiens
  misc_feature: GYAE6OF02I61UG.31.78.H01.1.454.CMB.1.raw
tcagcagtagacgtcacgaccggtgctcgatttagtgtgagtagtttgggtttgggggagctacaacaggcaggcgaggggcagacaagatgggtgttgcacgacccgaggttcttctatttctcttgttgctctggatctcgtggtcgccgtacggggacatcgtgatgagcctagtttccagacctccctggctgtgtctcgtgggcgagacgggccaccatacaactgacaagtccacgccagtagttgttttagttccggacccccaactaataaccaacttacttacgtcttcggtaaccagacaaggaaaggtacggacacgtaccctaacctaaacctcctagtactttacggtcgggtcctttacccggtacccgggtactaccgggtttccccgggggttaccctaaaccggtactttacgtacgtttcggaccgtaggggtacccgggttccggttacggggtaaccccgttactttttaccgtaacccttaccgtttacccgaaaccctacgttaccgaacgccgtaaccggtccccgtaggaccgtacgggtaccgtaaggtaaagtacgttagggtacggtactttaaggtttacttacgttcgtacgaacgtacctaaacttattttattacccttttctttaccgttaccttcggtttaccgggacggtacggtaaccggtagggtaggactacgtaaccgaaacgttactgggtacggacctacggacctacgtacttcgtcttactacttaccg

SEQ ID NO: 65436 - DNA, 535 bp, Homo sapiens
  misc_feature: GYAE6OF02I5VWB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgattttcactctcaccatcagcagcctgcaggctgaagatgtggcagtttaatactgtcagacaactattatacttctttcgtctacgttttcggcggtaacggaacaagggtggagaagtcgaaaacgactaggtggcctgccaccaatcgtcgttacttctac

SEQ ID NO: 65437 - DNA, 717 bp, Homo sapiens
  misc_feature: GYAE6OF02JTAY0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggacgggccaccatcaactgcaagtccagccagtagttgttttacgttcggacccccaactaactaaacaactacttagcttggtaccagcaagaaagtggacagcctactaaactctagtatttacgtggtccttccgtacccggctacgttcccggggttacctaaccggtacttacctacgttacggtaaccgacgggtccggggttacgttacggggtaacccgtaacgttttccaacccgttccgtaccacccgtaagttaccgtacgaccgtaacgtcccgttcggaccgtaacgggtccctaagggaaacgtagttacgggttacggtaaccgttaggttttaacttaacgttcgtacgtaacggacctaacgttaactttacgtaaccttttctttaccgtaccgttacgttttaccgggacggtacgggtaaccgtaggtacggattacgtacgaaacggtacgtacggtggtactacggacctacgacctttcgtacgttcctataaccg

SEQ ID NO: 65438 - DNA, 588 bp, Homo sapiens
  misc_feature: GYAE6OF02GXK88.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagccctacctaaactcctgtaatttacgtgggcctttccgtaccccggggctacgttcccggggttacctaaccggtattcattcggcaggtcgggtctcggggacctatttcactctcaccatcagcagcctgcgaggctagaaagagtggtggacttagtttattacgtgtcacgtactaactatttaacttactttctttccgtcttaccgtttcggacggtaacgggtacctaagggtgtagtataccgaaaacgtacttagtcggtctgaccacgtatccttgtaccttcgtac

SEQ ID NO: 65439 - DNA, 742 bp, Homo sapiens
  misc_feature: GYAE6OF02IHQ4J.31.78.H01.1.454.CMB.1.raw
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagtgttttattcggccccaacaataacaactacttacgcttcggaccagcaagtaaagtaggacagtccctacctaaactcctagtactttacgtgggtcctttaccgacccgggntaaccggttcccggggtttaccctaaaccggtatttccgaagtttcggcctagggtccgggttacgttacggggaacccgttattttccgaccttctaccgtaacccattcccaacggcctaacggtcccctaggaccgaaggggtccttagggaaacgtacgttgggtacgggtacttaaaggtttttaacttaccgtacggttaccaacggtacctaaaacgttacgtttaacttaccttttccgttttacggttaccttaaccgggttttcggggaccgggtaaacgggtaaacctaagggggttcgaacgtacgtaaaccgtaaaacggtaacgttgggacggtacctcggacctaaccttaacgttccgtacgtttacctaccgtaacccg

SEQ ID NO: 65440 - DNA, 888 bp, Homo sapiens
  misc_feature: GYAE6OF02HUB87.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggaccccacaataacaactacttaacttggtaccagcaagaaagtaggacacgcctacctaaactcctagtactttacgtgggtccttacgtaccccggggtctacggttaccccgggggtttaccctaaaccggtactttaccgagtttcgggaccgagggtccgggggttccgtacggggggaaccccgttaattttccgaacccttccgttacccaaacctacgttacccgaacggtcccgtaacggtccccttacggacccggtaaacggggttaccgttaagggaaacggtacggtttgggttaccgggtaacccgttttaaggtttttaaccgttttaaccgttacgggttaacctaaccggttaacctaaaacgttaacctttttaaaaccttttacccgtttttacccgtttttaccggttacccgtttaaccggtttttcccggggaaccgggggttaaccggggtaaacccggttaaacgggggttacggtaaacgggtaacttaaacccgggtaaaaacccggttaaacggtttcgggttaacgggtaacccgttacgggtacccctaaacccgttaacgtttcccggtttacccggttttaccttttacccgtttacccgtttttaccccccgg

SEQ ID NO: 65441 - DNA, 587 bp, Homo sapiens
  misc_feature: GYAE6OF02HQSWM.31.78.H01.1.454.CMB.1.raw
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagtgttttatcggccccaacaataacaactacttagcttggaccagcaagaaataggacagcctacctaaactcctagatttacgngggtccttccgacccgggcacgtccggggttacctaaacgnttcagttcggcaggcgggtctggggacctatttccactctaccaccatcagtcagcctgcagctagaagagtgtcggatagttattactgtcacgacaactattacttacttctttcgtcgtaccgtttcgggacggtacggaaccgtaagggtacggagtactaaccgaaacgtacgttaggtacggtacgtacggtacctaaccgtacttacgtacgttcctacgtacg

SEQ ID NO: 65442 - DNA, 769 bp, Homo sapiens
  misc_feature: GYAE6OF02JYEZE.31.78.H01.1.454.CMB.1.raw
tcagcagtagacgtcacgaccggtgctcgatttagtgtgagtagtttgggtttgggggtaggctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggcccaccatcaactgacaagtccagccagagtgttttattcggccccactaactacaactactagcttggtaccagcagaaagtagacagcctaccgtaaactcctagtaactttaccgtgggtcctttccgtaaccccgggctaacgttccccgggggttacccttaaacccgtattaccgtaacgtttggacctaacgggtcgggttccgtacgggggaacccctaacgtttttccaaaccgttccctaccctaaccctacttaccgaaggtccaacggcccgttacgcgtaaacggggtccttaagaaacggttaacgtggttacgggtaccttaaggttttaaacgtttacgttaccggtacttacggaaccctaaagttaacgttttaacttaaccgttttccgttttaccgttaccgttacgttttacccggggacggggaaacccggtaacctaagggggtacggttaactaacgggttaacgtaaacggttaaccttacggggtcgtaccgtaggtaccctacgtacgttaccgtaccggttacctacggttacc

SEQ ID NO: 65443 - DNA, 766 bp, Homo sapiens
  misc_feature: GYAE6OF02FF350.31.78.H01.1.454.CMB.1.raw
  modified_base (139)..(139): a, c, t, g, unknown or other
  misc_feature (139)..(139): n is a, c, g, or t
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtnccgtacgggacatcgtgatgacgcctagtttccagacctcccgtggctgtcgtctcgtgggccgaggacggccaacatcaactgacaacgtccagccagtgtttattttacgttccggaccccaacaataaccaactactgcttacgaccagacgaagaaagtcggaccacgtccctaactaaactctagttactttacgcggtccttaccggacccgggntacggttcccgggttacctaaacgtnttacgtagttcggacgtacggggtcggttacgtcgggtaacctacgtttaccaccgttcctaccgaaccgtacgtccgaacgccgtaacgtccgtacgacggtacggtaacgtaggaaacgttcgttacgggttaccggtaacttttaacggtttaccgttaacgttacggtaacctaaacggtaccttaaactttaaccgttttaaccttaccgtttttaccgttaaccgttaccggttaaccggtttaccggggaaccggtaaaccgggtacgtaagggtaccgtactaaccgtaaccggtaaaccggtcggtacggtaccgtccgtaaccgtacctaaccgttaccgttccgtaccgttaccttaccctaaccccgg

SEQ ID NO: 65444 - DNA, 539 bp, Homo sapiens
  misc_feature: GYAE6OF02JIPC0.31.78.H01.1.454.CMB.1.raw
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctactaaactcctgatttacngggcttctacccgggcatccggggttccaacgnttcattggcacgcgggtctgggaccgtagttcactctcaccatcagcagcctgcaggctgagatgtgctagttatactgtacagcaactattatctttctttctctacgtttcggacgggtacgggaccaagggtacgagtacgtacgtaaaacgtacttggtacggctagtacacctatcgtcgttctctaccg

SEQ ID NO: 65445 - DNA, 610 bp, Homo sapiens
  misc_feature: GYAE6OF02HVIWI.31.78.H01.1.454.CMB.1.raw
  modified_base (264)..(264): a, c, t, g, unknown or other
  misc_feature (264)..(264): n is a, c, g, or t
  modified_base (312)..(312): a, c, t, g, unknown or other
  misc_feature (312)..(312): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggccccacaataacaactacttancttggtaccagcagaaagtaggacagcctcctaaactctgatttacgnggtcttcgacccgggctacgttcccggggttacctaaaccggtatttccgaagtttcggcctaaggtccggggttctcggggtaacccgtattttccgaacttctccaacctatcagccagccctgccaggctgaagagtgtggctagtttatactgtcagacaatattatactttctttcgtctacgtttcgacgggtaggaaccgtaagggtggagtacgtaacgaaaacggtaaccgttgggtacggtccgtcggtacctacccgtaattccggttacgttccttaccgtaaccg

SEQ ID NO: 65446 - DNA, 604 bp, Homo sapiens
  misc_feature: GYAE6OF02GEQOH.31.78.H01.1.454.CMB.1.raw
  modified_base (270)..(270): a, c, t, g, unknown or other
  misc_feature (270)..(270): n is a, c, g, or t
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgacaagtccagccagtagttgttttattcggccccaacaataacaactacttancttggtaccagcaagaaagtaggacagcctacctaaactcctgtatttacgngggtcttccgtacccgggctacgttcccggggttacctaaccgattaccattggcaggccgggtcgtcgggacctatttcactctccaccatcagcacgcctgcaggctagaagtagtggtggtactaggtttaattactgtacagacaactatttactactttctttacgtcttaccgtttcgggacggtacggaaccgtaaggtcggagtacgtaaccgaaaacggtaacgttggtacggtccgttagacctacctacgttcgtacgttccttactaccg

SEQ ID NO: 65447 - DNA, 712 bp, Homo sapiens
  misc_feature: GYAE6OF02I1M0B.31.78.H01.1.454.CMB.1.raw
  modified_base (338)..(338): a, c, t, g, unknown or other
  misc_feature (338)..(338): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagactccctggctgtgtctcgtgggcgagacgggccaccatcaactgacaagtccagccagtagttgttttattccggaccccaactaataacaaccgttacttagcttacggtaccagcaaagaaagtaggaccagaccctacctaaactcctagtaactttaccgnggtccttaccgtacccgggctacggttccgggttacctaaccgtattccgtagttcggctaggcgggttctacggggtaacccgtatttcccgtacttccgtacccacgtacgtaccgacgtacgtaacgtcctacggccgtaacggtacgtacgtaaaacgtggtacgggtacggaccttaaggtttacttaaccgttcgttacgaaccgtactaaacgttacttacgttaaccgttttccgtttaccgttaccgttaaccgttttccgggacgggtaaacggtaaccgtaaggtaggtacgtacgtaaccgtaaacggtacgtaggttacggaccttacggacctaccggtattccgtgttacctacgtccc

SEQ ID NO: 65448 - DNA, 705 bp, Homo sapiens
  misc_feature: GYAE6OF02JTP8P.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagagggccacatcaactgcaagtccagccagagttgttttattcggccccaacaataacaactacttagcttggaccagcaagaaagtaggacacgccctacctaaactcctagtaactttacgtgggtccttaccggtacccgggctacgttccccggggttacctaaacccgtattccgtagttcggcacgggtccgggttacgtacggggaccctagtttccgaccttccgtaccacctacttccgaacgtccaacgtcccgtacgtacgacggtactaggaaagtacgtggtacggtacttaaggttttacttacgttacgttacgtacactaaccttaattaacttacctttaccgttttaccgttaccgttaccggttttccgggaaccgggtaacgggtaaccgtaaggggttacggacgtaacgtaaccgtaaaacggtaacgttggtaacggtctaccggtacctaaccgtacttaccgttacttccttaccgtaccg

SEQ ID NO: 65449 - DNA, 578 bp, Homo sapiens
  misc_feature: GYAE6OF02JHDH1.31.78.H01.1.454.CMB.1.raw
  modified_base (307)..(307): a, c, t, g, unknown or other
  misc_feature (307)..(307): n is a, c, g, or t
  modified_base (347)..(347): a, c, t, g, unknown or other
  misc_feature (347)..(347): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacgggacatcgtgatgagccagtttccagactccctggctgtgtctctgggcgagagggccaccatcaactgcaagtccagccagagtgtttattggcccacaataacactacttagcttggtaccagcagaaataggacagcctcctaaactcctgaactttacngtacgctttctaacccgggcagtcccggggttcctaacgnttccattggctagcggtctgggacccatttcaacgttcncaccatccagctacgcctgcaggctggaanatgtgacagttttacttacgngtcagccctaaagtatttactacgtttctttaccgtctaacgtttcggaccggtaggacctaaggttcggaagacgttaccgaaaacgttagttcggaggttcctaggtaccctaccgaagtttccttaggtcctttaccg

SEQ ID NO: 65450 - DNA, 594 bp, Homo sapiens
  misc_feature: GYAE6OF02HEP4E.31.78.H01.1.454.CMB.1.raw
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (433)..(433): a, c, t, g, unknown or other
  misc_feature (433)..(433): n is a, c, g, or t
  modified_base (457)..(457): a, c, t, g, unknown or other
  misc_feature (457)..(457): n is a, c, g, or t
  modified_base (531)..(531): a, c, t, g, unknown or other
  misc_feature (531)..(531): n is a, c, g, or t
tcagcagtagacgtcacgaccggtgctcgatttagtgtgagtagtttgggtttgggggtagctacaacaggcaggcaggggcagcaagatggtgttgcagacccaggtcttcatttctctgttgctctggatctctggtgcctacggggacatcgtgatgagcctagtttccagacctccctggctgtgtcctcgtgggacgagacgggccaaccatacaactgcaagtccaagccagtagttgttttatcggcccccaacaaataacaacgtactaagctaggtaccagcagaaagtaggacngcctaccaaactcngtattacgnggtctcaccggnacgtccgggttccaacgatcagtgacagcggtctaggccgtatttcacgttctcgactaactcgagacgacgtacctgcgtacgcttacggaanagtcgtaggctacggttattacgngtccagtacaactaattaacgtttccttactttccgtgttaccttcgggcggtaaacgggaactacggaggtanacgtaccgaaacgtaacgtgtacggacgtcgtacgacctaacgcgtttacgttctacgttacc

SEQ ID NO: 65451 - DNA, 832 bp, Homo sapiens
  misc_feature: GYAE6OF02HQVQK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagagggccaccatcaactgacaagtccagccagtagttgttttattcggccccaacaataacaactacttagcttaggaccagcaagtaaagtaggacacgccctacctaaactcctagtactttacgtgggtccttccgtacccgggcacggttcccggggttacccctaaaccggtattaccgtagtttcggaccgtaacggggtccggggttccgtacgggggaaccccgttagttttaccaccgttcccttacccgaaccctattacccgaacgcccgtaacggtccccgttagggacccgtacggggtaccttaagggaaaacggttacgtcgggttacgggtacctttaaagggtttttaacgtttaccgttacggttacctaacgggtaccttaaaacgttagttttaaaccgtttaccgtttttccgttttacccgtttaaccgtttaacccgggttttaccggggtaaccggggtaaacgggtaaacccgggtaaacgggggttcggaaacgttaaccgttaaaccggtaaaaacccgggtaaccggttacggggtaccgggtaccgttacgggaaccctaacccgtacgtttcccgttacgtttaccgttacccgttaacccg

SEQ ID NO: 65452 - DNA, 522 bp, Homo sapiens
  misc_feature: GYAE6OF02GFCBC.31.78.H01.1.454.CMB.1.raw
  modified_base (348)..(348): a, c, t, g, unknown or other
  misc_feature (348)..(348): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattggccccacaataacaactacttagcttggtaccagcagaaagtaggacagcctacctaaactcctagatttactgggcttcgtacccgggcatccggggttcctaaccgnttcattggcagcgggtctgggaccgtatttcactctcaccatcagcacgcctgcaggctgaagatgtggctagtttactacgtgtcagcaactattactactttctttcgtctacgtttcggcggaggaccaagggtgagatacgaaacgactgtgctgcacatctgtcttcac

SEQ ID NO: 65453 - DNA, 625 bp, Homo sapiens
  misc_feature: GYAE6OF02FJKPL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccacatcaactgcaagtccagccagagttgttttattcggaccccacaataacaactacttagcttggaccagacaagaaagtaggacagcctacctaaactcctgtactttacgtcgggcttccgtaccccgggctacgttcccggggttacctaaccggtattccgagttcggcacggtccgggtcgtacggggaacccttatttccgaaccttcctacctaacctactccacgccacgtcctgaccgaggctagaagtagtcggtggacttagtttactacgttgtaccagtactaactattacttactttcctttcgtactacgtttccgggacggtacgggtacctaagggtgagtacgtacgtaaacgtacgtggtacgtcgtacggacctaccgtagttcgtcgttacctactaccg

SEQ ID NO: 65454 - DNA, 554 bp, Homo sapiens
  misc_feature: GYAE6OF02I9N3D.31.78.H01.1.454.CMB.1.raw
  modified_base (423)..(423): a, c, t, g, unknown or other
  misc_feature (423)..(423): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccaacaataacaactacttagcttggtaccagcagaaagtaggacagcctacctaaactcctagatttactgggcttcgtacccgggcacgttcccggggttacctaaccgattcattggcacgcgggtctgggaccgtatttcactctcaccatcagcagcctagcaggctagaanatgtgctagtttatctgtacagacaacattattaccttctttcgtctacgtttcggacggaggaaccgtaaggtcgagtatacgaaacgtacgtggtgtaccgtgacaccgtatccgtagttccttctacg

SEQ ID NO: 65455 - DNA, 661 bp, Homo sapiens
  misc_feature: GYAE6OF02HAWHP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagccctacctaaactcctagtactttacgtgggtcctttccgtacccggggctacgttcccggggttaccctaaaccgtattccagttcggcacggtcgggtcgtcgggaccgtatttcgactctacaccatcacgcacgcctgcgaggctagaagtatggtacggacttaggtttacttacgttcgtacgacgtactaactatttacttacctttctttccgtaccgttaccgttttacgggaccgggtaaacgggtaccgtaaagggttggaacgtacgtaaccgtaaaaccggtaacgttacgggtacggtaccgttagtacccgtaaccgtacgttacccgttacggtttacccttaccgttaacccg

SEQ ID NO: 65456 - DNA, 688 bp, Homo sapiens
  misc_feature: GYAE6OF02IAOKA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacggccaccatcaactgcaagtccagcagagttgttttattcggaccccacaataaccaactacttagcttaggtaccagcaaggaaaagtggacacgcctacctaaactcctagtactttacgcgggtcttaccgtacccgggacacggttccccggggttacctaaaccggattccgtaagttcgggacctaagggtccgggtcgtacggggaacccttaactttccgaacctcttaccaaacccgtgtacccgacgtccgacgtccctaggtccgaggtcctaggaagtaacgtggtcggacttaagtttaagttactcgtactagaaccaaacgttactttaacttaccgttttccgtttacgtccgttaacgttccgggtacgggaacggtaaccgtaggttacgggaacgtacgttaacgaaaaccggtaacgtcggtacgtaccgttcgacctactacgttcgtcgttaccgtacttacccg

SEQ ID NO: 65457 - DNA, 654 bp, Homo sapiens
  misc_feature: GYAE6OF02H08ZO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacgggccaccatcaactgacaagtccagccagtagttgttttattcggccccacaataacaactacttagcgttggtaccagacaagaaagtaggacacgcctacctaaactcctagtattacgtcggtcttccgtacccggctacgttcccgggttacctaaccgtattcagttggaccaggtcgggtcgtacgggtaccgtatttccacttcctacacctactacagcacgtcctgacgaggtactagaagtagtcggtgtacttaagtttacttacgtgtacagtaccaaactattaacttacctttcgtttacgttaccgttaccgtttcgggacgggtaacgggtaccgtaagggtacgtaacgtacttaaccggaaaccggtaacgtggtaccggtaccgtacggtaccctaaccgttacgttacgttcgttaccgttactaaccg

SEQ ID NO: 65458 - DNA, 675 bp, Homo sapiens
  misc_feature: GYAE6OF02IVQMQ.31.78.H01.1.454.CMB.1.raw
  modified_base (371)..(371): a, c, t, g, unknown or other
  misc_feature (371)..(371): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctctgggcgagacgggccaccatcaactgcaagtccagccagtagttgttttattcggcccccaacgtaataaacaactactagtcttggtaccagcaagaaagtacggacacgcctacctaaactcctgaactttacgtggccttccgtacccgggctacggttcccggggttcctaacgtnttacgagttggctacggtcgggttcgtacgggaccgtagtttcaacgttccaccaaccctatacccgaaggtccacggcccttgcgaacggtctaggaagtagtggtcggtactagttttaacgtaccgttgtcgaaacgtacctaaccttaagttaacgttaccgtttacctttaccggttaccttacgttttaccggggaccgggtaacggtaacccgaaggggtcggtagtacgttaacgaaaccgggtaattcgggtacggacttgacccacgtaactccgtacgtttcctaccgtaccc

SEQ ID NO: 65459 - DNA, 555 bp, Homo sapiens
  misc_feature: GYAE6OF02JG1HD.31.78.H01.1.454.CMB.1.raw
  modified_base (399)..(399): a, c, t, g, unknown or other
  misc_feature (399)..(399): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaaataacaactacttagcttggtaccagcagaaagtaggacagcctacctaaactcctgatttacgtgggtcttccgtacccgggctacgtcccggggttacctaaccgtattcagttggcaggcgggtctagggaccgtatttcactcncaccatcagcacgcctgcaggctagagatgtgctagtttatactgtcatacactattattaccttctttcgtacttacgtttcgggcggtacggaccgtaggtagacgtacgtacgaaacggtatggtcgctagactactactctgttcttctacc

SEQ ID NO: 65460 - DNA, 791 bp, Homo sapiens
  misc_feature: GYAE6OF02FPBB3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccacatcaactgcaagtccagccagagttgttttattcggccccacaataacaactacttagcttggtaccagcagaaagtagacagcctacctaaactcctgtatttacgtgggcctttacgtaccccgggctacgttcccggggttaccctaaaccggtatttaccgaagtttcgggacctacgggtccggggttccgtacgggggtaaccccgtatttttccgaacctttccttacccaacccgtaacttcccgaaaggcccgtaacggtacccgttacggacccgtaacgggtacccgtaagggaaacggtagttacgggttacgggtaccgtttaaggttttttaacgtttaaccgtttcggttaaccgtaacgtaaccctaaaaccgttaaacttttaacgtttaacctttttcccgtttttaaccggtttacccgttaacccgttttttaccggggaccggggtaaacggggtaacccgttaaacggggtagggtaacgtaacgtaaccgtaaaacggtaaccgttagggtaacggtcgttacgacctaacccgtattccgtacgtttaccgttactaccg

SEQ ID NO: 65461 - DNA, 650 bp, Homo sapiens
  misc_feature: GYAE6OF02JCVT8.31.78.H01.1.454.CMB.1.raw
  modified_base (233)..(233): a, c, t, g, unknown or other
  misc_feature (233)..(233): n is a, c, g, or t
  modified_base (644)..(644): a, c, t, g, unknown or other
  misc_feature (644)..(644): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtggcgagagggccaccatcaactgcaagtccagccagagttntttattcgccccacaataacactactagctaggtaccagtcaagaaagtacggacacgcctaccgtaaactccgttagtaatttaaccgtgggtacctttccgtaaccccgggtactacgttaccccgggggtttaccctaaaccggtacttaccgtacttcggcgacggtcgggtccgtagggaaccgtacttcgaactcctacaccgtatctaagccagtcctagccgtagtctagaagatcgtaggacttagttacgttatacggtcacgtaccaaattgtttaacttacctttcgtttctaccgtaccgtttacgggccggtaaacgggtacaaggggttcgagtacgtaaccgtaaacgtaacgttggtaaccgtcgttagaccgtacctgttacgtcgttacctntacccg

SEQ ID NO: 65462 - DNA, 562 bp, Homo sapiens
  misc_feature: GYAE6OF02F99ZB.31.78.H01.1.454.CMB.1.raw
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
  modified_base (427)..(427): a, c, t, g, unknown or other
  misc_feature (427)..(427): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggcccacaataacaactacttagcttggtaccagcaagaaagtaggacagcctactaaactctgtatttacgngggcttcgtacccgggctatcgtgggttacctaacggtnttcgattcggcaggtccgggtctgggaccgtatttccgactcgtcaacctatcagcagcctgacaggctagaagntggtgactagtttattctagtcagactaatagttactacctttcgtttcgtcttacgttcggacggtaacggacctagggtagagtagtaacaaacgtagtcggtagcgtagactaccatcgttacgtcttaccg

SEQ ID NO: 65463 - DNA, 836 bp, Homo sapiens
  misc_feature: GYAE6OF02GHVJB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccaggagttgttttattcggccccaacaaataacaactacttagcttggtaccagcaagaaagtaggacacgaccctacctaaactcctagtactttaccgtcgggtacctttaccgtaccccggggctaacggtttaccccgggggtttacctaaacccggtacttttccgaacgtttcgggaccgtacgggtccggggttaccttacgggggtaaccccgttaacgttttccaacctttcccgtacccgaaccctagttacccgaaggtacccaacggtccccgttacggacccgtaacggggtaccgtaacgggaaaacggtacgttacgggttacgggtaccgttaacggtttttaaacgttaccgttaggttaccgaacggtaacctaaacttaaacgtttaacctttaccgttttaccgttttaccgttaccgttaaccggtttttccggggaaccgggtaaacggggttaaccgttaacggggttacgggtaacgtaacggttaaccggtaaaaccggttaaccgttacgggttaacgggtaccgttaacggacccgtaaccgtacgtttaccgttacgtttacccgtttacccgttaacccg

SEQ ID NO: 65464 - DNA, 603 bp, Homo sapiens
  misc_feature: GYAE6OF02GJX8L.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgtttttattcggccccacaataacaactacttagcttggtaccagacagaaagtaggacacgcctacctaaactcctagtatttacgtgggccttccgtacccgggctacgtcccgggggttacctaaccgacttcagttcggcaggcgggtctgggacctatttcactctcaccatcaacgcagcctgcaggctgaagatggtgctagtttactactgtcagacaatattaacttactttctttccgtcgttacgtttcgggacggtacgggtaaccgtagggtggactaagtaccgaaaacggtaaccgtttgggtacggtacgtcggaccaaccgtaacgttcgttacggtttccttacgttaacccg

SEQ ID NO: 65465 - DNA, 671 bp, Homo sapiens
  misc_feature: GYAE6OF02JQHEF.31.78.H01.1.454.CMB.1.raw
  modified_base (324)..(324): a, c, t, g, unknown or other
  misc_feature (324)..(324): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacgggccaccatcaactgacaacgtccagccagtagttgttttactcggaccccaacaataacaactacttagcttagtaccagcaagaagtagacagcctactaactctagtactttacgnggtcttaccgaccggtctacggttcccggggttacctaaccgtattaccgacgttcggacgtacggtcgggtcgtacgggtacctatttccgactcctaccaacctatacgacgtcacgtcctagacgtaggactagaagtacgtaggtcggtattagtttacttacgtcgtacacgtactaaacgtcttaacttacctttctttaccgttacgttaccgtttacgggaccgggtaaacgggtaaccgtaagggttaggtacgtaagttaaccggtaaacgtacggttaggtaccggtacgttaccgacctaccgttacttacggttacgtttaccgtaccttaccg

SEQ ID NO: 65466 - DNA, 587 bp, Homo sapiens
  misc_feature: GYAE6OF02HMX4T.31.78.H01.1.454.CMB.1.raw
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggccccacaataacaactacttagcttaggtaccagacagaaagtaggacagcctacctaaactcctgtatttacgngggtacttccgaacccgggntacgtccggggttacctaaccgattcagttcggcaggtcgggtctcgggacctatttcacttcctacacctatcagcacgcctgcaggctagaagtatggtggctagtttattactgtcagactaacattacttactttctttcgtacttacgtttaccgggacggtacggaccgtaaggtcggagacgtaaccgaaacggtaactggtacggtcgtacggactaccattcttacgttctactaccg

SEQ ID NO: 65467 - DNA, 623 bp, Homo sapiens
  misc_feature: GYAE6OF02IJNJ3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttatggccccacaataacaactacttagcttggtaccagcaagaaagtggacagcctacctaaactcctagtatttacgtgggtccttccgtaccccgggctaacgttcccggggttacctaaacccgtattccagtttcggactagggtcgggtcgtcggggtacccgtattttccactcctacaccctatcagcagtcctgcgagctagaagagtgtcggctaagtttatactgtcagtacaactattactactttctttacgtctacgtttcggcggtaacggtaccgtaaggtgggacgtaacgtacgtaaaaccggtacgttaggtacgggtaccttacggccgtaaccgtaccgttacgttccgttaccgtttactaacccg

SEQ ID NO: 65468 - DNA, 760 bp, Homo sapiens
  misc_feature: GYAE6OF02JHOJ3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaaccaataaccaactacttagcttggtaccagcagaaagtaggacacgcctactaaactcctagtatttacgtcgggtcttacgtaccccgggctacgttcccggggttaccctaaccgtacttcgtaagttcggacacggtcgggtcgtacgggtaccgtacgttttcaccttcgtccaaccctagtcccaagtccaacggtcccgtagaccggtaacgggtaccgtacggtaaagtaacgttcgggtacggtaccgttaagtttttaacgttaccgttggttacctaacgtaacccgtaaacttaacgttttaactttaaccgttttccgttttacccggtttaccgttaacccggtttttccggggaaccggggtaaccgggtaaaccggtaacggggttacgggtacgtaaaccgttaccggaaaaaccggttaacgttacgggtacgggtacttaccggaccgttaaccgtaccgtttaccgttccggtttaccttaccgttaacccg

SEQ ID NO: 65469 - DNA, 769 bp, Homo sapiens
  misc_feature: GYAE6OF02FX7JL.31.78.H01.1.454.CMB.1.raw
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
tcagcagtagacgtcacgaccggtgctcgatttagtgtgagtagtttgggtttggggagctacaacaggcaggcagggcagcaagatggtgttgcagacccaggtcttcatttctctgttgctctggatctctggtgcctacggggacagtcgtgatgagccagtttccagactccctggctgtgtctctgggcagagggccaccgatcaactgcaagtccagccagagtgttttattggcccaccaataacaactacttagcttggaccagcagaaagtggacagtctacctaaatcctgatttacngggctttcgtacccggggnagttcccggggttacctaaccggattcgatttggctaggcgggtctgggggaaccctattttccgaacttctacaacccgtattccaagccgaagtcccctaggtaccacggggtctacggtaaacggtaacgttcggtacggggaccctttaaggttttaaccgttttaaccggttacggtttaccgaacgttacccgtaaaaacggtttaccgtttttaaacgtttaaacccgtttttccgttttttaacccgggtttaaccctttaacccgggtttttttaaccggggacccggggtaaacgggggtttaaacccctaaagggggttacgggtaaggtaacgttaacccggtaaaaaccggtaaccgtttacgggtacgggttacttacgggaaccctacccggttaagtttacccgttggtttacccttgttaacccg

SEQ ID NO: 65470 - DNA, 682 bp, Homo sapiens
  misc_feature: GYAE6OF02F5IUN.31.78.H01.1.454.CMB.1.raw
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
  modified_base (407)..(407): a, c, t, g, unknown or other
  misc_feature (407)..(407): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (458)..(458): a, c, t, g, unknown or other
  misc_feature (458)..(458): n is a, c, g, or t
tcagcagtagacgtcacgaccggtgctcgatttagtgtgagtagtttgggtttgggggagctaacgaacgaggcaggtaggggcaggccaagagtaggtgttgcacgacccaggtcttcgatttctcttcgttgctctggactcgtcctggtgcctacggggacatcggtagaatgagcctagtttccagactccctggctgtcgtctctgggcagacgggccgaacatcaactgcagtccagccagcgtgtttattcggcccacaatacactatcgnttcgacagacagaacgtaggacncgaccgtcctaaactcctgtactttacgngggccttcgtaacccgggctacggttcccggggttaccctaacgtacttcagttcgccaggccggtctcgggacctnttcgactctcgaacctataccagacncgtcctagacncggactagaacgtntacggtcgacttacggtttacgttacgttagttcgtaagtacttaaactattttaacgtaactttcgtttaccgtacgttaacgttttaccgggaccgggttaaccggtaaccggttaaacgggttcgggtaacgttaccgtaacggtaaaccggttaacggtagggtacgtacgttacgaccgtaacgtacgttccggttacggtcctttacatttaccccgg

SEQ ID NO: 65471 - DNA, 620 bp, Homo sapiens
  misc_feature: GYAE6OF02G22CN.31.78.H01.1.454.CMB.1.raw
  modified_base (315)..(315): a, c, t, g, unknown or other
  misc_feature (315)..(315): n is a, c, g, or t
  modified_base (359)..(359): a, c, t, g, unknown or other
  misc_feature (359)..(359): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagctcctggctgtgtctcgtgggcgagagggccacatcaactgcaagtccagccagagttgtttattcggcccacaataacaactacttagcttgtaccagcaagaagtaggactagtcctacctaaactcctagtactttacgnggtccttccgacccgggctacggttccgggttacctaaaccgtnttcagttggaccgaggcggtctgggacctagtttccactctcaacctntacgagtcagcctgacacggtactagaagtagtgtacggtacgtagtttagtacgtgtccagactaactacttacttactttcgttacgttccgtacgtttcgggacggtacggtaaccgtaagggtacgtacgtaacgtaaccgtaaacggtacttacgggtacgccgttagaccgaccgttacgtccggtttcgttaccttacgttacccg

SEQ ID NO: 65472 - DNA, 827 bp, Homo sapiens
  misc_feature: GYAE6OF02H9MR7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgcctagtttccagacctccctggctgtgtctcgtgggcgagagggcccacatcaactgacaagtccagccagagttgttttacttcggccccaacaataaccaactacttagcttggtaccagacaagaaaggtaggacacgacccttacctaaactcctatactttacgcgggtaccttccgtacccggggctacggttaccccggggtttaccctaaaccggtatttaccgtacgttcggacgtacgggtccggggttccgtacggggtacccttagtttcccgaccttccgtacccaacctactaccgacgtccgtaaccgtcccgtagggaccgtaacgggtcccgttaagggtaaaacggtacggttcgggtacggttaacccgtttaaggtttttaacgttaccgttacgttaaccgaacgtaaccgtaaacttaacttttaaccgtttaacctttcccgttttaccggtacccgtttaacggttttccgggggaacccggggttaaacgggtaaacccggttaaacggggttagggtaaccgtaacgttaacccggtaaaaccgggttaacggttccggggttaacggtacccgttacggtacccgttaacccgttaacgttcccggtttcggtttaccccgtttaaccgttaacccgg

SEQ ID NO: 65473 - DNA, 608 bp, Homo sapiens
  misc_feature: GYAE6OF02I1ASC.31.78.H01.1.454.CMB.1.raw
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (373)..(373): a, c, t, g, unknown or other
  misc_feature (373)..(373): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatggccccacaataacaactactagcttggtaccagcagaaagtaggacagcctacctaaacgtcctgatttaccgngggcttcgacccggnagtcccggggttacctaaccgattaccattggacagtcgggttcngggtacccgattttcactcgtcaccatccagcagctgcaggctgaagatgtaggctaagtttatactgtcacgtacaactatttacttacgtttaccttttcgtaccgtaccgtttcggaccgggtaacggtaaacccgtaagggttcggaagtaacgttacgaaaacggtaacttcggtacggcgttagtacccgtaaccgtaacgttctacggtttaccgttacgttaacccg

SEQ ID NO: 65474 - DNA, 720 bp, Homo sapiens
  misc_feature: GYAE6OF02JBRWN.31.78.H01.1.454.CMB.1.raw
  modified_base (380)..(380): a, c, t, g, unknown or other
  misc_feature (380)..(380): n is a, c, g, or t
  modified_base (425)..(425): a, c, t, g, unknown or other
  misc_feature (425)..(425): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatccaactcgacaacgtccacgccagtagttgttttacttccggccccaacctaactaactaaactacttacgcgttaggtaccagtacaagaaagtaggacagcctacctaactcctgatttacgtggtctccgtacccgggctacgttcccggggttacctaacgtnttacagttggacaggcgggtcgtgggaccgtactttccacttccnccacctagtccacgcacggtccctcggacgacggactaggaaacggtatgggtcgtacgttagttttaactttctcggtactagtacctaaacttacgttttaacttacccgtttttagtttccgttacccgttacgttttaccgggggtaaccgggttaaaccggggaaccgttaacggggtacgggttaaggtaaccgttaaaccggaaaaccgttaacgggttacggttacgggtaccgttacggtacccgtaccggttacttaccgtttcggttccttaaccgttaccccg

SEQ ID NO: 65475 - DNA, 582 bp, Homo sapiens
  misc_feature: GYAE6OF02FU2R9.31.78.H01.1.454.CMB.1.raw
  modified_base (320)..(320): a, c, t, g, unknown or other
  misc_feature (320)..(320): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagcaagaaagtaggacagcctacctaaactcctagactttacgngggtcttctacccgggctacgttcccggggttacctaaccgattcagttcggcaggcgggtctgggacctatttcactctcaccatcagcagcctgcacggctagaagatggtggctagtttatactgtacacgacaactattactactttcgtttactctacgtttcgggacgtacggtaccgaagggtggatagtaaccgtaaacggtacgttaggtacggtctaggtaccaaccgtattccgtacgttccttactaccg

SEQ ID NO: 65476 - DNA, 799 bp, Homo sapiens
  misc_feature: GYAE6OF02HW5T0.31.78.H01.1.454.CMB.1.raw
  modified_base (234)..(234): a, c, t, g, unknown or other
  misc_feature (234)..(234): n is a, c, g, or t
  modified_base (403)..(403): a, c, t, g, unknown or other
  misc_feature (403)..(403): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactcccctggctgtgtctctgggcgagagggcccaccatcaactgacaagtccagccaagngttgttttattggcccctacaaataaaccgaactactttaacgcttacgggtaaccaacgcaaaggtaaaaacgttagggaaaccaaggcccctttaacccgtaaaaacttcccctaggtaaatttttaaccgtacggggtccttttaccggtaacccccggggggtanaaaccggtttccccggggggttaacccttaaaaccggtcgtttacctaaggtttcgggacccagggtccgggggtttcgacgggggtaacccgtaactttttccgaaccttctccaacccgtatcgaacgcaagcccgtagccaaggtcctagaagtagtacggtgggactaaacggttttacttaaccgtgtaccgacgacaaaccttaagttaactttaacccgtttcgttttaccgttacccgtaaccttttacgggggtaccggggtaaacggaaaccgtaaggggttacggaacgttaaacgtttaaacgggaaaaccctaaaccggtttgggaaccgttcggacgttacccgaaccttacttacgtttcggttaccctttacctaaccgg

SEQ ID NO: 65477 - DNA, 807 bp, Homo sapiens
  misc_feature: GYAE6OF02IF85T.31.78.H01.1.454.CMB.1.raw
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagcctagtttccagacctccctggctgtgtctcgtggcgagaggccacatcaactgacaacgtcagccagtagttgttttattcggaccccctaactaaacttaaacaaccttaacttagacgttacggaaccagacaaagaaagtacggacacgtacccttacctaaacttccgtagtactttacgtcgggtaccttccgtaaccccgggntacggtcccgggtttacctaacgtacttacagttcggcctaaggtccggggttacgtacgggtacccgttaatttaccgaccctttaccgtacctaaccctattacccgagtaccaacggtcccttacggaccgtaacgggtacctaaggtaaacggtaacgttcgggtacgggttacgttaacggttttttaaactttaccgttacggttaaccgtaacgtaaccttaaacgttaaacttttaaactttaaccctttttaccgtttttacgttaacccgttaaccgtttttaccggggtaccgggtaaaccgggtaaaccgttaaagggggtacgtaacgttaacgtaaaccgtaaaacggtaaccgttacgggttacggtaccgtacgaccgtaaccgtaacgttacccgttacggtttacccttattaaccccg

SEQ ID NO: 65478 - DNA, 618 bp, Homo sapiens
  misc_feature: GYAE6OF02HQW6O.31.78.H01.1.454.CMB.1.raw
  modified_base (234)..(234): a, c, t, g, unknown or other
  misc_feature (234)..(234): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttnttttattcggccccacaataacaactacttagcttggtaccagcaagaaagtggacacgcctacctaaacctcctgtatttacgtcgggtccttccgtacccggggctacggttcccgggggttaccctaaaccgtattccagtttcggctaggtcggggttctggggacccgtatttccactcctcacctatcagcacgcctgcaggctagaagagtgtggactagtttacttactgtacagtaccaacttattaacttactttcgtttccgtctaccgtttcgggacggtaacggtaccgtaagggtggtacgtacgtaccgaaacggtacgttaggtacggtacctaggacccaacgtacgttaccgtcgttactctaccg

SEQ ID NO: 65479 - DNA, 954 bp, Homo sapiens
  misc_feature: GYAE6OF02HJ5KN.31.78.H01.1.454.CMB.1.raw
  modified_base (916)..(916): a, c, t, g, unknown or other
  misc_feature (916)..(916): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtggagtgacgcgtacgttcgacgtacctccgtcgctgtcgtctcggtcggacgaggacggccactatacaactgactaacgtccgacgacgagtagtttagttttcgtaccgttacccaaacctaaactaaacctaaaccttaacgttacgttacggttaccgttaacgaaccgaacgtaaagtaaacggtaaacggtacggaaccgttacctaacccttaaacccgttaaccgtacgtttaacgtttaacggttccggttaccggtttaccccgggttaacccggtaacccggtaccggggtttaccccgggtttaaccccggttaaacccgttaaccgttaaccgtttacgggtaccggtacgggtaccgggtaccgggttccgggttaaccgggtaacccggtttaccgtttacgttacctaccgtacccctaactacccgtacgtaccgaacgtcccgtaacggtccggtaaggtccgaagggtaacgtaaagggtacgttagggttaccggtaacggtttaacgttttaaccgtttagtttacccggacgttaaacggaaaccttaaacgtttaaactttaaaccctttttcgttttacccggtttttaccgttacggttttaaccccgggtttcgggggtaaaacccggggtaaccggtaaccggggttaaaccgggtaggggttaccgtaaacaaccgggttaaaacccggtacggtacgggtttacggaccgtaccgttacgtaaacccggttnttaacccggtttccctttacggttaacccttccccggg

SEQ ID NO: 65480 - DNA, 568 bp, Homo sapiens
  misc_feature: GYAE6OF02H5C8E.31.78.H01.1.454.CMB.1.raw
  modified_base (433)..(433): a, c, t, g, unknown or other
  misc_feature (433)..(433): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggcccccacaataacaactacttagcttggaccagcaagaaagtaggacaagcctaccctaaaactcccttagtaatttacgtgggccttccgtacccgggctacgtcccggggttcctaaccgattcattggctaggcgggtctgggaccgatttcacttctacaccatcagcagcctgcagcgtagaaagntggtggctagtttattactgtacagacaactattaattactttctttccgtactacgtttacgggcggtaacggtaccgtaagggtgagactacgaaacgtaacgtgtgctgacaccattctcttcgtactaccg

SEQ ID NO: 65481 - DNA, 653 bp, Homo sapiens
  misc_feature: GYAE6OF02JVXQK.31.78.H01.1.454.CMB.1.raw
  modified_base (632)..(632): a, c, t, g, unknown or other
  misc_feature (632)..(632): n is a, c, g, or t
  modified_base (647)..(647): a, c, t, g, unknown or other
  misc_feature (647)..(647): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggctgtgtctcgtgggcgaggacgggccaccatacaactgacaagtccagccaagtagttcgttttattcggccccaacaataacaactacttagcttggtaccagcaagaaaggtacgacacgtaccctacctaaactcctagtactttacggtgggtccttccgtaacccgggctacggttacccggggtttacctaaccggtacttcgacgttggaccgtaggtaccggggttctcggggaacccgtattttcccgactccgtaccacctaatccgaagccgtacgcccgtagccgaggcctaggaacgtagttcggtacggtactaggtttaattacgtcgtaccgacgtacgaacttattacgtttcttctttaccgtcttacgttcgggtacggaggtaacgagggtagagtactaacgaaactcgtgtagcgtacacgtactnttacgtcttaccgtntaaccg

SEQ ID NO: 65482 - DNA, 651 bp, Homo sapiens
  misc_feature: GYAE6OF02JCPIF.31.78.H01.1.454.CMB.1.raw
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagacgggccaccatcaactgcaacgtccagccagagttgttttattcggaccccacaataacaactactagcttaggtaccagcaagaaagtaggacagcctacctaaactcctagactttacgnggtcttaccgtaccggctacgtccgggttacctaacgtnttcagttcggcacgtcgggtcgtagggacctatttccgactccgtacacctatcagctacgcctgacgtacggctagaagtagtggtacggtacttacgtttacttacgtcgtacgtaagacctaaagttattaacgttaccgtttcgtttaccgttaccgtaaccggttttcgggaccgggtaaacggtaaccgtaagggttcggaacgtacgtaaccggtaaacggtaccgttggtacgtaccgtagtacccgtaccgttacttccgttacgtccttaccgtacccg

SEQ ID NO: 65483 - DNA, 692 bp, Homo sapiens
  misc_feature: GYAE6OF02F5J94.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggcccaacaataacaactactagcttgaccagcagaaagtagacagcctactaaactcctgtactttacgngggccttcgtaccccggggctacggttcccgggggttacccttaaaccggactttcgaatttcgggacctaagggtccggggttcgtaggggaacccgtaattttccgaccttcctacctaacccattccaagccgagtcccgtagccgagggtctaggaaagtacgtggtcggcgttaaggttttaacttaccgttaggtacgaacgtacaaacgttaactttaactaccgttttcttttacgtccgttaaccgttttccggggaaccggtaaggggtaacccgtaaaggggtacggtagtaacgtaacgaaaacggtaaccgttggtaacggtccgttagacctaaccggtcttaccgttcgttacctttcgtaccg

SEQ ID NO: 65484 - DNA, 642 bp, Homo sapiens
  misc_feature: GYAE6OF02HBEV2.31.78.H01.1.454.CMB.1.raw
  modified_base (610)..(610): a, c, t, g, unknown or other
  misc_feature (610)..(610): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagagttgttttattcggaccccacaataacaactacttagcttaggtaccagcaagaaagtaggacacgtccctacctaaactcctagtagtttacgtgggtaccttccgtacccgggctacgttcccggggttaccctaaccggtatttcagttcggaccgacggtcgggttcgtacggggacctatttccaccgtctaccacctactcgacgaccacgccgtgaccgtaggcgtaggaaagtcgtggtacgacgtttagtttaacttacgtagtacagtaccaattactttagttacctttcgtttacgtacttacggtttcgacgggacggtaaccgtaagggtcggatacgtaacgtaacgaccgttggcgtaccgngtacctacgacttcggttactccgttataccg

SEQ ID NO: 65485 - DNA, 702 bp, Homo sapiens
  misc_feature: GYAE6OF02JW0M4.31.78.H01.1.454.CMB.1.raw
  modified_base (327)..(327): a, c, t, g, unknown or other
  misc_feature (327)..(327): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacattcggtgatggagcctagtttccagactccctggctgtgtctcgtgggcgaggagggcccacatcaactgcaagtccagccagagttgttttatcggcccccaacaataaccaacttactagtcttcggtaccagcaagaaagtggacacgcctactaactcctagtatttacgngggtacctccgaccggggctacggttccccgggttacctaaaccggtattcaagttcgggcctaggggtccggttcgtacggggacccttagtttccaacgttcctacgaaccctagtaccgacgcgtaccgtccgtcgccgtaacggtacgtacgaacgtaagtggtacggtacgttacgtttaagttactcggtcacgtactaacgttaacttaacgttacctttccgttttaccgtaccgttacgtttaccggggtaccggtaacgggtaaccgtaagggttacgggtacgtacgtaaccgtaaaccggtacgttacggtcggtaccgttacgccgtaccgtacgttcggttacgttaccttaccgttaccg

SEQ ID NO: 65486 - DNA, 637 bp, Homo sapiens
  misc_feature: GYAE6OF02F0I66.31.78.H01.1.454.CMB.1.raw
  modified_base (319)..(319): a, c, t, g, unknown or other
  misc_feature (319)..(319): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagagttgttttattcggaccccaacaataaccaactacttagcttggtaccagcagaaagtagacagcctacctaaactctgtattacgnggtcttccgtacccgggctacgttcccggggttacctaaccgattcagttcggacaggtcgggtcgtgggaccgtatttcacttctccactactcacgcacgcctagcgaggctagaagtgtaggtggacgttagtttaactcgttcgtacacgtacctaaacttactttaattaccttttcgttttaccgttaccgttaccgttttccggggacggtaacgggtaacgtaagggttacggtagtaacgtaccgaaacggttacgtcgggttacggacttacgacctaccgtacgttcgtacgttccttaccgtaccg

SEQ ID NO: 65487 - DNA, 680 bp, Homo sapiens
  misc_feature: GYAE6OF02JZ2SL.31.78.H01.1.454.CMB.1.raw
  modified_base (640)..(640): a, c, t, g, unknown or other
  misc_feature (640)..(640): n is a, c, g, or t
  modified_base (651)..(651): a, c, t, g, unknown or other
  misc_feature (651)..(651): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggcccaccatcaactgcaagtccagccagagttgttttagttccgccccaaccaataacaacttacttacgcttacggtaccagccaagaaagtcggaacacgcctaccgtaaacctcctagtaactttacgtcgggtacctttaccggaccccgggtactaacggttcccccgggggtttaccctaaaacccggtagtttacctaagttcggtacaacgggtcgggtcgttacgggggaccctacttttccaaccgttctacccgtaccaattcgacgtccgacgtcctacggtacgaacggtctaggaagtagtcggtaggtccgttaagtttcgttacgtgttaccgaagtaaccacttaagtttacttaaccttccgtttactccgttaacgtttgaccgggtacgaccgtaaggtcgatacgtaccgaaagtcgngtacgcgttanaccgtactacgttctacgtcctatacccg

SEQ ID NO: 65488 - DNA, 880 bp, Homo sapiens
  misc_feature: GYAE6OF02JLUHO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaagtccagccagtagttgttttattcggccccaacaataacaactactgcttagacagcagaagtacggacagtcctactaactcctagactttacgtggccttacgtaccccgggatacgtttccccggggttacctaaaccggtactttacgtacgttacgggaccgtaacgggttccgggggttaccttacggggggtaaccccgttaacgtttttacccgaacccttttaccccgtaacctaaccccgtaacgtttacccgaacggtccgaaacccggtccccgtttacgggacccgtaacggggtaccgtaacggtaaacgggtaacgttacgggttacgggtacctttaacggtttttaaccgtttaaaccggttacgtttaacccgaaggttaaccctaaaccgttaaacgtttttaacgtttacccgtttttacccgttttttaccggttacccgttttaaccggttttccggggtaaccgggggttaaaccgggttaaacccgggtaaacggggtttacgggtacgggttaaccttaaacccggtaaaaacccggttacggtttacgggttaacccgggtaccgtttaacccggaccgttaacccgtaccggtttaccgtttaccggtttaccgtttacccctttaacccgg

SEQ ID NO: 65489 - DNA, 584 bp, Homo sapiens
  misc_feature: GYAE6OF02I7T5G.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagctggtaccagcagaaagtaggacagcctacctaaactcctgtactttactcgggcttccgtacccgggctacgttcccgggggttacctaaccgtacttcacgtttcggcaggtcggggtctggggacccgtattttcactctcacccatccagcagcctgcgaggctagaacgatgtgctagtttatagtgtacagctaactattacttacctttcgtttacgtccttacgtttcgggacggtaacggtacgtaagggtggagtacgtaaccgaaacgtacgtggtcggctacgcgactatcgtcgtacttcgtaccg

SEQ ID NO: 65490 - DNA, 676 bp, Homo sapiens
  misc_feature: GYAE6OF02JYEFE.31.78.H01.1.454.CMB.1.raw
  modified_base (320)..(320): a, c, t, g, unknown or other
  misc_feature (320)..(320): n is a, c, g, or t
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
  modified_base (631)..(631): a, c, t, g, unknown or other
  misc_feature (631)..(631): n is a, c, g, or t
tcagcagtagacgtcacgaccggtgctcgatttagtgtgagtagtttgggtttggggagctacaacaggcaggcagggcagcaagatggtgttgcagacccaggtcttcatttctctgttgctctggatctctggtgcctacggggacatcgtgatgagccagtttccagctccctggctgtgtctctgggcgagagggccaccgatcaactgcaagtccagccagagttgttttattggaccccactaagtaacactacttagcttggtaaccagcctaagaaacgtggacaagcctactaaactccgtgattttacgngggtccttaccgtacccgggatagttacccggggttacctaaccgtattccgaagttcggactacggccgggttntacggggacctagttttcaccgttacncctaacctatccgagtccaggtcccttagggaccaacggggtcttacggaaacgtatggtaacggtcgttaacggttttactaccgtagttaccgaggacctaacgtatttacgtaactttcgttaccgtacgttacgtttcggaccggtaacgtaccgtaaagggttcgacgtaatttaacccgaacggtaaaccgttcgtaccggtnttaaccggacttaaccctaagtcctttacgcgtttaacctaccgg

SEQ ID NO: 65491 - DNA, 618 bp, Homo sapiens
  misc_feature: GYAE6OF02IQOE6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaacgtccagccagagtgttttattcggccccacaataacaactactagcttggtaccagacaagaaagtaggacagaccctacctaaactccctagtatttacctgggtccttcgtaccccggggctaagttcccggggttacctaaccgattccgattcggcaggcgggtctgggacctactttcactctacgaccatcagcacgcctgacgaggctagaagtagtcggtggtctaagttttactacgttcgtacaagtcctaaacttaatttatttaacctttcttttaccgtcttaaccgtttcgggacgggtaggaaccgtaagggtgagtacgtaaccgaaaacggtacgttaggtacggtcgtacgaccactacgttcgttcgttcttaccgtacc

SEQ ID NO: 65492 - DNA, 522 bp, Homo sapiens
  misc_feature: GYAE6OF02FWDIL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcatcatcagcagcctgcaggctgaagatgtggctagtttattactgtcagcaatattatactttctttcgtctacgtttcggcggtaggaccaaggtggagtactacaaacgtactgtcgctgccacctatctgtcttacg

SEQ ID NO: 65493 - DNA, 597 bp, Homo sapiens
  misc_feature: GYAE6OF02F4U1X.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaccaataacaactacttagcttggaccagcaagaaagtaggacagcctacctaaactcctagtactttactgggcctttaccgtacccgggctacgttcccggggttacctaaccgtattcagttggacaggtcgggtctaggggacccgtatttccacttctcaccatccagcacgcctgcgaggtctagaagtagtggtacggacttacgtttattaccgttgtacctagactaactagttacttactttctttcgtacttacgtttcgggacgtacggtacgaaggtaggagtacgtacgaaacgtacttaggtcggtactagaccactactcgtcgttctctaccg

SEQ ID NO: 65494 - DNA, 560 bp, Homo sapiens
  misc_feature: GYAE6OF02FR79E.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgttttattcggccccaaccaataacactacttagctgtaccagcagaaagtaggacagcctacctaaactcctgatttactgggtcttcgtaccccgggctacgttcccggggtttacctaaccgtacttcagttcggcgaggcgggttctggggaccgtattttcactctcaccatcagcagcctgcgaggctagagagtgtggctagtttacttactgtacagacaactattactactttcttcgtctacgtttcgacggtaggtaactagggtacgagactacgaaacgtaactggtacgtcgtagcactactcgtcgtcctatacc

SEQ ID NO: 65495 - DNA, 1002 bp, Homo sapiens
  misc_feature: GYAE6OF02F2GWV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgagcgagaggccaccatcaactgcaagtccagccagagttgtttattcggccccacaataacaactactagcttggtaccagcaagaaagtaggacagcctacctaaactcctagtactttacgcgggtcttaccgtacccgggctaacgttcccggggtttacctaaacccggtactttaccgacgtttacgggccgtaacggtcccgggggttaccgtcgggggtaaccccgttaacgtttttcccgaacccgtttcccgttaccctaaaccccgttaagtttaccccgaacgggtacccgtaaaccgggtcccccgtttacggggaccccgtaaacgggggtaccccttaaggggtaaaaaccggttaacgggttaccggggtttaccgggggttaacccgttttaaacgggtttttttaaacgttttaaaccccggtttacgggtttaacccgtaaacgggttaaccccgttaaaaaccgtttaaaccgttttttaaaccgttttaacccccgtttttttacccggtttttttaaccccggtttaacccgttttaaaaccccggggtttttttcccgggggaaaccccggggggtttaaacccggggggtaaaacccccggtttaaaacggggggttttaccgggggtaaacgggtttaaaccggtttaaacccccggtaaaaaaacccggggttaaacccgttttaacgggggttacccggggttaacccgttaccgggtaacccccgtaaaccccggtttaaacgtttccccggttttaacggtttaccccgtttttaaccccgg

SEQ ID NO: 65496 - DNA, 777 bp, Homo sapiens
  misc_feature: GYAE6OF02H4OUV.31.78.H01.1.454.CMB.1.raw
  modified_base (179)..(179): a, c, t, g, unknown or other
  misc_feature (179)..(179): n is a, c, g, or t
  modified_base (290)..(290): a, c, t, g, unknown or other
  misc_feature (290)..(290): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagactcccnggctgtgtctcgtgggcgaggacgggccaccatcaaactgaccaagtccagccaagtagttgtttttaattcggaccccctaacaataacaacttacttagcttggtaccngacaagaaagtacggacacgtcctacctaaactcctagtatttacgtggtcttccgtacccgggctacgtcccggggttacctaaccgtattcgacgttggaccgtaggtccgggtacgtcggggaccgtaacgttttccaccgtacttaccaccgtacgtccgacggtaccacggtaccctggaccgaacggtccgtaaggtaaacggtaacgttcgggtacgggtacctttaagggtttttaaaccttacgttacgggttaaccctaacgggtaacctaaaacctttagttttaaacctttaccgttttaccccgtttttacgttacccgttacccggttttaacggggtaccgggtaaacggggtaacccgtaaggggttccggtaacgtacttaaaccggaaaccgttaaccggttggtaaccggttccgtaacggtaccctaccgtacgtttacccgtcgttttacccgtatttaaccccgg

SEQ ID NO: 65497 - DNA, 566 bp, Homo sapiens
  misc_feature: GYAE6OF02IF139.31.78.H01.1.454.CMB.1.raw
  modified_base (312)..(312): a, c, t, g, unknown or other
  misc_feature (312)..(312): n is a, c, g, or t
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccacatcaactgcaagtccagccagagttgttttattggccccacaataacaactacttagcttggtaccagcaagaaagtaggacagcctacctaaactcctgatttacngggtcttcgtacccgggntacgttccgggttaccaaccgtnttccagttcggctagcgggtctgggacctatttcgactctcacctatcgagcagcctagctaggctagaagagtgtggtactagtttacttactgtacagcaactattacttactttcttcgtctacgtttcgcgggtaggtaccgaagggtcgagtagtacgaaacggtactggtacggactggacctaacgacttcgtagttccttactac

SEQ ID NO: 65498 - DNA, 660 bp, Homo sapiens
  misc_feature: GYAE6OF02FJ8YJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcccagtttccagacctccctggctgtgtctctgggcgagagggccaccatcaactgcaagtccagccagagttgttttattcggccccacaataacaactacttagcttggaccagcagaaagtaggacacgcctacctaactctagtattacgtggtccttacggacccggctacggttcccgggttacctaaccgttactctagttcggacgacggtcgggtcgtacgggacctattccgactcctccaaccataccgagccacgtcctcgacgagtctagaagtagttcggcgtacttagtttactacgttcgtacacgactaaacgttatttaccgttacttttacgtttcgtaccgtttacggttaccgggaccggtaaccgggtaacgtacggggtacgacgtaaccgtaaccggtaaaacggtcggttacgggtaccggttacgtaccgtaccgaaccttacgttcgttaccggtttaccttaccttacccg

SEQ ID NO: 65499 - DNA, 860 bp, Homo sapiens
  misc_feature: GYAE6OF02G7ZJN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccctacggggacatcgtgatgagccagtttccagacctccctggctgtgtctctgggcgagagggccaccatcaactgacaagtccagccagtagttgttttattcggccccaaccaataacaactacttagcttggtaccagcagaaagtaggacagcctacctaaactcctagtactttacgtcgggtaccttccgtaccccgggctacgttcccggggttacctaacccggtattcgtaacgttcggaccaaggtccggggttccgtacggggtaaccccgtagttttaccaaccgttcctacccgaaccctacttaccgaacgtccgacgtacccgtcgacgacgggtcttacggaaagtacgttcggtacggtacttaacggtttttaacgtttaccgttaggttaccgtaacgtaaccgtaaaacgtttaacttttaaacgtttaacccttttaccgtttttttacccggttaccgtttaacccgggtttttaccgggggtacccgggggtaaacgggggttaaacccgttaaacggggggtttaacgggggaaacgttaaaccggttttaaacccggtaaaaaaccgggttaaaacccgttttacgggggtaaccggggttacccggttaaccggttaacccccggttaaacccgttaaacggtttttcccggtttaaccgggtttttacccctttaacccgtttaacccccgg

SEQ ID NO: 65500 - DNA, 610 bp, Homo sapiens
  misc_feature: GYAE6OF02G11NG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagccctacctaaactcctgtactttacgtgggccttccgtaccccgggctacgttcccgggggtttaccctaaacccggtatttccagttcggctacggcggggttcgtcggggacccgtagttttccacttcctaccacctatcagcagccctgcaggctagaagagtggtcggctagtttattacgtgtcagacaactattattacctttctttcgtccttacgtttccgggacggtacggtaaccgtagggtggagtacgtaccgaaacggtacgtcggtacggctagacctacctacgtcgtcgttccttactaccg

SEQ ID NO: 65501 - DNA, 534 bp, Homo sapiens
  misc_feature: GYAE6OF02FGWA6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatttcggccccacaataacaactacttagcttggaccagcagaaagtaggacagcctacctaaactcctgtatttactgggctttcgtacccgggcacgtcccggggttcctaaccggtattcattcggcacggcgggtctaggggacctatttcactctcaccatcagcacgctgcaggctgaagatgtgctagtttatactgtacagacaactattatacttcttcgtctacgtttcggcgtacggacaaggtgagatacgaaacgactagtcgtctgacacatctcgtcttctac

SEQ ID NO: 65502 - DNA, 665 bp, Homo sapiens
  misc_feature: GYAE6OF02H85E1.31.78.H01.1.454.CMB.1.raw
  modified_base (376)..(376): a, c, t, g, unknown or other
  misc_feature (376)..(376): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggagggcccaccatcaactgacaagtccagccagagttgtttttattcggcccccaacaataacaacttacttagcttggtaccagacaagaaagtggacacgcctaccctaaactcctagtactttacgtcgggtccttccgtacccgggctacgtcccggggtttacctaacgnttcacgttggactgcgggtctcgggacctattcactctcaccagtcagcacgcctgcaggctagaagtcgtgtggtacttagtttacttacttgtactaagacctaaactactttaacttaccttttcgttttaccgttaccgtttaccggttttaccggggaccgggtaacggggtaacccgtaagggttacgggtaacgttaactaaccgtaaaacggtaacgtacggttacggtaccgtcgtaccgtacccgtacgttaccgttacgtttaccgttccttaacccg

SEQ ID NO: 65503 - DNA, 733 bp, Homo sapiens
  misc_feature: GYAE6OF02FFSYA.31.78.H01.1.454.CMB.1.raw
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgccgtacgggacatcgtgtatgacgacctacgtttccagtacctcccgtggtctgtcgtctcgtgggcgaggacggcccacataccaacgtgacaacgtccagccaggtagtttgtttttagttccggccccaaacaaataaaccaactacttagtcgttaggaacctagacaaagtaaaaggtacggacacgtccctaactaaaccttccgtagtaactttacgngggtcctttaccggacccggntacggttcccgggttaacctaacgttctacgttagttcggacgtacgggtcggtcggtacgggaccttatttccacttccaccaacctataccgacgaccgacgtccgtgacgacggtcgtaaggaagtacgttggtacggtacgtttaagttttaacgtacgttcgtaccgacgtaacctaaacgttaatttaacttaccttttccgtttaccgttaccgttaccggtttacggggacgggtaaacggtaccgtaaggggtgtacgtacgtaaccggtaaacggtacgtcgggtacggtcgtacggaccctaacgtacgttcgttcggttaccttacgtacccg

SEQ ID NO: 65504 - DNA, 656 bp, Homo sapiens
  misc_feature: GYAE6OF02I0UIE.31.78.H01.1.454.CMB.1.raw
  modified_base (314)..(314): a, c, t, g, unknown or other
  misc_feature (314)..(314): n is a, c, g, or t
  modified_base (456)..(456): a, c, t, g, unknown or other
  misc_feature (456)..(456): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagctccctggctgtgtctctgggcaggagggccaccatcgaactgcaagtccagccagagtgttttatggccccaacaataacaactacttagcttggtaccagcaagaaagtaggacagacctcctaaactcctgatttaacnggcttctacccgggctaacgtcccggggttacctaaaccggatttcgaatttcgggacaaggtccgggtacgtggggacccgagttttccaacttcctacaccattccaaggcaacgtcctaggaccgaggcctagaaagtntcggtggactaggtttaacttactggttacacgactaaacctatttaacttactttaccttaccggttcaaccgtttttccgggaacggggtaacggtaacccgtaaaggggttagtagagtttaacccgaaaacggtaaccgttagggtcggttacgacgtaccaccggttaacttacggtcggtttactacttacccg

SEQ ID NO: 65505 - DNA, 601 bp, Homo sapiens
  misc_feature: GYAE6OF02FZBTT.31.78.H01.1.454.CMB.1.raw
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcagaaagtaggacagccctactaaactcctgatttacgtgggcttcgtacccgggctagtcccggggttcctaaccgattcattggcaggtcgggtctgggacccgtatttccactctcaccatccgagcacgcctcgcaggctgaaagntggtggactagttttactactgtacagactaactaattattactttctttcgtctacgtttcgggacggtaacggtacccgtaagggtcggtagtacgtaccgtaaaacggtaacgttaggtacggtaccgtacggaccgtacccgtaagttccgtacggttaccttaccgtacccg

SEQ ID NO: 65506 - DNA, 626 bp, Homo sapiens
  misc_feature: GYAE6OF02IZ14D.31.78.H01.1.454.CMB.1.raw
  modified_base (273)..(273): a, c, t, g, unknown or other
  misc_feature (273)..(273): n is a, c, g, or t
  modified_base (332)..(332): a, c, t, g, unknown or other
  misc_feature (332)..(332): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacggccaccagtcaaactgcaagtccagccagagttgtttatcgccccacaataacactactagcttgaccngcagaaacgtaggacagcctactaaactcctagtattacgtggcttaccgacccggggntacgttccggggtacctaacgtattccagttcgggacacggtcgggtcctacggggacctagtttcaccttcgtaccaccgatccgaacgcctaaggccctaggacccgtagggcctaggaaacgtcgttacggtcggtacttaaggtttacttacgtggtacctaggacctaactactttaacgtacctttccgtttacgtccttaacgtttcgggacgtaacggtaccgaagggttgacgtataccgaaacgtactgtacgactgacctactattcgtacgttacctcgtac

SEQ ID NO: 65507 - DNA, 606 bp, Homo sapiens
  misc_feature: GYAE6OF02GVOZ4.31.78.H01.1.454.CMB.1.raw
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattggccccacaataacaactacttagcttaggtaccagcaagaaagtaggacagccctacctaaactcctagactttacgtcggtcttccgtacccgggctacgttcccggggttacctaaccgtattcagttcggcaggcgggtctggggacctatttcgactctacaccatcagcacgcctgcaggctagaagntggtgacgtagtttacttacttgtcagactaactattactactttcgtttacttcgtaacgtttcgggacgggtacggtaaccgtagggtagagtaacgtacgtaaaaccggtactggtacggtacgtcggtacccaccgtaagttcgttacggttccgttacttacccg

SEQ ID NO: 65508 - DNA, 636 bp, Homo sapiens
  misc_feature: GYAE6OF02JAGQT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactactagcttggtaccagcagaaagtagacagccctacctaaactcctgtactttacgtgggccttcgtacccgggctacgttcccggggttacctaaccggtacttacgatttcggcctaggcgggtcgtgggtaccgtactttcactcgtaccaccagtcacgcacgcctgcaggcctagaagatggtcggacttagtttaattacgtgtacgaacgcaaagtatttagttacctttctttacgtccgttaaccgtttcgggacgggtaacggtaaccgtaaggggttggacgtagtaaccgaaaccggtaacttcgggtaaggtccgtaggacctaaccgttacgttcgttccgttaccttacccgttaaccccg

SEQ ID NO: 65509 - DNA, 540 bp, Homo sapiens
  misc_feature: GYAE6OF02FQDQC.31.78.H01.1.454.CMB.1.raw
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactactagcttggaccagcagaaagtaggacagccctacctaaactcctgatttactgggtcttctacccgggcagttcccggggttacctaaccgtcttcattcggcaggcgggtcgtgggacgtatttcactctcaccatcagcagcctgcagctagaagntgtcgcttagtttatcgtgtacagtacaatatttactactttcttcgtctacgtttcggcggtaggactagggtgagactacgaaacgtactgtcggtctacgacactatctgtcttctac

SEQ ID NO: 65510 - DNA, 603 bp, Homo sapiens
  misc_feature: GYAE6OF02GZWHJ.31.78.H01.1.454.CMB.1.raw
  modified_base (312)..(312): a, c, t, g, unknown or other
  misc_feature (312)..(312): n is a, c, g, or t
  modified_base (327)..(327): a, c, t, g, unknown or other
  misc_feature (327)..(327): n is a, c, g, or t
  modified_base (394)..(394): a, c, t, g, unknown or other
  misc_feature (394)..(394): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattggccccacaataacaactacttagcttggtaccagcagaaagtaggacacgcctcctaaactcctgactttacngggcttcgacccggnacgtccgggttcctaacgattcattggcagcgggtctgggaccgatttcgactcctcaccatcgaanccagcctgcaggtctagaagatggtcggactagtttattacgttgtcgagctaacgtacttaacttacgttttcgtttacttcgttaaccgtttcgggtaccgggtaaggtaacccgtaagggtaccggtagtaacgtaccgtaaaacggtaccgttaggtacggtcgtacggacctaccgagttaccgttcgttccgttacttacccg

SEQ ID NO: 65511 - DNA, 675 bp, Homo sapiens
  misc_feature: GYAE6OF02GSZYE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggccaccatcaactgacaagtccagccagagttgttttattcggccccaacaataacaactacttagcttaggtaccagacaagaaagtaggacagccctacctaaactcctagtactttacgtcgggtccttccgtaccccggggctacggttcccggggttacctaaaccggtattccgtagttcggaccgtagggtccggggttccgtacggggtacccttacttttccaccgttcctaccaacctatccgaacgccacgtcccgtgccgaggctaggaagtacgtggtcggtacttaagtttacttacgttcgtacaacgtactaaacttatttaacttaccttttacgtttcgtacgttaccggtttaccgggacgggtaacggtaaccgtagggtcggagtacgtaacggaaacgtacgtggtacgacgtacgacctaccgtacttcgtcgttccttactaccg

SEQ ID NO: 65512 - DNA, 734 bp, Homo sapiens
  misc_feature: GYAE6OF02JGIJ8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactcctggctgtgtctcgtgggcgagaggccaccatcaactgcaagtccagccagagttgttttattcggcccaacaataacaactactagcttaggtaccagcagaaagtagacagtacctacctaaactcctagtactttacgtgggccttaccgtacccgggactacggttcccggggttaccctaaaccggtattaccgtagtttcggaccgtaacgggtccggggttccgtacggggacccgttacttttccaccgttcttacccaccctaattccgagacctaacgtcccgtggaccgtagggtacctaaggtaaacgtacgtgggtacggacgttaaggttttaacttacggttacgtaccgtaacggtaacctaaaccttaactttaacgttaaccttttcccgttttacgttaccgttaccggtttaccgggaacggggtaacgggttacccggtaaagggttcggacgtaacgtaaccgtaaaaccggtacgttacgggtacggtacgtacgtaccgtaccgtagttccgtacgttcgttacccgtacccg

SEQ ID NO: 65513 - DNA, 535 bp, Homo sapiens
  misc_feature: GYAE6OF02FHNYH.31.78.H01.1.454.CMB.1.raw
  modified_base (318)..(318): a, c, t, g, unknown or other
  misc_feature (318)..(318): n is a, c, g, or t
  modified_base (409)..(409): a, c, t, g, unknown or other
  misc_feature (409)..(409): n is a, c, g, or t
  modified_base (477)..(477): a, c, t, g, unknown or other
  misc_feature (477)..(477): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccacaataaccaactacttagcttggtaccagcaagaaagtaggacagcctacctaaactcctgtatttacngggcttcgtacccgggcagtcccggggttacctaaccgattcattggcaggcgggtctgggaccgtatttcactctcaccatcagcagccngcaggctgaatatgtggctagtttatactgtcagtcaatattactactttctttcgtctacgttcggnggacggtacagggtgagactacgaaacgtactgtcgctgctaccntctcgtcttctac

SEQ ID NO: 65514 - DNA, 683 bp, Homo sapiens
  misc_feature: GYAE6OF02IUGBM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagcctagtttccagactcccgtggctgtgtctcgtgggcgaggacggccaccataccaactgacaagtccagccagtagttagttttattcggaccccacaaataacaactaacttagcgttaggtaaccagacaagaagtaggacagacctactaaactctagtacttacgtcggtccttaccgtacccggtctacggttcccgggttacctaacgtattacgtaagttggcgtacggtccgggtaccgtagggtaacccgtatttaccacgttcctacacccgtatacgacgacctacgtcccgtagtaccggaggtaccgtaggtaaagtacggttacggtacggtaccgtttaagttttaacttaccgtacgtacgtaacgtaactaaacttatttaacgttactttcgttacttacgtacgtttacgggacggtaacggactaacgggtgtacgtaacgtaccgaaagttacgtggtacgacgtacgaccgtactacgttcgtacgttactaccttaccg

SEQ ID NO: 65515 - DNA, 722 bp, Homo sapiens
  misc_feature: GYAE6OF02IQNHT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgcaagtccagccagagttgttttattcggccccaacaataacaactacttagcttggtaccagcagaaagtaggacagcctacctaaactcctagtactttacgtgggtcttaccgtacccgggcacgttcccggggttaccctaaccggtactttacgagttcggcacggtccgggttccgtacggggacccgtacgttttaccaccgttctacaccctacgtcgacgccacgtcctcgcaggcctagaagacgtggtcggtacgtagttttacttacgttcgtcacgtactaactacgtttaacttacctttccgtttaccgttaccgttaccgttttaccggggaccgggtaaccggggtaacccgttaaggggtacgggtacgtaacgttaaccggtaaaaaccggtaaccgtttacgggtaacccgggtacgttacccggtaacccgtaacccgttaaccgtttcccggttaccggttttacccgtttacccttaaccccgg

SEQ ID NO: 65516 - DNA, 540 bp, Homo sapiens
  misc_feature: GYAE6OF02GNH4G.31.78.H01.1.454.CMB.1.raw
tcagcagtagacgtcacgaccggtgctcgatttagtgtgagtagtttgggtttgggggagctaacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctactaaactcctgatttactgggcttcgtacccgggcagtcccggggttcctaaccgattcattggctagcgggtctgggacccgtatttcactctcaccatcagcagcctgcaggctagaagatgtgactagtttatactgtcagcaactattatacttctttacgtctacgtttcggcggaggaccaagggtgagatacgaaacgtaactggtcgtctgacaccgtattcctggttccttagtacc

SEQ ID NO: 65517 - DNA, 612 bp, Homo sapiens
  misc_feature: GYAE6OF02FZ9Y7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctcctaaactcctgtatttactggcttcgtacccgggcacgttccggggttcctaaccgattcattggcaggtgggtcgtgggacccgtatttcacttctccaccatcagcacgcctgacaggctagaagtattggtggacttaagttttatacgtgtacagtactaaactatttacttaccttttccgttttccgttacgttaccgtttccgggcgggtaaacgggaaccgtaagggttggacgttactaacgtaaaacggtaacttgggtacggtcgttagaccctaacgtattccgttcgttacccttacgtacccg

SEQ ID NO: 65518 - DNA, 695 bp, Homo sapiens
  misc_feature: GYAE6OF02F79HB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgacaacgtccagccagtagttgttttattcggccccaacaataacaactacttagcttggtaccagcaagaaagtaggacagccctacctaaactcctagtactttacgtcgggtaccttaccgtacccgggactacgttcccggggttaccctaaccgtacttccgtaagttcggacgtacgggtccgggtcgttacgggggtaacctattttaccgaccttcctaccaaccctataccgaacgaccacggtccctacggaccgacgggtctaggaacgtagttgggtacggtacttaagttttaacttacgttcgtacacgtacctaaacgtactttacttaccttttcgtttaccgttaccgttaccggtttaccgggacggtaacgggtaaccgtaagggtcggtagtacgtaacgtaaacgtacgttggtacggtccgtacgacctaccgtactcgttactacttaccgtaccg

SEQ ID NO: 65519 - DNA, 518 bp, Homo sapiens
  misc_feature: GYAE6OF02IKWRQ.31.78.H01.1.454.CMB.1.raw
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (406)..(406): a, c, t, g, unknown or other
  misc_feature (406)..(406): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagaggccaccatcaactgcaagtccagccagagtgttttattggccccacaataacaactacttagcttggtaccagcagaaagtaggacagcctacctaaactcctgatttactgggacttctacccggnactccgggtcctaacgnttcattggcagcggtcngggaccgatttcactctcaccatcagcagcctgcaggctagaaagntgtgcagtttattactgtcagtacaactaattataactttctttacgtctactttcggcggaggaccgaaggtgagatacaaacgaactgtgctgcacctatctgtcttnac

SEQ ID NO: 65520 - DNA, 592 bp, Homo sapiens
  misc_feature: GYAE6OF02GQ9B7.31.78.H01.1.454.CMB.1.raw
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagccctacctaaactcctagtatttacgtgggtccttccgtaccccggggctacggttccccggggtttacctaaccgtattccaagttcggcaggtccgggttcgtgggacccgtatttccactctacaacntcagcacgcctgcaggctagaagntggtgactagtttactactgtcagcaattattacttactttctttcgtctacgtttcgggcggtacggaacctagggtgacgtactaacgaaacggtaagttcggtacggcttacgactacctagttcctgttccttactaccg

SEQ ID NO: 65521 - DNA, 645 bp, Homo sapiens
  misc_feature: GYAE6OF02HQFJK.31.78.H01.1.454.CMB.1.raw
  modified_base (321)..(321): a, c, t, g, unknown or other
  misc_feature (321)..(321): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgcaagtccagccaagtagtgttttattcggaccccacaaataacaactactagcttaggaccagcaagaaagtaggacagcctacctaaactcctagtaatttacgnggtaccttcgtacccggactacgttccgggttacctaacgattacagttcggcgtaggcggtctagggactatttcgactctcaaccatacacgcaacgcctagaccgagtcgtaggaaagtgtggtacggacttaaggtttacttacgtgtacaagtactaaatatttacgttaccttcgttttacgaccgttaacgtttccgggaacgggacggtaacccgttaaggggtacggtaagtaactaaccggtaaaaccgtagttacggtacggtccgtacggacgtaacccgtagtttccgtacgtttccgttaccttaacccg

SEQ ID NO: 65522 - DNA, 554 bp, Homo sapiens
  misc_feature: GYAE6OF02IAWP6.31.78.H01.1.454.CMB.1.raw
  modified_base (424)..(424): a, c, t, g, unknown or other
  misc_feature (424)..(424): n is a, c, g, or t
  modified_base (549)..(549): a, c, t, g, unknown or other
  misc_feature (549)..(549): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcaagaaagtaggacagcctaccctaaactcctgatttactgggcttcgtacccgggctacgtcccggggtttacctaaccgattcattcggcaggtcgggtctggggacccatttcactctcaccatcagcagcctgcaggctagaagntgtggctagtttatacgtgtcagcaactattacttacctttctttcgtctacgtttcgggcggtacggaccaagggtgagactacgaaacgtactggtcgtctagaccactattctcgttccttntaccg

SEQ ID NO: 65523 - DNA, 565 bp, Homo sapiens
  misc_feature: GYAE6OF02I056S.31.78.H01.1.454.CMB.1.raw
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggccccacaataacaactacttagcttggtaccagcagaaagtagacagcctactaaactcctgatttacngggcttctacccgggcacgtccgggttcctaaccgnttcaattggcagcgggtctgggaccatttcactctcaccatcagcagcctgcaggctagaagagtgtggactagtttatactgtacagacaactattacttactttctttcgtctacgtttccggacggtacggtaccgaaggtcggagtacgtaaccgaaacggtaacgttggtacggctacggacctaccgtattccgttacgttaccttctaccg

SEQ ID NO: 65524 - DNA, 707 bp, Homo sapiens
  misc_feature: GYAE6OF02ID3SD.31.78.H01.1.454.CMB.1.raw
  modified_base (234)..(234): a, c, t, g, unknown or other
  misc_feature (234)..(234): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacagtcgtgatgacgcctagtttccagcctccctggctgtgtctcgtgggcgagagggccaccatacaactgcaagtccagccagngttgttttagtcgccccaactaataacaactacttagcttaggtaccagacaagaaacgtaggacagccctactaaactcctagtactttacgcggtactttccgaaccgggctacggttccccggggttaacctaacccggatttacccgtaaggtttcggcctaaacggggtccgggttactaccgggggaaacccgtttactttaacgtaccgttcctacccgtaacccgaacttacaacggtccaaggtccccttgggaccgaaggtcccttaaggaacggtaacgtggtacgggtacttaaaggtttacttaacggttcgtataacgacttaaactattttaacctaacgtttctttaccggtactaccgtttcgggacgtaaaggaccgtaaggtcgagtactaacgaaacggtacttaggtcggacctacggtacctaccgtacgtactccggttacttccgtaac

SEQ ID NO: 65525 - DNA, 785 bp, Homo sapiens
  misc_feature: GYAE6OF02IWPH3.31.78.H01.1.454.CMB.1.raw
  modified_base (323)..(323): a, c, t, g, unknown or other
  misc_feature (323)..(323): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctctggcgagagggccaccatcaactgcagtccagccagagttgttttattcggaccccaccaactaaccaacttacttagcgttggtaccagcaagaaagtaggacacgcctacctaactctagtatttacgnggtccttccgtacccggactacgtcccggggttacctaaccgtacttctacgttcggcgtacggcgggtcgtacgggaccgtactttcgaccttcctacctacctacgtcacgaccaccggtccctacggtcgacgggtacgtacggaaacggtaggttacggtacgggtacctttaaaggtttttaaccgttacccgttaggttcccgtaaacgtaaccctaaacctttaaattttaaccttttaacccgttttttacccgttttacccgtttaacccggtttacggtttttaacccgggggaaccggggtaaaccggggtaacccggtaaggggtttacgggaacgttaaccgtaaacccgggtaaaacgttaaccggttgggttacccgggtaacttacccggtaacccgtaaccgttaccggttacccttaccgggttttacctacccgttaaccccg

SEQ ID NO: 65526 - DNA, 548 bp, Homo sapiens
  misc_feature: GYAE6OF02HO3M2.31.78.H01.1.454.CMB.1.raw
  modified_base (351)..(351): a, c, t, g, unknown or other
  misc_feature (351)..(351): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggaccaccatcaactgacaagtccagccagagtgttttattggccccacaataacaactattagcttggaccagcagaaagtaggacagcctactaaactctagtattacgtggccttcgtaccgggctacgtcccggggttcctaaccgnttcagttggcaggcggtctgggacctattcactctacacctatcancagcctagcgnggctagaagagtgtcggtactaagtttatacgtgtcagacaatattacttacttacttcgtacttacgttcggacggacggacgtaggtacgagtatacgaaacgtatacggtgctagctaacngttctntccgttatcg

SEQ ID NO: 65527 - DNA, 644 bp, Homo sapiens
  misc_feature: GYAE6OF02I58S3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccgatcaactgcaagtccagccagagttgttttattcggccccacaataacaactacttagcttggtaccagcaagaaagtaggacagcctacctaaactcctagtacttacgtggccttcgtacccgggctacgttcccggggttacctaaccgtattcagttcggacaggtcgggtcgtagggtacccgtatttccacttctaccgaacctatccagccgagcccgtgaccgtaggccttaggaaacgtgtaggtcggacttaaggtttattacgttcggtacaagacctaactatttaacttacctttacgttttaccgtacgttaccggtttcgggacgggtacggtaaccgtaagggtcggaacgtacgtaaccgaaacggtaaccgttggtcggtacgtgacctaccgtacgttcgtacgttcttactaccg

SEQ ID NO: 65528 - DNA, 536 bp, Homo sapiens
  misc_feature: GYAE6OF02FSTT6.31.78.H01.1.454.CMB.1.raw
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggaccagcagaaagtaggacagcctcctaaactcctgatttacgngggcttcgacccgggnagttcccggggttcctaaccgnttcattggcaggcgggtcngggaccgtatttcactctcaccatcagcagcctgcaggctgaagntgngctagtttatactgtcagacaactattaatactttctttcgtcctacgtttcgggacggtagggaccgtaagggtggagtatacgaaacgtagtgtgctgcactatctnttctntacc

SEQ ID NO: 65529 - DNA, 719 bp, Homo sapiens
  misc_feature: GYAE6OF02H1RFP.31.78.H01.1.454.CMB.1.raw
  modified_base (323)..(323): a, c, t, g, unknown or other
  misc_feature (323)..(323): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgacaagtccagccagagttgttttacttcggaccccacaataacaactacttagcttggtaccagcaagaagtaggacacgccctacctaaactcctagtatttcgnggtcttccgtacccgggctacggttcccggggttcctaaccgtnttcagttgcaggtcggtgtcgggaccgtatttcactctccacctatcgacgcacgtccctgccaggacgtagaagtagtgggtacggtacgttaagttttacttacgtcgttaaccgaacgtacgtaaacttaacgttttaactttaccgtttttaccgttttaccgttaccgttaaccgggtttttaccggggccgggggttaaacgggtaaacccggttaaagggggttacgggttaaaggtaaccgtttaaaccggaaaaccggttaaccggttacggggtacggtaccgtttacggaaccctacccggttaacgtttccgtttacggtttacccttacgttaaccccg

SEQ ID NO: 65530 - DNA, 634 bp, Homo sapiens
  misc_feature: GYAE6OF02FV4KD.31.78.H01.1.454.CMB.1.raw
  modified_base (414)..(414): a, c, t, g, unknown or other
  misc_feature (414)..(414): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggaccccacaataacaactacttagcttggtaccagcaagaaagtagacagcctacctaaactcctgtatttacgtgggtcttccgtacccgggctacgttcccggggttacctaaccgattcagtttcggcaggtcggtctgggacctatttcactctacaccatcaagcacncctgacaggctagaagtagtggtggacgttagtttaagttacgttagtcgagtacctaaagttactttaactacttttccgtttaccgttacctacggttttaccgggacgggtaacgggtaacccgtaagggttcgacgtacttaacggaaaacgtaacgtcgggtacggtaccgttcggacctaacccgtacgttacctcgttaccgttccttacccg

SEQ ID NO: 65531 - DNA, 562 bp, Homo sapiens
  misc_feature: GYAE6OF02IU6WY.31.78.H01.1.454.CMB.1.raw
  modified_base (412)..(412): a, c, t, g, unknown or other
  misc_feature (412)..(412): n is a, c, g, or t
  modified_base (557)..(557): a, c, t, g, unknown or other
  misc_feature (557)..(557): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaaagtaggacagcctctaaactcctgatttactgggcttctacccgggcacgtccggggttcctaacgattcattggcaggtcgggtcgtgggaccgatttcactctcacatcagcagcctgcaggctgaagntgtcggctagtttaattactgtacagtccaactattattacctttcttttccgcttactttcgggacgggacggtaaccgaggttggagtagtacgaaacgtaacgttgtagggtctacggtaccacctacgtcgtcgttacctntaccg

SEQ ID NO: 65532 - DNA, 619 bp, Homo sapiens
  misc_feature: GYAE6OF02INWF0.31.78.H01.1.454.CMB.1.raw
  modified_base (355)..(355): a, c, t, g, unknown or other
  misc_feature (355)..(355): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagtgttttattcggccccacaataacaactacttagcttggaccagacagaagtaggacagcctacctaaactcctagtattacgtgggcttccgtaccgggcacgttccgggttacctaaccgtnttcagttggacaggtcgggtcgtagggacctatttcacttctcaccatcagcacgcctgcaggctagaagtgtgtggacttagtttactacgtgtacagtacaaactattaacgtacttttctttacgtacttacgtttccgggacgggtaacggtaaccgtaagggtacgggtaacgtaacgttaaccgaaaacggttaacgttggtaacggtaccgttacgaccctaacctagttaccgttacggttcccttacgttacccg

SEQ ID NO: 65533 - DNA, 615 bp, Homo sapiens
  misc_feature: GYAE6OF02I2PG1.31.78.H01.1.454.CMB.1.raw
  modified_base (348)..(348): a, c, t, g, unknown or other
  misc_feature (348)..(348): n is a, c, g, or t
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacggccacatacaactgacaagtccagccagtagttgttttattcggaccccaaccaataaacaactacttagcttaggtaccagacaagaaagtaggacacgcctacctaaactcctagtactttacgtggtcttaccgacccggnacgttccgggttacctaacgtnttcagttcggctaggcgggttcgtacgggaaccgtactttccactcacctaccatccagcacgtcctgcgaggtctagaagtagtggtcggacgttagtttacttacgttgtacgacgtacaaacttacttacttacctttcgtttacgtacgttacggtttcggacgggtacggaaccgtaagggtcggatacgtaacgaaacgtacgtacggtggctacgacactacgtctcgttactacctc

SEQ ID NO: 65534 - DNA, 655 bp, Homo sapiens
  misc_feature: GYAE6OF02HSRMX.31.78.H01.1.454.CMB.1.raw
  modified_base (199)..(199): a, c, t, g, unknown or other
  misc_feature (199)..(199): n is a, c, g, or t
  modified_base (323)..(323): a, c, t, g, unknown or other
  misc_feature (323)..(323): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagngggccaccatcaaactgacaacgtccagccaagtagttgtttttattcggcccccactaataacaactacttagcttggtaccagcagaaagtggacagccctacctaaactcctgatttacgnggtccttcgtacccgggctacgttcccggggttacctaaccgtnttaccagttggacctagggtcgggttctcggggaacccgttattttcacgttcctacaactactacgacacgacgccgtgaccgagggtctaggaaagtagtggttacggtacttaagttttacttacgtgttaccgtagactaacgtatttaacttacgtttcctttcgttactacgttttccgggacgtaacgggtacgtaacgggtggaagtacttaaccgaaacgttacgtcgggtacgtccgtaggaccctaccgtattccgtacggttacctttactaaccg

SEQ ID NO: 65535 - DNA, 828 bp, Homo sapiens
  misc_feature: GYAE6OF02F8OTR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggccccacaataacaactactagcttggaccagcaagaaagtagacagccctacctaaactctagtactttacgcgggtcttaccgtacccgggctaccggttcccggggttaccctaaaccggtactttaccgtacgtttcggaccgtacgggttccgggggttaccgttaccggggggtaacccgttaacgtttttcccgaaacccgttttcccgttaacccctaaaccccgtaacgtttacccgaaccggtaacccgtaaccgggtaccccggttcggaccggtaccgggtaccgttaagggtaaacgtacggttacgggttacggtacgtttaacggttttacgttacgttacggtacctaaacggtaccctaaacgttaacttttactttaaccgttttccgttttaccgttaccgtttaaccgggttttccgggggaacgggtaacccggggttaaccggtaagggggttcggtaacggtaacgtaacccggtaaaaccggttacggttacgggtaccggtaccgttaccgacccgtaaccttacgttaccgtttaccggtttaccttaccgttacccg

SEQ ID NO: 65536 - DNA, 675 bp, Homo sapiens
  misc_feature: GYAE6OF02HK5BG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgttttattcggccccaacaataacaactacttagcttaggtaccagcagaaagtaggacagcctacctaaactcctagtactttacgtgggtcttaccgtacccgggctacgttcccggggtttacctaaccgtattcgagttcggcagggtccgggttcgtcggggtaccctatttccgacttcctacctaaccactcgacgccacgcctcggcgtacggctaggaagtacgttcggtacggtacttaaggtttttaacttacgtgttaccaacgtacaaacttagtttaactttaaccttttccgtttacgtaccttaccgtttaccggggaccgggtaaaggaacccgtaaggggtggaacgtacgtaaccgaaacggtaccgttggtaacggtactaccggtaccaaccgtacgttccgtacgttccttactacccg

SEQ ID NO: 65537 - DNA, 878 bp, Homo sapiens
  misc_feature: GYAE6OF02G39WR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacggccaccatcaactgacaacgtccagccagtagttgtttttattccggacccccaacaataaaccaacttacttagtcgttacggtaccagcaaaggaaagtacggacacgcccttaacctaaacctccgtagtaactttacgtcgggtcctttaccggtacccgggctaccggttccccggggtttaccctaaacccggtatttccgtaacgtttcgggacctacggggtccggggttcgtaccgggggtaacccgttattttccgaccttcccgttacccaaccgtactacccgacgtccgtaacggtcccgttacggaccggtaacgggtaccgtaaggtaaaaggtacggtttacggggtacgggttaccgtttaaacggtttttaacctttaaccgtttcggttaaccgtaacggtaaccctaaaacgttaattttaaccgtttaacccgtttttccgtttttacccggttaacccgtttacccgggttttaacccgggggtaacggggtaaaccgggtaacccggtaaagggggttacgggtaaacggttaacgttaaacccggtaaaaacccgggttaccggtttaaggggttacccggggtaccgttaccggtaccccttaaccgttaccgttccgtttacggtttaccctttaccgttaaccccg

SEQ ID NO: 65538 - DNA, 553 bp, Homo sapiens
  misc_feature: GYAE6OF02GKBNK.31.78.H01.1.454.CMB.1.raw
  modified_base (382)..(382): a, c, t, g, unknown or other
  misc_feature (382)..(382): n is a, c, g, or t
  modified_base (549)..(549): a, c, t, g, unknown or other
  misc_feature (549)..(549): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtagacagcctacctaaactcctagatttactgggtcttctacccgggctacgtccggggttacctaaccgtattcattggctagcgggtctgggacctnttcactctcacatcagcacgcctgcgaggctaggaagagtggtaggctagtttacttacgtgtacagtcaactattactacctttcttacttctacgtttcggcggacggaccaagggtgagtatacgaaacgaacttggtcgtactgctaccagttctcgtccttntacc

SEQ ID NO: 65539 - DNA, 591 bp, Homo sapiens
  misc_feature: GYAE6OF02JBX6K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagtgttttattcggccccacaataacaactacttagcttggtaccagcaagaagtagacagcctacctaaactcctagtatttacgtgggtcttccgtacccgggctacgtcccggggttacctaaaccggtacttccaatttcggcaacggtcgggttcgtgggacccgtatttcactctcacctatcagcacgcctgcaggctagaagatggcgtctagtttattactgtacagactaaactatttaactacctttctttcgttacctaccgtttaccgggcggtaacggaccgtaagggtcgagtaacgtaccgaaacgtacgtaggtagactgaccacgtatcctagttctctaccg

SEQ ID NO: 65540 - DNA, 556 bp, Homo sapiens
  misc_feature: GYAE6OF02IN5A4.31.78.H01.1.454.CMB.1.raw
  modified_base (309)..(309): a, c, t, g, unknown or other
  misc_feature (309)..(309): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgttttattggccccacaataacaactacttagcttggtaccagcagaaagtaggacagcctctaaactcctgatttacngggcttcaccggcactccgggttacctaaccgattcattggcagcgggtctgggaccatttcactctcaccatcacgcacgcctcgcgaggcctagaaacgatggtggactaagtttacttactgtacagacaactattactactttctttcgttctacgttttcggacggtacggaaccgtaagggtggagagtacgaaacgtaactggtagacctgacaaccgtatccgtagttccttactaccg

SEQ ID NO: 65541 - DNA, 656 bp, Homo sapiens
  misc_feature: GYAE6OF02GXMJZ.31.78.H01.1.454.CMB.1.raw
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagacgggccaccatcaactgcaagtccagccagtagttgttttacgttcggcccccacaataacaactacttagcttaggtaccagcaagaaagtaggacagccctactaaactcctagtaactttacgnggtccttccgtacccggggctacgttcccggggttacctaaccgattcagttggcaggcgggtcgtcgggacctatttcactctccaccagtccagccacgcctgcgaggctaggaagtagtcggtggacttagtttaacgttacgttgtaccgtaacgactaaactagtttaacttacctttcttttccgttacttaccgtttccgggaccgggtacgggtaacccgtaagggtacggacgtaacgtaaccgaaaccggtaacgttacgggtcggtaccgtacggaacctaccgtacgttccgtttacgttccgttacgttacccgg

SEQ ID NO: 65542 - DNA, 731 bp, Homo sapiens
  misc_feature: GYAE6OF02J15YK.31.78.H01.1.454.CMB.1.raw
  modified_base (499)..(499): a, c, t, g, unknown or other
  misc_feature (499)..(499): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaaggtccagccagagttgttttattcggcccctaacaactaacaacttactagtcttggtaccagcaagaaagtaggactacgccttacccaaactcctgtaatttacgtcggggtaccttccggtaccccggctacgttcccgggggttaccctaaccggtaattccgtagttcggcaacgggtccggggttccgtacggggtacccgtattttccgacttcctacccgaacacgttacaacgtcgacgtccctacggaccgacggtcctagaaacggngttacgggacggtcgttagtttaacgtttacgtcgttaacgaagtaccaaacgtttaacttactttaaccgttttccgtttaccggttacgttacggtttaccggaaccggggtacggaaacccggttagggtacgggtagtaattaaccggaaacggtaacgtttcggtaccgggtaaccgtacggaccctaccgttaaccgttccgtaccggtttctaacccggtttccc

SEQ ID NO: 65543 - DNA, 746 bp, Homo sapiens
  misc_feature: GYAE6OF02JQP4G.31.78.H01.1.454.CMB.1.raw
  modified_base (161)..(161): a, c, t, g, unknown or other
  misc_feature (161)..(161): n is a, c, g, or t
  modified_base (332)..(332): a, c, t, g, unknown or other
  misc_feature (332)..(332): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagcagtagacgtcacgaccggtgctcgatttagtgtgagtagtttgggtttgggggtaggcgtacaacaggcaggcgagggcagcaagatggtgttgcagacccaggtcttcattctctgttgctctgatctctggtgcctacgggacagtcgtgatgngccagtttccagactcccgtgctgtgtctcgtggcgagagggccaccatcaactgacacgtccagccagacgttgttttattcggaccccacgaactaaacacttacttagccttggaccagaccaagaaagtcggacacgcccttaccgtaaactcctagacttttacgngggtaccttccgtacccggggatacggttcccgggttacctaaccgattcacgtttacggcctaggtcgggtactaggggtaaccctntttcgacctccgttacaacccgttanaccgtacgaccgtactacccgttacgaccgtacgggtactaacggtaacgtacgtacggttacgggtacctaacgggttttaacttttaacgccggttaacctaacgggtacctaaacttacgtttaaactttaccctttttaaccgtttccgttaccgtttaacccgtttttacgggacccggggttaaggtaacccgggttaagggtaccggtaagtacggtaaccggtaaacggtaacgtttacggcggtaccgttacgaccgtactaccgttacgttccggttacttacgttaccg

SEQ ID NO: 65544 - DNA, 636 bp, Homo sapiens
  misc_feature: GYAE6OF02I5HGS.31.78.H01.1.454.CMB.1.raw
  modified_base (320)..(320): a, c, t, g, unknown or other
  misc_feature (320)..(320): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggaccccacaataacaactacttagcttacggtaccagacaagaaagtaggacagacctactaaactcctagatttacngggtccttaccgtacccgggctacgttcccggggttacctaaccgtattccagttcggccaggtccgggtcgtacggggaccctattttccgacgttcctacgaacctataccgagccacgtcctcgacgtaggcctaggaagtattcgggtcgtacttacgtttagttacgtgtaccgagacctaactattacttacctttcgttacgtctacggtttcggagggtaccggtaacaagggtacgagtaactaccgaaacgtacgttacggtgtaccgtagtacccaactacgtcgttacggttcctagttacccg

SEQ ID NO: 65545 - DNA, 804 bp, Homo sapiens
  misc_feature: GYAE6OF02I9OTA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtcgtctctgggcgagacgggccaccagtcaactgcaagtccagccagagttgttttattcggccccaacaactaacaactacttagcgttaggtaccagcagaaagtagacagcctactaaactcctgatttacgtggcttcgtacccgggcacgttccgggttacctaaccggtattcagtttcggactacggccgggttacgtcggggtaccgtacgttttccgaaacgttccgtaccgtaaccctaacgtccgaaacgtcgaaccggtacccgtttacgggccgaacggggtcctaacggtaaacgtaacggttcgggttacgggtaccggttaacggttttttaacgtttaacgtttccgggtttaccgtaaaccgggtaccctaaacgttaacgttttacgtttaaccgtttttcccgttttaacccggtttaccgtttaaccgttttaccggggtaccggggttaaccgggtaaacccgttaaacggggttaccgggtacgttaaccggtttaaccgtaaaaacggtttaaaccggtagggttaaccgggttaccgttaacggaccccgtaaccgttaccgttaccggtttcggttaccctttcgtaaacccg

SEQ ID NO: 65546 - DNA, 960 bp, Homo sapiens
  misc_feature: GYAE6OF02IGJN1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgtttattggccccacaataacaactacttagcttaggtaccagcaagaaagtaggacagcctacctaaaacttcctagtacttttaacgtcggggtactttccgtacccggggctacgtcccggggtttaccctaaacccggtatttccgaacgtttcggaccgtacgggtaccggggttccgtacgggggtaaccccgtagtttttacccgaccgtttaccttacccgaacccctaagtttacccgaacgggtcccgtaacggtaccccgtttacgggtacccgtaacggggtaccgttaacggggtaaaaggtacggttacggggttaacggggttaccccgtttaaagggttttttttaaccttttaaacccggtttcggtttaacccggtaacggttaaacccgtaaaaacccgtttaacgtttttaaaccttttaaccccgtttttttacccgttttttacccgggtttaacccgttttaaacccgggtttttttacccggggggaacccgggggttaaacggggggtttaaaacccccggttaaaaggggggtttaaccggggtaacggttaaaacccggtttaaacccggtaaaaaacccggggtaaaccggtttacggggttaaccggggttaaccccgttaagggtaacccccgttaaacccggtaacggttttaccccggtttacggtttaccccgtttttaacgttaaaccccccg

SEQ ID NO: 65547 - DNA, 594 bp, Homo sapiens
  misc_feature: GYAE6OF02ILF7W.31.78.H01.1.454.CMB.1.raw
  modified_base (454)..(454): a, c, t, g, unknown or other
  misc_feature (454)..(454): n is a, c, g, or t
  modified_base (486)..(486): a, c, t, g, unknown or other
  misc_feature (486)..(486): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagttgttttattcggccccacaataacaactacttagcttggtaccagcaagaaagtaggacagcctacctaaactcctagtactttacgtcgggtcctttccgtacccggggctacgttcccggggtttacctaaaccggatttcagttcggcacggtcgggtcgtacgggaccgtatttcgactcctacacctatcagcacggtcctgcaggtctaggaagntggtaggctagttttattactgtcagacaatnttaattacttctttcgcttacgttcggcggagggaaccagggtgagactaccgaaacggtacgtcggtacggacgttagccctaacgtacttcgttacgttcttccac

SEQ ID NO: 65548 - DNA, 630 bp, Homo sapiens
  misc_feature: GYAE6OF02IGVW2.31.78.H01.1.454.CMB.1.raw
  modified_base (464)..(464): a, c, t, g, unknown or other
  misc_feature (464)..(464): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggccccacaatacaactacttagcttggtaccagcagaaagtaggacagcctacctaaactcctagtatttactgggccttccgtacccgggcacgttcccggggttaccctaaccggtatttccagtttcggacgaggtccggggttaccgtcggggtaacccgtagttttccactcctaccaccctataccagccacggcccgttgccgaggctaggaaagnttacggtggacttaaggtttaacttacgtagtacgagtactaaactatttacttacgtttctttcgtacttaccgtttcggcgggtacgggaccgtaagggtggagtacgtacgaaacgtacgtcggtggtactgacctacctacgttctacgttccttactaccg

SEQ ID NO: 65549 - DNA, 567 bp, Homo sapiens
  misc_feature: GYAE6OF02HHD1O.31.78.H01.1.454.CMB.1.raw
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaaataacaactacttagcttggtaccagcagaaagtaggacagcctacctaaactcctagtactttactgggacttcgtacccgggctacgtcccggggttacctaaccgattccaagttcggcaggtcgggtcgtacgggaccgtatttccacttctacacctatcagcacgcctgcaggctagaagngtgtgctagtttattactgtacagacaatattactacttcgtttcgtctacgttcggacggtaggaacctagggtgagtataacgaaacgtactggtcgtactgacctaccgtattcgtagttctacgtac

SEQ ID NO: 65550 - DNA, 774 bp, Homo sapiens
  misc_feature: GYAE6OF02FPOHX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacggaccacatcaactgacaacgtccagccagtagttgttttacttccggaccccaaccaataacaactacttagcttaggtaccagcaaggaaagtacggacacgccctacctaaacctcctagtatttacgcgggtaccttccgtacccgggcacggttcccgggttaccctaaccgtatttacagttcggaccacgggtccgggttcgtacggggtacccttagttttccaaccgttcctaccaaccgtactccgaacgccgacgtcccgtacggaccgacgggtaccgtaggaaacggtacgttacgggtcggtaccgtttaaggttttaccttaccgttcgtaccgtaacgtaccgtaaacttaagttttaactttacccgttttccgttttaccgttaccgttaccgggttttaccggggaacggggtaaccgggtaaacccggttaagggggtacggtaacgtaacgtaaacccggtaaaacggtaacgtttcgggtacggtaccgttaccgggacccttaaccggtacgttacccggttacggtttacccttacgttaaccccg

SEQ ID NO: 65551 - DNA, 781 bp, Homo sapiens
  misc_feature: GYAE6OF02IGUE0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggagggccaccatcaatgcaagtccagccagagttgttttacttcggccccaacaataacaacttacttagcttggtaccagcaagaaagtaggacacgacctacctaaactcctagtacttacgtggtccttcgtacccggctacggttcccggggttacctaaccgtattccgagttcggacgtacgggtccgggttacgtacggggtaacccgttacgttttaccgaccttccgtacccgtaacccgtaacttccggaaccggtaccgtaaccggtccccgttagggacccgtaacgggtaccgttaggtaaaacggtacggttacgggttacgggtacttaacgggtttttaactttaccgtgggttaacccaaggtaacctaaactttaacgttttaaccgttaccgtttttacccgtttaccgttaccttaaccgggttttccgggaaccggggtaaacgggtaaccgtaaggggttgggaacgtacgtaaccggtaaaaccggttacggttcggtacggtccgtaacggtaccctaaccgtacgttacccgtttacgttccttaccgtaacccg

SEQ ID NO: 65552 - DNA, 733 bp, Homo sapiens
  misc_feature: GYAE6OF02H2QIU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagtagttgttttattcggaccccaacaataacaactacttagcttcgtacagcaagaagtagacacgtcctacctaaactctagtatttacgtcggtcttccgtacccgggctacggttcccggggttacctaaccgtacttcagtttggcctacggtcgggttcgtcggggtaccctagtttccacgttcctaccaccctagttaccgacgaccgtacgtccctggaccgtagggtccttaggtaaacgtaggtacggttacggtacgttaagttttttacgtaaccgtttcgtaccgtaacggtacctaaactttaacgtttaacctttacccgttttaccgtttttccggtaacctttacggttttacccggggaaccggggttaaacgggtacccgtaaagggggttagaacggtaacgtaacccggtaaaacggtaccggttagggttaccgacgtaccgacgttaccgtacgttacgttccttccgttaccttaacccg

SEQ ID NO: 65553 - DNA, 636 bp, Homo sapiens
  misc_feature: GYAE6OF02JHD14.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcaagaaagtaggacacgcctacctaaactcctagtatttacgtcggtcttccgtacccgggcacgttccggggttacctaaccgtacttcattggcagtcgggtctagggaccgtatttccactcctacacctatcagcacgccgtgcgacggctagaacgtagtgtggtacgtaagtttaatttacgtgtaccgagtaccaaacttactttaacttacctttccttttacgtaccttaccgtttaccggtacggggaacggtaaccgaagggtagggtagtaacgtaaccgtaaaccggtaacgttggtacggtacgtacgacccgtacctacgttccgtacgttacctttacctaccg

SEQ ID NO: 65554 - DNA, 558 bp, Homo sapiens
  misc_feature: GYAE6OF02FZIDF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctagtatttactgggcttccgtaccccgggcacgttcccggggttcctaaccgattcattggcaggcgggtctgggaccgtatttcactctcaccatcagcagcctgcaggctagaagtatgtggctagtttatactgtcagcaatattatactttctttcgtctacgtttcgggcggtacggaccgtagggtaggagtatacgaaacgtacgttggtggcctgacctacctacttcgttcgttccttctaccg

SEQ ID NO: 65555 - DNA, 545 bp, Homo sapiens
  misc_feature: GYAE6OF02GGWJJ.31.78.H01.1.454.CMB.1.raw
  modified_base (417)..(417): a, c, t, g, unknown or other
  misc_feature (417)..(417): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggaccagcagaaagtggacagcctcctaaactcctgtattacgtggcttctacccggcagtccgggttcctaaccgattcattcggcagcgggttctgggacctatttcactctacaccatcagcacgctacgcaggctagaagatggngcgtagtttatactgtcagacaactattactattcttcgtctacgtttcggcggtacggaacgtaggtaggagtaacgtacaaacggtatggtacgtctgaccacctagtcttacggttcctataccg

SEQ ID NO: 65556 - DNA, 589 bp, Homo sapiens
  misc_feature: GYAE6OF02F27K2.31.78.H01.1.454.CMB.1.raw
  modified_base (335)..(335): a, c, t, g, unknown or other
  misc_feature (335)..(335): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttattcggaccccaccaataacaactactagcttggaccagcagaaagtaggacagcctacctaaacctcctgtatttacgtggcttcgtacccgggnacgtccgggttcctaaccgattcagttggcaggcgggtctcggaccgtattcactctcaccatcagcacgcctgcagctagaaagntgngctagtttatactgtcagtcaaactatttactaactttctttaccgtactacgtttcgggacggtaacgggtaccgtaagggtaggacgtagtaaccgtaaacgtaacgttggtacggaccttacgacccttaaccgtagttaccgttcgttaccttcgtaaccc

SEQ ID NO: 65557 - DNA, 530 bp, Homo sapiens
  misc_feature: GYAE6OF02GPFKE.31.78.H01.1.454.CMB.1.raw
  modified_base (416)..(416): a, c, t, g, unknown or other
  misc_feature (416)..(416): n is a, c, g, or t
  modified_base (490)..(490): a, c, t, g, unknown or other
  misc_feature (490)..(490): n is a, c, g, or t
  modified_base (526)..(526): a, c, t, g, unknown or other
  misc_feature (526)..(526): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcagtccggggttcctaaccgattcattggcagcgggtctgggaccgatttcgactcgtcaccatcagcacgctgcaggctagaagatgnggctagtttatactgtcagcaacattatactttctttcgtactacgtttcggcggtacggaccgtaaggtgganagtacaaacgtattgagtctcgcacagtctgtcttntacc

SEQ ID NO: 65558 - DNA, 609 bp, Homo sapiens
  misc_feature: GYAE6OF02G701D.31.78.H01.1.454.CMB.1.raw
  modified_base (316)..(316): a, c, t, g, unknown or other
  misc_feature (316)..(316): n is a, c, g, or t
  modified_base (402)..(402): a, c, t, g, unknown or other
  misc_feature (402)..(402): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagtatttacgngggtctttcgtacccgggtcacgtccggggttcctaaccggtattcattggcaggtcgggtctgggacgactttcactctacaccntaccagcagtcctgcagctagaagtatggtggtactagtttatacttgtacacgtacaaactattacttactttctttacgtccttaacgtttcgggacggtaaacgggtacctaagggtcggagtaacgtaaccgaaaaccggttaaccgttggtacgggtacgtacggaccaaccgtcttacggtcgtttaccgttacttaaccg

SEQ ID NO: 65559 - DNA, 715 bp, Homo sapiens
  misc_feature: GYAE6OF02JQVYS.31.78.H01.1.454.CMB.1.raw
  modified_base (180)..(180): a, c, t, g, unknown or other
  misc_feature (180)..(180): n is a, c, g, or t
  modified_base (202)..(202): a, c, t, g, unknown or other
  misc_feature (202)..(202): n is a, c, g, or t
  modified_base (305)..(305): a, c, t, g, unknown or other
  misc_feature (305)..(305): n is a, c, g, or t
  modified_base (388)..(388): a, c, t, g, unknown or other
  misc_feature (388)..(388): n is a, c, g, or t
tcagcagtagacgtcacgaccggtgctcgatttagtgtgagtagtttggtttgggggtaggcgtacaacaggcaggcgagggcgagcaagatggtgttggcagacccaggtcttcattctctgttgctctggatctctggtgcctacgggacatcgtgatgagccagttccagactcccnggctgtgtctcgtggtcgaggngggtcccaccagtccaactgcaacgtccagccagagttcttttagttcggccccacgaataaccacttactagcttggtaccagacctagaaaacttggaccngaccctaccctaaatccgtgtaatttaccgtgggtccttacgtacccccgggatacgttacccgggggttccctaaaaccgtnttccgaatttcggacaacggttcggggtccttagggggaccctaattttccaacgtttcaccctaccgtaatcccgtaagccaacgtccgtacggtaccaggtacctacggaagttacgaccggttggacccgttaaggttttaaccttagttaccggttcaacgggtaccaacttaacgtttaacttaaccgttttccgtttaaccgttacttaccgttttacgggcggtaacggtaccgaacgggttgggactaacgtcgaaaacggtagttaccggtggtaaccctggaaccctaccgaccgttgtaacgtttccgtatacccg

SEQ ID NO: 65560 - DNA, 626 bp, Homo sapiens
  misc_feature: GYAE6OF02GX96R.31.78.H01.1.454.CMB.1.raw
  modified_base (324)..(324): a, c, t, g, unknown or other
  misc_feature (324)..(324): n is a, c, g, or t
  modified_base (344)..(344): a, c, t, g, unknown or other
  misc_feature (344)..(344): n is a, c, g, or t
  modified_base (443)..(443): a, c, t, g, unknown or other
  misc_feature (443)..(443): n is a, c, g, or t
  modified_base (468)..(468): a, c, t, g, unknown or other
  misc_feature (468)..(468): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttacttcggccccaacgaataacaactacttagcttaggtaccagcaagaaagtagacagcctacctaaactcctagtactttacgngggtccttcgtaccccgggntacgttcccggggtttacctaaccgtacttcgagtttcggcacggtcgggtctggggacctgtttcactctacaccatcagcacgctgcaggctgaagngtggtggactagtttatcctgtcanactaactattactactttcgtttctcttaccgtttcggacggtaacggtaaccgtagggttacggacgtacgttaaccgaaaaccggttacgtacggtacgggtaccgttacggacccttaacgtacgtttaccgtacggtttaccttacccttaccg

SEQ ID NO: 65561 - DNA, 748 bp, Homo sapiens
  misc_feature: GYAE6OF02HQZ1O.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaaactgcaagtccagccagagtgttttattcggccccaacaataacaactactagcttggtaccagcagaagtggacagcctctaaactctagatttacgtggcttccgtaaccgggctacggttacccggggttacctaaaccggtattccgtaatttcgggcctaaggtccggggtacttcggggaacccgttattttaccgaaccgttcctacctaaccgtacttcgacgcgtaacggtcccgttgacgtacggccgtaaggaagtacgtgtacgggtactaagttttaacttacgtaggttaccaggtacctaaaccgttactttaacgttaaccgttttcgttttaccgttaaccgttaacccgttttccggggaaccgggttaacgggtaaccccgtttaaaggggttaccggtaacgggttaacgtttaaccggaaaaccggttaaccggttacgggttcgggttaacccgtagggtaccccgtaaccgttaagttaccggttaccggtttaccgttaccgttaaccccgg

SEQ ID NO: 65562 - DNA, 832 bp, Homo sapiens
  misc_feature: GYAE6OF02HBHVF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagagggccaccatcaactgacaagtccagccagagttgttttattcggccccaacaataaacaactacttagcttggtaaccagacaagaaagtaggacagacctacctaaactcctagtactttaacgtcgggtaccttaccgtaccccgggtactaacggtttaccccggggtttaccccttaaacccggtactttaccgtaagtttaccgggacgtaacgggtccgggggttaccgttacgggggaaaccccgttaagtttttcccgaacctttcccttaacccgtaaccctaacttccgaacggtacctaacggtccccgttagggtaacgggtaccgttaacggaaaggttaagttacggtacgggtacgttaaacggtttttaacgtttaaccgtttacggttacaacggtaaccctaaaacttaacttttaacgtttaacccgtttttaccgttttaccgtttaccgttaaccgtttttaccggggacggggttaaaccggggtaaacccggtaaggggttaacgggaacgtaacgtaaccggaaaaccggtaaacgttaggtacgggtacctacggacctaaccgtactttaccgtacggtttaccttacgtaccgtttaccccg

SEQ ID NO: 65563 - DNA, 755 bp, Homo sapiens
  misc_feature: GYAE6OF02IORN9.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtctccatttctctgttgctctggatctctggtgcctacggggacatcgtgatgagccagtttccagactcctggctgtgtctcgtgggcgaggagggccaccatcaactgacaagtccagccagtagttgttttacttcggacccccacaataactaactacttagcttggtaccagcagaaagtaggacagcctactaaactcctagattacgtggtcttccgtaccgggcacgttccggggttacctaaccgtatttaccgagtttcggacctacggtccggggttacttcggggaacccgttatttaccgaacctccttaccaacccgtataccgacgccacgtccctacggaccgtaacgggtacctaggaaacggtagttacgggtacgggtaccttaaggttttaactttaccgtacggttaccgaagtaccctaaactaatttacttaaccgttttccgtttaccgttaccgttacggttttaccggggaccggggttaacgggtaaacccggttaaggggttacggtacggtaacgttaaccggtaaaaccggttaaccggttacgggttacgggtacccgttacggtacccgtaacccggtactttacccggttacgtttacccgtttaccgtaacccg

SEQ ID NO: 65564 - DNA, 676 bp, Homo sapiens
  misc_feature: GYAE6OF02GRNVL.31.78.H01.1.454.CMB.1.raw
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagttgtttttaattcggccccctaacaaataaaccaactacttagcttaggtaaccagcaagaaagtaggacagcctactaaactcctagactttacgngggtccttaccgtacccgggctacgttcccgggggttaccctaaacccggtatttccaagtttcggccaaggtccggggtctagggggaccctatttcgactactcacccattccagcacgcctagcgaggctagaaacgtgtggtacgcgtagtttaacttaccgtgtaccagactaaactagttaacttacctttcgttttcgacttaccggttttacgggacgggtaaacgggtaacccgtaagggttacgggacgtaacgttaccgaaaaaccggttacgttacgggtacgggtcctacggtacctaacccgtacgttccgtacgttaccttaccgttaacccg

SEQ ID NO: 65565 - DNA, 681 bp, Homo sapiens
  misc_feature: GYAE6OF02JB7HD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggccccaacaataacaactactagcttggtaccagcagaaagtaggacagcctacctaaaactcctagtactttacgtgggtccttccgtacccggggactacggttcccggggtttacccgtaaaccggtatttccgaacgtttcggacctaggggtccgggttccgtacggggtacccgttacttttaccgacgttaccttacctaacccgtatccgacgccgaacgtcccgtaggaccgtacgggtactaggaaaggtacgttggtcggaccttaggttttaacttacgttcgtacacgtacaaacttatttaacttacgtttctttacgtaccgttacgtttccgggacggtacgggaacctaagggtagtagacgtacgaaacgtacgtaggtacgtcgtacgactaccgtattacctcgttacgttctaccg

SEQ ID NO: 65566 - DNA, 675 bp, Homo sapiens
  misc_feature: GYAE6OF02JBTW1.31.78.H01.1.454.CMB.1.raw
  modified_base (313)..(313): a, c, t, g, unknown or other
  misc_feature (313)..(313): n is a, c, g, or t
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggacaggagggccaccatcaactgcaacgtccagccagagttgttttattcggccccaacaataacaactactagcttacggtaccagtcaagaaagtaggacagcctactaactctanattactggcttacgacccgggnacgtccgggttacctaacgtnttcagttggcaggtcgggttctggggtaccctatttccaacgttcctacaccattcgaacgtcacgcctgcgaaggtcctaggtaaagacttgggtacggacttaagtttacttacggttgtaccgtaagtaccctaaatacgtttaacttaacttttcccgttacgttaccttaccggttttaccggggccgggtaaacggtaaccgtaagggttcggaagaacgttaaccggaaaacgtacggttcgggtaaacggtaccttaccggaaccgtaccccgtaacgttccggtttacggttacccgttaccgttaaccg

SEQ ID NO: 65567 - DNA, 639 bp, Homo sapiens
  misc_feature: GYAE6OF02IV7H9.31.78.H01.1.454.CMB.1.raw
  modified_base (442)..(442): a, c, t, g, unknown or other
  misc_feature (442)..(442): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcctggctgtgtctcgtgggcgagacgggccaccatcaactgacaacgtccagccagagttgttttattcggccccacaataacaacgtacttagcttaggtaccagtacaaggaaagtacggacacgtacctacctaaactctagtactttacgtgggccttccgtacccgggactacggttcccggggttacctaaacgtattcgtagttcggaccgaggtccgggttgtacggggaacccttatttaccgactctcaacccntccagcacgtctcgcgacgtctagaacgtagtggtaggacttagtttattacgtgactagactaactattacttacttctttacgtctacgtttcgggacggtaacgggaacgtaagggtgtacgtaacgtaaccgtaaacgacggttcggtagtccgtcgtaccgacctacgtccttacggtaccttacgtaaccg

SEQ ID NO: 65568 - DNA, 627 bp, Homo sapiens
  misc_feature: GYAE6OF02GQF5H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggcccaccatccaactgacaagtccagccagagttgttttattcggaccccacaataacaactacttagcttggtaccagacagaaagtaggacagcctacctaaactcctagtactttacgtgggtccttccgtacccgggctacgttcccggggttacctaaccgtacttcagttcggcaggtcgggtcgtagggaccgtatttccacttcacaccatcagcacgcctgcaggtctaggaagtagtcggtagtacgttaagtttatacgttcgtacaagactaactagtttaacttactttccgtttacgtacttaccgtttcgggacgggtacggtaaccgtaagggtagacgtaacgtaccgtaaacgtaacgttggtacggtacctcgacctacgtacttcgtagttccttacgtacc

SEQ ID NO: 65569 - DNA, 695 bp, Homo sapiens
  misc_feature: GYAE6OF02IUJHC.31.78.H01.1.454.CMB.1.raw
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (469)..(469): a, c, t, g, unknown or other
  misc_feature (469)..(469): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggacccccaacaataaccaacttacttagcttaggtaccagcaagaaagtggacagccctacctaaactcctgtacttttacgngggtccttaccgtaccccgggntacgttccccggggttaccctaaccggattccgagttcggacctagggccgggttcgtacggggacctagtttccaacttctacccaaccatccaagccacgtcctgcgaggctagaagntggtcggactagtttacgttactgtacacgtacaactactttacttactttccgtttacgtaccgttaccgtttacggggaccgggtaacgggtaaccgtaaggggttacggtacggtaacgttaaccggtaaaaccggtaccggtttacgggtaccggttacccgtaggttacccctaaccggttaccgtttccgtttaccggtttaccctttaccgttaacccg

SEQ ID NO: 65570 - DNA, 927 bp, Homo sapiens
  misc_feature: GYAE6OF02J2ZJG.31.78.H01.1.454.CMB.1.raw
  modified_base (497)..(497): a, c, t, g, unknown or other
  misc_feature (497)..(497): n is a, c, g, or t
  modified_base (878)..(878): a, c, t, g, unknown or other
  misc_feature (878)..(878): n is a, c, g, or t
  modified_base (917)..(917): a, c, t, g, unknown or other
  misc_feature (917)..(917): n is a, c, g, or t
tcagcagtagacgtcacgaccggtgctcgatttagtgtgagtagtttgggtttgggggagctacaacaggcaggcagggcagcaagatggtgttgcagacccaggtcttcattctctgttgctctggatctctggtgccgtacgggacatcgtgaatgacgcctagtttccacgacctcccgtggcttggtcgtccttcgtcgggacgacggacgggccctaccacttacaaaccgttcggaccaaaccggtcccacggacccgaagttacggtttgtttttaacgttcccgggaacccccctaaaccgtaaaacttaaaaccctaaaccgtttaccgttaacggtacccggtttacgggtaacccctaaggaaccgtaaaacgggtaaaaggttaccggaaaccgtaccggtacccccttaacccgttaaaacctcccggttagttaaaaccgttttccggtacgggttcccctttaccccggtaacccccggggnttaaaccggggtttcccccggggttaaccctaaccggtaactttccgtaaaacggttcggtacccgaacggggtcccgggtttaccgtaccgggggtaaacccttacgtttttccaacccttttacccgccccgtaaacccgttacgaacctaaccgggtacccacgtcccttacgggacccgtaaacgggtccgtaagtaaaccggtattcgggggttaccgtaaccttaggttttttaaccaacgggttcttaacccgaaggtaccctaaacttaatttaaccgttcttttccccggtttagtccgttaaccgttcgggaacgtaacggttaacgacgggttagacgtaaccttacggaaacgtcgtcgggttaacccnggtaacccgcctaaccgaccgtttgttccggtttaaccnccttaccccg

SEQ ID NO: 65571 - DNA, 577 bp, Homo sapiens
  misc_feature: GYAE6OF02F522N.31.78.H01.1.454.CMB.1.raw
  modified_base (315)..(315): a, c, t, g, unknown or other
  misc_feature (315)..(315): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctagtatttacnggggctttccgtacccggggctaacggttcccggggttaccctaaaccggatttccagtttcggctaggccgggttcctcggggaacccgtattttccaactctccaccctaatcacgcacgcctgcaggctagaagatggtgactagtttacttactgtcacgctaactattattacttctttcgtctacgtttcggcgtaggaccaggtgagtatacgaaacgtacgtgtcggtctgacacgacttcgtcgttctctacg

SEQ ID NO: 65572 - DNA, 807 bp, Homo sapiens
  misc_feature: GYAE6OF02GAABA.31.78.H01.1.454.CMB.1.raw
  modified_base (200)..(200): a, c, t, g, unknown or other
  misc_feature (200)..(200): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagnggccaccatcaactgcaagtccagccagagtgttttattcggccccacaataacactacttagcttggtaccagcaagaagtaggacagcctactaaacctcctagtactttacgtgggtcttccgtacccggggctacgtcccggggttacctaaccgtattccgtagtttcggacctacgggtccggggtacgttacgggggaacccgtagttttccgaaccttcctacccaacccgtagttacccgaagccgaacgtcccgtaggaccgaacgggtcgttacgggaaaacgtacgttacggggttacggtaccgtttaacggtttttaacgtttaaccgttggttaaccgtaacgggtaacctaaaccgtttaacgttttaaaccgtttaacccgttttttaccgtttttacccggtttaccgttacccggtttttacccggggaccggggttaaaccggggtaacccggtaaagggggttacgggtaacggtaacgttaacccggtaaaacccggtaacgtttacgggtaccgggttacccgttacggaacccgtaacccgttaagttcccggtttaaccggttaccgtttacccgtaacccg

SEQ ID NO: 65573 - DNA, 777 bp, Homo sapiens
  misc_feature: GYAE6OF02HUYGX.31.78.H01.1.454.CMB.1.raw
  modified_base (393)..(393): a, c, t, g, unknown or other
  misc_feature (393)..(393): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtgccgtacggggacatcgtgatgagccagtttccagactcctggctgtgtctgtgggcgaggacggccaccatcaaacgtgacaacgtccaagccaaggtagttgtttttacttcggacccccaactaaactaacaactacttagtcttacggtaccagacaagtaaaggtagacacgccctacctaactcctagtactttacgcggtacttccggtaaccccggctacggttaccccggggttacctaaaccggtnttacgtacggtttcggacgtacggggtccggggttcgtacgggggtaaaccccgtttacttttacccgaccgtttacctacccgtaaccctaaggttccgtaacggacccgtaacgcccgttcggaaccgtacggtaccggtaggaacgtaacggttacgggtacggtacgtttaaacggttttaactttacggtacgttaacgtaacgtaacctaaaacgttactttaaactttaccttttaccgtttaccgttaccggttacggtttaccgggtaccgggtaaacggtaccgtaagggtacggtagtaacgtaacggtaaacgtaccggtagggtacgtaccgtcgaacctactaccgttacggtacttcgtaccttaaccg

SEQ ID NO: 65574 - DNA, 597 bp, Homo sapiens
  misc_feature: GYAE6OF02JKIXZ.31.78.H01.1.454.CMB.1.raw
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
  modified_base (466)..(466): a, c, t, g, unknown or other
  misc_feature (466)..(466): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttcggtaccagcaagaaagtaggacagcctacctaaactcctagactttactgggtccttccgtacccgggcacgttccggggttcctaaccgtattcattggcaggtcggggtctggggaccctatttccactcctcacctatccgagctacgcctgcgaggtcgtagaagngtgnggtctagtttacttactgtcgancaactattacttacttcttcgtctacgtttccggacgggtacggaaccgtaggtcggtagacgtaacgtaaacgtagtacgggtcgtacgttcgactacccgtattaccggttcttaccgttacgttaccg

SEQ ID NO: 65575 - DNA, 845 bp, Homo sapiens
  misc_feature: GYAE6OF02FT0SC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctggcgagagggccaccatcaactgcaagtccagccagagtgttttattcggaccccacaataacaactactagcttggacagcaagaaagtaggacacgacctacctaaactccctagtacttttacgtgggtccttacgtaaccccggggctaacgttcccgggggtttaccctaaacccggtactttccgagtttacggacgtacgggtccggggttacgtacgggggtaacccgtacgtttttaccgaaccgttcgtacccaacccctaattacccgaacggtccctaaacggtccccttacgggacccgtaaacggggtaccgttacggtaaaagggtaacgtttcgggttacgggtaccgtttaacggttttttaaactttaaccgtttcggttacccgtaagggtaacccttaaaaccgttaaacgttttaacctttaaccgtttttacccgtttttacccggtttacccgttaacccggtttttaacccgggggttaaccggggtaacggggttaaaccccgttaaaggggtacggggttaacgtaaacgttaacccgtaaaaacggtaaacccttggggttaaccggtaccgttacggtaccctaaccgtacgttaccgtttaccggtttaccttacccgttacccg

SEQ ID NO: 65576 - DNA, 592 bp, Homo sapiens
  misc_feature: GYAE6OF02HW6N9.31.78.H01.1.454.CMB.1.raw
  modified_base (439)..(439): a, c, t, g, unknown or other
  misc_feature (439)..(439): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcctggctgtgtctcgtgggcgagacgggccaccatcaactgcaacgtccagccagagttgttttattcgccccaacaataacaactattagcttggtaccagcagaaagtagacacgccctacctaaactcctagtatttacgtggtccttccgtacccggctacgttcccgggttaccaaccgtattcagttcggcagcgggtctcgggacctagtttacaccgttctaccaccatcagccagcctagcgaggctagaagntggtcggtactagtttacttactcgtacagtacaacgttattacttactttcgtttaccgtctaccgttcggacgggacggacgaagggtgacgtactacgaaacgtactggtcggtctaggacctaacgtattccgtacgttcctactaccg

SEQ ID NO: 65577 - DNA, 552 bp, Homo sapiens
  misc_feature: GYAE6OF02FG9AF.31.78.H01.1.454.CMB.1.raw
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagaggccacatcaactgcaagtccagccagagtgttttattcggcccccacaataacaactacttagcttggtaccagcagaaagtggacagcctacctaaactcctagattttacngggcctttcgtaccccgggnaacgtcccggggttacctaaccggtattcattggctagcgggtctgggaccgtattcactctcacctatcacgcagcctgcaggctgaagtatcgtgctagtttatactgtacagtacaactattactactttctttcgtactacgtttcggcgacgggtaccagggtgagactacgtaaaacgacgtgtgctagaccacctatccgtcgttcttctacc

SEQ ID NO: 65578 - DNA, 678 bp, Homo sapiens
  misc_feature: GYAE6OF02IQEXW.31.78.H01.1.454.CMB.1.raw
  modified_base (347)..(347): a, c, t, g, unknown or other
  misc_feature (347)..(347): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagagttgttttacttcggaccccaacaataacaactacttagcgttggaccagacaaggaaacgtaggacacgtaccctactaaactcctagtatttacgcgggtctcgtacccgggntacggttccgggttacctaaccgattcgattggacctaggcgggtactcgggtaaccgtatttaccaccgtctacgacctagtaccgtagcagtcctagcgaggtctagaaagtagtcggtacggtctaagttttacttacgtacgttacagaccgtaaacgtatttaacgttactttaccgtttaccggtaccgttacgttttaccgggacgggtacgggtaaaccgtaagggttagtacgtaacgttaaccggtaaaaccgtacgtacgggttaccgtacgtccggtaaccgtaccttaacggttccttacgttcccgttactacccgg

SEQ ID NO: 65579 - DNA, 609 bp, Homo sapiens
  misc_feature: GYAE6OF02HNK4V.31.78.H01.1.454.CMB.1.raw
  modified_base (326)..(326): a, c, t, g, unknown or other
  misc_feature (326)..(326): n is a, c, g, or t
  modified_base (403)..(403): a, c, t, g, unknown or other
  misc_feature (403)..(403): n is a, c, g, or t
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatggagccagtttccagactccctggctgtgtctcgtgggcgaggagggccaccatcaactgcaagtccagccagagttgttttattcggccccaacaataaccaactacttagcttggtaccagcaagaaagtaggaacacgcctacctaaactcctagtactttacgngggtcttaccgtacccgggctacgtcccggggttacctaaccggtattcgagttggcaggtcgggtctagggacctntttcactctcaccatccgagtcacgtccnggcaggcgtagaagatggtgacctaagtttactactgtacagactaactagttacttactttactttcgtacgttacgtttcgggacggtaacgggaccgtaagggtaggagtaactacggaaaacgtacgtaggtcggtacgtgacctaccggaattccgtacgttccttatcccg

SEQ ID NO: 65580 - DNA, 924 bp, Homo sapiens
  misc_feature: GYAE6OF02ICZLO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtggcgaggacggccaccatcaactgacaacgtccagccaagagttgtttttacgttcggaccccctaacaaattaaaccaaaccttacttaacggtcctttacgggtaacccaggtaccaaaggtaaaaacggttacgggaaccaacggtaccccttacccgtaaaaaccttcccgttaaggtaactttttaaccggtcgggttacctttaccggtaaccccggggtcaaccgggtttccccggggggtttacccctaaaaccggtctttaccgaagttttcgggaccgtaacggggtccggggtttccgtacggggtaacccggttaacttttcccgtaaccgttccgttacccgtaacccgtaacgttaccgtaaccggaccgtaaaccgggtcccgttacggaccggtaacggggtacccgttaacggtaaacgggtaacggtttcgggtacgggtacccgtttaagttttaacgttttacgtagttacccgtaagtacctaaacttaagtttaacctttaccgttttaccgttttaccgttacccgtttaaccggttttacccggggtacggggtaaaccggggtaaccgtaaacgggggttcgggtaacgttaacggtaacccggtaaaaccggtaccggtttcggggtaaccgggttaccgttaccggtacccgttaaccggtactttaacccggttacggttttacccttacggtttaaccccg

SEQ ID NO: 65581 - DNA, 729 bp, Homo sapiens
  misc_feature: GYAE6OF02IGATA.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagctccctggctgtgtctcgtgggcgagagggccacctatcaactgcaagtccagccagagtgttttatcggaccccacaataacaactactagcttggtaccagcaagaaagtaggacagcctacctaaactcctagatttaccgngggtccttcgaacccgggctacgtcccggggttacctaaaccgtattcctaattcggacctaagggccggggttcttacgggggaaccccgtaattttccaacgtttcctacctaacccagttaccgaacggtccaaccggcccttcggacgaacgggtcccgttaacggaaacggaaagttaccggtggtaccgttaaggttttaaacgttttaacgttcgttacccgaagaccgtaaaacctaatttaacttaaaccggttttcctttccgtttaacctaacccgtttttcggggaccggtaacgggtaaacccggtaaagggttaccgtaggtaacgtaaccgtaaaaacggtaaccgtagtcgggtctacggacttaccagtttaccgtcgtttaccgttacttaacc

SEQ ID NO: 65582 - DNA, 732 bp, Homo sapiens
  misc_feature: GYAE6OF02JSCJR.31.78.H01.1.454.CMB.1.raw
  modified_base (471)..(471): a, c, t, g, unknown or other
  misc_feature (471)..(471): n is a, c, g, or t
tcagcagtagacgtcacgaccggtgctcgatttagtgtgagtagtttgggtttgggggtaggcgtacaacaggcaggcagggcgagcaagatggtgttgcagacccaggtcttcatttctctgttgctctggatctctggtgccgtacggggacagtcgtgatgagccagtttccagactccctggctgtgtctcgtgggcgagaggggccaccgaatcaactggcaacggtccagaccagagttcgtttaattcggcccctacaataaccaacgtaacttacggctttaggtaccacggaccaggtaaaacgtggaccaacgcctacccgtaaactccgtgaactttacgtggcttaccgtaacccgggctaacggttcccggggtccttaaacccggatttccgaacgtttcggacctaaggtccgggtcgttaggggaccccgtatttacctacgtcctacgtaaccnttaccggacacgtacgccgtagaccgacggtacgtacggtaacgtacgtcggtacggtaccgtaaggtttaacgttaaaccgttgtacccgtaagtactaaaccttaaccgtttatttacctttaccggttttctaccgttaccggttttacggacggttaacggtaaccggtaagttacggggtactaacgtaaccggtaaacgtaacgtcgtaacgttcggaactacgtaccgtaatccggtttcgtacgttccctacg

SEQ ID NO: 65583 - DNA, 593 bp, Homo sapiens
  misc_feature: GYAE6OF02IBIGY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgttttattggcccccacaataacaaactacttaagcttggtaccagcaagaaagtaggacagctcctaaaactcctgtactttactgggtcttaccgtacccgggacagtcccggggttacctaaccgattcagttacggcaggcgggtctcgggaccgtatttccactctcaccatctagcagcctgcgaggctagaagagtgtggtctagtttaacttatagtccagactaaactatttacttaactttctttcgtactacgttttacgcgggtaggaaccgtaaggtggaagacttaacgaaacggtaacgtgtggtaccgtgaccgtacctattacccgttgttacccgttatacccg

SEQ ID NO: 65584 - DNA, 848 bp, Homo sapiens
  misc_feature: GYAE6OF02JEC9C.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacggccaccatcaacgtgcaacgtccagaccgagtagttgttttacgttccggacccccaactaaactaaccaacttaacgttacgcgttacggtaaccagaccgaaggtaaaacggttacggaacctaacggtacccttaacccgttaaaaccttcccgttaaggttaaccttttaccggtcgggttaccgtttacccggtaacccccgggtattaacccgggtttaccccgggggtttaaccccttaaaacccgggtactttaccgtaaggtttaccgggaccgtaacggggtccggggttaccggttaaccggggggtaacccttacggttttacccaaccgttaccgtacccgtaacctacgttaccgacggtaccgaccggtccgtacggaccgaacgggtacgtaacggaaacgtgttacgggtacggtacgtttaacggtttacttaccgtcgtaccacggaacttaaaccgttactttaaccgtttaccttttacgtttcccgtaccgtttaccgggttaccggtacggggtaaccggtaaaccggtaagggtaacggactaacggtaaccggaaacgtaaccggttggtacgaccgtcgaccctaacgttaccgttcttacgtttcctacttacccg

SEQ ID NO: 65585 - DNA, 653 bp, Homo sapiens
  misc_feature: GYAE6OF02GKETY.31.78.H01.1.454.CMB.1.raw
  modified_base (273)..(273): a, c, t, g, unknown or other
  misc_feature (273)..(273): n is a, c, g, or t
  modified_base (630)..(630): a, c, t, g, unknown or other
  misc_feature (630)..(630): n is a, c, g, or t
  modified_base (650)..(650): a, c, t, g, unknown or other
  misc_feature (650)..(650): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgccgtacggggacattcgtgatgagccagtttccagactccctggctgtgtctcgtgggcagcggccacatcgaactggcaacgtccagccagtagttgttttacttcggaccccacaaataacaactacttancgttacgtaccagcaaggtaaagtaggacagtccctaccttaaacctcctagtactttacgcgggtccttaccggtacccgggctacggttcccggggttacctaaccgttacgttcgaaggtttcggaccgtaacgggtccgggttcgtacggggtacccgtacttttccgaacttcccgtacaaccctatccgacgtcgacgtccgtcgaccgacggtcgtaaggaagtacgtcggtcggtacgttagtttacttacgtcgtaccagtaccaagttactttagttacctttcgtttcgtacgtacgtttcgggacgtaggtaaccgtggtacggactatacgaacgtatggtacngtcgacactgtactcgtctntcc

SEQ ID NO: 65586 - DNA, 625 bp, Homo sapiens
  misc_feature: GYAE6OF02FUV6A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctagatttactgggtaccttcgtaaccccggggctaagttcccgggggtttacctaaaccggtactttccaatttcggcaggcgggttcgtaggggacccgtagttttccacctctacaccctatcaagcagccctgcaggctaggaaagtatgtggacgtagttttattaccgtgtacgagaccaactatttaactacttttcctttcgtctacgtttcgggccggtaacgggtaccaagggttcggacgtaacgtacgaaaaccgtaacgttggtcgggtactcggtaccaccgtaacgttctacggttcctacgtaccg

SEQ ID NO: 65587 - DNA, 716 bp, Homo sapiens
  misc_feature: GYAE6OF02G1XII.31.78.H01.1.454.CMB.1.raw
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggaccccacaataacaactacttagcttaggtaccagcaagaaagtaggacagcctacctaaactcctgtatttacgngggtccttccgtacccgggntacgtccggggttaccctaaacgtattcagttcggactacggcgggttacctggggaaccctagttttccgacttcctaccaacctactccgagaccacgccctaggccgaggtccgtaggaaacgtagtggtacggtacttaaggttttactaccgttacggtaccaaggtaacctaaacgttaattttaaccttaccttttaccgtttttaccgtacctttaaccggttttaccggggaccggggtaacgggtaaacccggtaagggggttacggaacgttaacgtaaaccggaaaacgggttaaccttgggtaacggtaccgttacggaccctaaccgttacttaccggttcggtttaccttccgtaacccg

SEQ ID NO: 65588 - DNA, 632 bp, Homo sapiens
  misc_feature: GYAE6OF02HSNPQ.31.78.H01.1.454.CMB.1.raw
  modified_base (472)..(472): a, c, t, g, unknown or other
  misc_feature (472)..(472): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccaacaataacaacttacttagcttggtaccagcaagaaagtagacagcctacctaaactcctagtactttacgtgggtaccttccgtacccgggcaacgttccggacggtttaccctaaaccggtatttactaatttcgggactaggtccggggttcgtacgggaaccgtattttccaccttcctccaaccctatccagcacgtcctggcagggctaggaaagtntggtggtactaagtttttatacgtgtcagactaactattattactttctttacgtactaccgtttcgggacggtaacgggtacgtaagggttcggaagtacgtacgaaaacggtacgtggtcgtcgtacgacctacccgtatttccgttcgtacttaccg

SEQ ID NO: 65589 - DNA, 866 bp, Homo sapiens
  misc_feature: GYAE6OF02J1B65.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatccaactgcaagtccagccagagttgttttattcggccccacaataaccaactacttagcttgtaccagcagaaagtacggacacgcctacctaaactcctagtactttacgtcgggtcctttaccgtaccccggggtctaacggttccccggggggtttacccttaaacccggtacgtttaccgtaaacgtttcgggtaccgtaacggggtacccgggggtttccgttacggggggtaacccccgttaacgtttttacccgtaaccgtttacccggttaccctaaaccccggttaactttacccggaaccggttacccgaaccggtccccgttacggtacccggaacgggtaccgtacgggtaaacggtaacgttgggttaccgggtaaccgttaacgggtttttaactttaaccgttacggttaccgtaacggtacctaaacccgttaattttaaaccgttaaccgttttaccgtttttacccggtaccgtttaccgtttttaccgggggaccgggtaaaccgggtaaaccgttaacggggttacgggtacgtaacgttaacccggtaaaaccggttaccgttacggtacgggttaccgtacggtacccgttaacccgtacgtttacgttcggtttaccgttccgttaacccgg

SEQ ID NO: 65590 - DNA, 579 bp, Homo sapiens
  misc_feature: GYAE6OF02F3V61.31.78.H01.1.454.CMB.1.raw
  modified_base (537)..(537): a, c, t, g, unknown or other
  misc_feature (537)..(537): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaacaataacaactacttagcttggtaccagcaagaagtaggacagcctacctaaactcctagtactttactgggtcctttcgtacccgggctacgttcccggggttcctaaacgtcttcagttcggacacggtcgggtctgggacctatttccacttcctccaccatccagcacgccctggacagggtctaggaagagttcgtaggtcttaagttttattactgtacagtacaactaatttagtactttcttcgtactacgtttcggacggtacggaacgaggtagagtanacgtaaacgacgtggtgctgacacctatcgtacgttctatcg

SEQ ID NO: 65591 - DNA, 718 bp, Homo sapiens
  misc_feature: GYAE6OF02J2J5O.31.78.H01.1.454.CMB.1.raw
  modified_base (374)..(374): a, c, t, g, unknown or other
  misc_feature (374)..(374): n is a, c, g, or t
  modified_base (440)..(440): a, c, t, g, unknown or other
  misc_feature (440)..(440): n is a, c, g, or t
tcagcagtagacgtcacgaccggtgctcgatttagtgtgagtagtttgggtttgggggaggctacaacaggcaggcaggggcagcaagatggtgttgcagacccaggtcttcattctctgttgctctggatctctggtgccgtacggggacatcgtgatgagcctagtttccagactccctggctgtgtctgtgggcgagacgggccacatcaactgacaagtccagccagtagttgttttattcggaccccaacaataacaactacttagcttggaccagcaagaaagtggacacgacccttaccaaactcctagtactttacgtcgggtcttccgacccggggctaacggttcccggggttacctaaccgtnttcgtacttcggctacggggccggttcgtaggggtaccctactttcaccgtccttaccgacctaanccgtagccgtacgccgtgccgaggtcgttagaacgtacttgggtcgtacgttaacggttttaacttccgttagtaccgtaacgtacctaaacgttaactttaacgtttaccttttaaccgttttccgttaccctttacggttttacccggggacgggtaaaccggggttacctaaggggtacgtagtaaccgttaaccggtaaaccggtaaccgtggtaccggtaccgtacgtacctaaccggtaactttcggtaccgtttacgttacccgttacccg

SEQ ID NO: 65592 - DNA, 647 bp, Homo sapiens
  misc_feature: GYAE6OF02HT1KM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccaacaataacaactacttagcttggtaccagcagaaagtaggacacgaccctacctaaactcctagtatttacgtgggtcctttccgtacccgggctacggttccccggggtttacctaaccggtacttacacgtttcggctagggccggggttcgtcggggtacccgttatttaccacttcctccaacctattccgacgtccaacgtcccttaggaccgtacggtcctaggaacgtagtgggtacggtacgttagtttattacgtgtacacgactaaactattacttacctttctttccgtacttaccgttcggacgggtacggaacgtagggtgacgtacgtacgaacgtacgtggtacggaccgtcgacctacgtactcgtcgttccttacgtaccg

SEQ ID NO: 65593 - DNA, 784 bp, Homo sapiens
  misc_feature: GYAE6OF02GUWPD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagtgttttattcggccccacaataacaactacttagcttggtaccagcaagaaagtaggacagccctacctaaactcctgtatttacgtgggtccttccgtacccgggctacgttcccggggttaccctaaaccggtacttacgtaacgttcggacctagggtccggggttacgtacggggtacccgtaacgttttccgaaccttccgttaccaaccctaacgttacccgaacggtaccgtaacggtcccgttcggaccgaacgggtaccgtaggtaaacggtacgttacgggtacgggtacgttaacggttttaacgttaaccgttcggttaccgtaacggtacctaaacgttaagttttaactttaaccgtttttccgtttttaccgttaccgttaaccggtttttccggggaaccggggttaacgggtaacccggtaaggggttacgggtaacggtacttaaccggaaaacggttaaccggttcgggttacgggtaccgtacggtaccgtaacccgtacgttacccgttacgttaccgttaccttaacccg

SEQ ID NO: 65594 - DNA, 668 bp, Homo sapiens
  misc_feature: GYAE6OF02G5JYV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgcaagtccagccagagttgttttattcggccccaacaataacaactactagcttagtaccagcaagaaagtagacagcctacctaaactcctagtactttacgtcgggtacttaccgtacccgggcacgttcccggggttacctaaccgtacttcagtttcggctacggccgggtcgtacggggaccgtagtttaccacttccgtaccacctagttccacgtaccgtacggaccctcggacgtacggtctaaggtaaggtacgttggtacggtaaccttaagttttaacgtttacgttacgttacaacgtactaaatacttttaacttaccttttcgtttaccgttactacgtttcgggaccggtaaggtaccgaagggttaggtacgaacgttaacgaaacgtacgttggtcgtacgtacgtacgtacctattcgtacgttccttatacccg

SEQ ID NO: 65595 - DNA, 781 bp, Homo sapiens
  misc_feature: GYAE6OF02GTMG2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagacgggccaccatcaactgcaagtccagccagagtgttttattcggccccaacaataacaactactagcttggaccagcaagaaagtaggacagcctacctaaactcctagactttaacgcgggtacttccgtaacccgggctaacgttcccgggggtttaccctaaaaccggtactttaccgtaacgtttcgggacctaaggggtcccggggttacgtacgggggtaacccgtaacgtttttccaacctttaccgtaccaacccgtaattcccgaaggtaccaacggtacccgttaggacccgtaagggtccgttagggaaaagagttcgggtacgggacttaaggtttttaacttacggttacgttacgaacggtacctaaaacgttactttaaacgtttaccttttaccgttttaccgttaccttaaccgggtttttacccggggacgggtaaacgggttaaaccgaaagggttcgggtaacgtaacggtttaacccgaaaacggttaaaccggttagggttaccggtacctaggaccctaaccgtaagtttacccgttacggttacccttacttaacccgg

SEQ ID NO: 65596 - DNA, 586 bp, Homo sapiens
  misc_feature: GYAE6OF02H282N.31.78.H01.1.454.CMB.1.raw
  modified_base (374)..(374): a, c, t, g, unknown or other
  misc_feature (374)..(374): n is a, c, g, or t
  modified_base (566)..(566): a, c, t, g, unknown or other
  misc_feature (566)..(566): n is a, c, g, or t
  modified_base (573)..(573): a, c, t, g, unknown or other
  misc_feature (573)..(573): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggccaaccatcaactgcaagtccagccagagttgttttattcggacccccaacaaataaccaacttacttagtcttggtaccagacagaaagtaggacagtccctacctaaactcctagatttacgtgggccttccgtacccggctacgttcccggggttacctaaccgtnttcaagttcggccgtaggtccggggtactcggggtacctagtttcaccgtctaccaccatcaacgcacgtacctcgacgaggtcgtagtaagagtgtcggtacttagttattactgtacagacactattactacctttcttctctacgtttcgacggtagacgtaggtgagtactacgaaacgactgtagcncgtcacngtctctctctacg

SEQ ID NO: 65597 - DNA, 546 bp, Homo sapiens
  misc_feature: GYAE6OF02H26S4.31.78.H01.1.454.CMB.1.raw
  modified_base (533)..(533): a, c, t, g, unknown or other
  misc_feature (533)..(533): n is a, c, g, or t
  modified_base (543)..(543): a, c, t, g, unknown or other
  misc_feature (543)..(543): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttacgtgggtccttccgtacccgggctacgtccggggttacctaaccgacttcagttggcaggtcgggtctcgggaccgatttccactctcaccatcagcagcctgcagctagagatgtgctagtttacttactgtctagacaactattacttactttctttcgtacctacgtttcggcggtacggtacgaaggtggagactacgaaacgtactgtgctgcactntcgtgtcctntac

SEQ ID NO: 65598 - DNA, 846 bp, Homo sapiens
  misc_feature: GYAE6OF02I0LMJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcggtgatgagccagtttccagactccctggctgtgtctcgtgggcgaggacgggcccaccatcaacgtgacaagtccagccagtgttgttttagttcggcccctacaataacaactactagtcttaggtaccagacaagaagtagacagcctacctaactctagactttacgtggtcttccgtacccgggctacggttcccggggtttaccctaaccggtacttaccgtaacgttcggccgtaacgggtccggggtacgttacggggtaacccgttacgttttaccgaaccgttcccgtaccctaacccgtaaacgttacccgaacggtacccgtaaccgggtaccccgttagggacccgtaacgggtaccttaacggggtaaaacgtacggttacgggtacgggttaccgtttaacgggtttttaacgtttaaccggtttacgttacccgtaacggttaaccctaaacgttaacgttttaaccgttttaccgtttttacccgtttttaccggttaccgtttaaccggttttacccggggaacggggttaaaccgggtaaccgggttaaaggggttacgggtaacgtaacggttaaacccgtaaaaccgggttaccggttacgggtagggtacccttacggtaacccgttaaccgtacgtttccgttaccggtttacctttaccgtaccccgg

SEQ ID NO: 65599 - DNA, 731 bp, Homo sapiens
  misc_feature: GYAE6OF02ILZWM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgtttattcggccccacaataacaactacttagcttggaccagcaagaaagtaggacagcctacctaaactcctagtactttacgtcggtcttaccgtacccgggctacgttcccggggttacctaaccggtatttacgagtttcggcctaaggtccgggttacgtacggggacccgtacttttaccaacgttcctccaacctactaccgaaggcctaacgtcccgttaggaccgtacgggtactacggtaaacgtagttcggtacgggtacgttaacggttttaacgttaccgttacggttacccgtaaacgtacctaaaaccgttagttttaactttaacccttttaccgttttacgttaccgttacggtttaccggggtaccgggtaacggggttaaacccgtaaggggttacggaacgtaacgtaaccgaaacggtaaccttgggtacggtaccttacggacctaccgtacttaccgtcgtttacctattacccg

SEQ ID NO: 65600 - DNA, 785 bp, Homo sapiens
  misc_feature: GYAE6OF02HAAG1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataaccaactacttagcttaggaccagcaagaaagtacggacacgcccttacctaaactccgtagtactttaccgtggggtcctttaccgtacccggggactacggttcccggggtttaccctaaaccggtactttcaagtttcgggaccgtacggtccggggttaccgtacgggggtaacccctattttacccgacctttcccgtaacctaacccgtaacgttaccgaacggtcccgtaaccggtacccgtacggtaccgtaacgggtaccgttaacgggaaagtagttacgggttacgggtaccgttaaggttttaactttaccgttcggttaccgaacggtacctaaacgttactttaacgttttaccttttaccgttttaccgttaccgtttaccggtttttaccggggaaccggggttaaccgggtaaccgttaacggggtacggtaacggtaacgtaaccgtaaaacggtacgttacgggtcggttacgtcgtacctacgtacttccgttacgttaccttacctaccg

SEQ ID NO: 65601 - DNA, 621 bp, Homo sapiens
  misc_feature: GYAE6OF02FHALE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgtttttattcgggccccaccaataaccaactacttagcttggacctagcagaaagtaggacagccctacctaaactcctagtatttactgggtcttcgtaccccggggctacgttcccgggggttacctaaccggtattcctatttcgggcctacggtccggggttcgttcggggacccgtattttccgaccttctccacctatcagcagcctgcaggctagaagatggtggctagtttatacgtcgtcagtcaactatttaacttactttcctttcgttacctacgtttcgggaacggtacgggtaccgaagggttcggagtacgtacgaaacggtacgttaggtcggtactcgacctaccgtagtaccgttcggttaccttactaccg

SEQ ID NO: 65602 - DNA, 662 bp, Homo sapiens
  misc_feature: GYAE6OF02GLFQE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatcaactgcaagtccagccagtagttgttttattcggaccccaacaataacaactacttagcttaggtaccagcaagaaagtaggacacgcctacctaaactcctagtactttacgtgggtccttaccggtacccgggctacggttcccggggttaccctaaccggtattccgtagttcggactacgggtccgggtcgtaggggacccgtatttccacttcctaccacctatccacgccacgtcctgcgaggctaggaagtgtggtacgtacgttaagtttactacgttgtacaacgtactaaacttagtttaacttacctttccgtttacgttaccgttacggtttaccgggacggtaacgggtaaccgtaagggtggtaacgtagtaaccgtaaacgtacgtggtacggtcgtacgactaccgtaagttccgttagttccttacgtaccg

SEQ ID NO: 65603 - DNA, 780 bp, Homo sapiens
  misc_feature: GYAE6OF02JPCAZ.31.78.H01.1.454.CMB.1.raw
  modified_base (347)..(347): a, c, t, g, unknown or other
  misc_feature (347)..(347): n is a, c, g, or t
  modified_base (400)..(400): a, c, t, g, unknown or other
  misc_feature (400)..(400): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatggacgcctagttccagacctcccgtggctgtcgtctcgtgggcgaggacgggcccaccatacaactgacaacgtccagccgagtagttgttttacgtccgacccaacaactaacaacttactagtcgttacggtaaccagacgaagtaaagtacgacacgtcctaactaaactcctagtactttaccgngggtaccttaccggtacccggtctacggttaccccgggttacctaaaccggtnttaccgtacgttacgggacctacggggtccgggtttacggtacggggtacccttatttacccgaaccgtttcccgtaacctaaccctaacgttaccaaaggtcccgtaacgtcccgttacggacgtaaccggtcgttacggaaaggttacgttacgggtacgtacttaaacggttttaacttacggttaacgtaccgtaacgaaccgtaaacgtttacgtttaacttacccgttttacgtttaccgttaacgttacccgggtttacgggaccgggtaaacgggtaacccgtaagggtaggtactaacgttaaccgaaacggttacctgggtaaccgttcgtaccgtaacgtaccctagttcttcgttacgttacctaccg

SEQ ID NO: 65604 - DNA, 708 bp, Homo sapiens
  misc_feature: GYAE6OF02GQRCK.31.78.H01.1.454.CMB.1.raw
  modified_base (262)..(262): a, c, t, g, unknown or other
  misc_feature (262)..(262): n is a, c, g, or t
  modified_base (373)..(373): a, c, t, g, unknown or other
  misc_feature (373)..(373): n is a, c, g, or t
  modified_base (470)..(470): a, c, t, g, unknown or other
  misc_feature (470)..(470): n is a, c, g, or t
tcagcagtagacgtcacgaccggtgctcgatttagtgtgagtagtttgggtttgggggagcgtacaacaggcaggcaggggcagcaagatggtgttgcagacccaggtcttcatttctctgttgctctggatctctggtgcctacggggacagttcgtgatgagcctagtttccagctccctggctgtgtctcgtgggcgagagggccaccgatcaactgcaagtcccaagccagtacgttagtttttatccggcccccaanaaactaaacctaacttaacttaggactttacgggaacctaacgcaaaggaaagttaggacaggcccttactaaactcctagtaactttacgtcggctttcgaaccccgggntaacggttccccgggttcctaaacccggtatttccgtaattcggacacgggtcggtcgttacgggtaaccgtagttttacaccttacgcctaaaccncgttacgacgtcgacgtctcgacgtacgtcgtaggaagtacgtgtcggtacttagttactacgttacgtacaacgtactaaacgttagttacttaccgtttcgttaccgttaccgtaccggtttcgggaccgtaaaggtaaccgtaagggtacggtaacgtaacgtaaccgaaacggttacgttacggtacgtaccgtacgaccgttaacgtacgttacgtacgttaccttacctacg

SEQ ID NO: 65605 - DNA, 587 bp, Homo sapiens
  misc_feature: GYAE6OF02HOEL0.31.78.H01.1.454.CMB.1.raw
  modified_base (437)..(437): a, c, t, g, unknown or other
  misc_feature (437)..(437): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaaataacaactactagcttggtaccagcagaaagtaggacagcctacctaaactcctagatttactgggccttcgtaccccgggctaacgttcccggggttacctaaccgattccagttcggctaggcgggtctggggaccgtatttcactctacaccatcagcagcctgcaggctagaagatggtgtntagtttattacgtgtacagacaactattacttactttctttcgttctacgtttcgggacggtaggtaccgaagggtggacgtagtaaccgaaacggtacgttggtacggtctacggcctaaccgtacttacgttacggttacttactacg

SEQ ID NO: 65606 - DNA, 609 bp, Homo sapiens
  misc_feature: GYAE6OF02IYUSQ.31.78.H01.1.454.CMB.1.raw
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
  modified_base (487)..(487): a, c, t, g, unknown or other
  misc_feature (487)..(487): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggcccaccatcaactgacaagtccagccagtagttgttttattcggccccacaataacaactacttagcttcgtaccagacaagaaagtagacagcctacctaaactcctgactttacgtcggtcttccgtacccggctacgttcccgggttaccctaacgtattacagttcggcgaggccgggtcgtcgggaccgtatttccgactactccacctatccgagcacgccncgcaggctaggaagngtaggtgacttaagtttacttactcgacagacaaactnttaactctttactttacgtacttacgtttcgggacggtaacggtaccgaagggtgacgtagtaacgaaacgtacgtacggtcgacgtacgtaccaccgtagttaccgtcgttacttctaccg

SEQ ID NO: 65607 - DNA, 697 bp, Homo sapiens
  misc_feature: GYAE6OF02JN850.31.78.H01.1.454.CMB.1.raw
  modified_base (329)..(329): a, c, t, g, unknown or other
  misc_feature (329)..(329): n is a, c, g, or t
  modified_base (376)..(376): a, c, t, g, unknown or other
  misc_feature (376)..(376): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagactccctggctgtgtctctgggcgagagggcccaccatcaactgcaagtccagccagtagttgtttttattcggcccccactaaataaccaacttactagcttggtacccagacagaaagtaggacaagcctacctaaactcctagtactttacgngggtccttcgtacccgggctacgtccggggtttaccctaaaccggtnttaccgatttcggactaggtcgggtcgttacgggaccctattttccacgtcttccaaccgatcgacgcacgtccctgcaggtctagaagtgtcgtggtacttaggtttacttacgttgtaccgtaagtacctaagttaactttagttaccttttccgtttcgtacccgttaccgttttaccgggccgggtaaacgggtaaccgtaagggtttcggaagtaaccgttaccgaaaaaccggttaccgttacgggttacggtaccgttaggtacccccgtaaacgttaccgttacccgggttacgtttcccgttaacttcccgg

SEQ ID NO: 65608 - DNA, 641 bp, Homo sapiens
  misc_feature: GYAE6OF02FJBJV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctagtatttacgcgggtcttaccgtacccgggcacggttcccggggttacctaaccgtattctagttcggcaggcgggttcgtacgggacctatttcactctacaccatcacgcacgctcgcgacggcgtagaaccccgtagtcggtggtacgtagtttacttacgttcgtacgtacgactaactaacttacttacctttcgttttcgttaccgttaccgtttacgggtacgggtacggtaaccggtaacggtaggtacgtacgtaacgtaaacggtaacgttacggtcggtacgtacgtaccgtaccgtaccgttacgttcgttccttactaccg

SEQ ID NO: 65609 - DNA, 676 bp, Homo sapiens
  misc_feature: GYAE6OF02H0VQ8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacgggccaccatcaactgacaagtccagccagtagttgttttacttcggacccccaacaaataacaaccttacttaagtcttacggtaaccagacaagtaaacgtaggaacacgtaccctaccgttaaactcctagtactttacgcggtccttccgtacccgggctacggttcccggggttacctaaccgtacttcgagttcggcgtaggtcggtcgtcggggtacctatttccgacttctacacctatacgacgtccacgtcctagcgaggctagaaagtgtaggtcgacttaagtttacgtacgtgtacgaacgactaaacttagtttacttaccgttttactttaccgtacttaccggtttacgggaccgggtaacggtaaccgtaaggggttcgaacggttaactaacggtaaaccgtacgttgggtacgtcgtacgaccgtacgtacttcgtacgttccttacgtaccg

SEQ ID NO: 65610 - DNA, 542 bp, Homo sapiens
  misc_feature: GYAE6OF02FLM2I.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcaagaaagtaggacagcctactaaactcctagatttactgggtccttcgtacccgggcagttcccggggttcctaaccgtattcgatttggcaggcgggtctgggacctatttcactctcaccatcagcagcctgcgaggctagaagagtggtgactagtttattactgtcagtcaactattatacttctttacgtctacgtttcggacggagggacctaagggtgagatacgaaacgcgttacggtgctgctacatctcgtctctac

SEQ ID NO: 65611 - DNA, 622 bp, Homo sapiens
  misc_feature: GYAE6OF02I6VEP.31.78.H01.1.454.CMB.1.raw
  modified_base (235)..(235): a, c, t, g, unknown or other
  misc_feature (235)..(235): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggattctctggtgcctacggggacatcgtgatgagccagtttccagactccctggctgtgtctcgtggcgagagggccaccatcaactgcaagtccagccagtagttnttttattcggcccacaataacaactacttagcttggtaccagcaagaaagtaggacagccctacctaaacttcctgtagtttacgtgggtccttccgtacccgggctacgttcccggggttcctaaccggattcagttcggcaggtcgggtcgtacggggaccgtattttccgaccgttcctacaccctatccgaacgctaccgccttcggcgacggtcctaggaaagtagtcggtgacgttagtttaactttcgtagtactagactaactagtttacttacctttctttcgtcttaccgttcgtcgggacggtacgagggtggtagtactaaccgaaacggtactggttcgacgtagccaccgtagttcgtacttccgtactaccg

SEQ ID NO: 65612 - DNA, 631 bp, Homo sapiens
  misc_feature: GYAE6OF02FOBXJ.31.78.H01.1.454.CMB.1.raw
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (458)..(458): a, c, t, g, unknown or other
  misc_feature (458)..(458): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccctacggggacatcgtgatgagccagtttccagacctccctggctgtgtctcgtgggcgagagggcccacatcaactgcaagtccagccagagttgtttttattcggacccccaccaataaccaactactagtcttaggtaccancaagaaagtaggacagccctactaactcctntatttactgggcttccgtacccgggcacgttacccggggttccctaaccgtattccgtagttcggacgaggtccgggtcgtacggggtacccgtagtttaccactctacaccatccagcacgcctgccaggctagatagtgnggtctaggtttatacgtgtcacgactaacgtattactactttcgtttccgttaccttacgtttccgggacgggtacgggtaccgtaagggttcgggaacgtacgtaaccggaaacgtacggtacggtacggtcctaggaccctaccgtaacttcgtacttcccttactacccg

SEQ ID NO: 65613 - DNA, 547 bp, Homo sapiens
  misc_feature: GYAE6OF02IND81.31.78.H01.1.454.CMB.1.raw
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgtatttactgggcttccgtacccgggctacgtcccggggttcctaaccgatttcattcggctaggcgggtctcgggaccgtatttcactctcaccatcagcagcctgcaggctagaagntgtgctaagtttatactgtacagacaaatntttaatacctttctttacgtctacgtttcggcggaacggacctagggtgagataccgaaacgtaactggtagctgctacatctgttctctac

SEQ ID NO: 65614 - DNA, 577 bp, Homo sapiens
  misc_feature: GYAE6OF02G7HEZ.31.78.H01.1.454.CMB.1.raw
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgcaagtccagccagagttgttttattcggacccccaaccaaataacaactacttagcttggtaccagcaagaaagtaggacagcctacctaaactcctgactttacgngggcttccgacccgggcacgttccgggttcctaaccgnttcattcggcaggcggtctgggacctatttcnctcncaccatcagccacgcctgccaggtctagaagagtgtcggctagtttattactgtcagcaatattactactttctttctctacgtttcgggacggtacggaaccgtaaggtcggagtactaacgaaacgtaacgttggtagtcctacggacctaccgtacgttccttgttccttactaccg

SEQ ID NO: 65615 - DNA, 730 bp, Homo sapiens
  misc_feature: GYAE6OF02GYNA4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggcccacatcaactgcaagtccagccagagttgttttattcggccccacaataacaactacttagcttggtaccagcaagaaagtaggacagcctacctaaactcctagtatttacgtgggctttccgacccgggctaacgttcccggggttacctaaccgactttaccgactttcggacgtacggtccggggttacttcgggggaacccgttacttttaccgaccttcccttaccgaacccctagttccgaagtcccgagtccccgttaggccgtaagggccgttaaggaaaggtacgttgggtaccggacttaaggttttaactttacgtcgtacaacgacctaaacgttactttaactttacctttaccgtttttccgtaccttaacgttttccgggggacgggtaaaccggtaccgtaaggggttacggacgtaacggtaaccgtaaaacgggtacgttacgggtccgggtacgtccggtacctaaccggttacgttaccggtttcgttaccgttacttaccccg

SEQ ID NO: 65616 - DNA, 650 bp, Homo sapiens
  misc_feature: GYAE6OF02GX36P.31.78.H01.1.454.CMB.1.raw
  modified_base (486)..(486): a, c, t, g, unknown or other
  misc_feature (486)..(486): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggccccacaataacaactacttagcttggtaccagcagaaagtaggacagcctacctaaactcctgtactttactgggtccttccgtaccccggggcacgttcccggggttaccctaacccgattccgatttcggcgtacggcgggtccgtcggggacccgtagtttcctactcctacaccctatccagccagccctgccgaggtctagaagattggtcggtacgttaagtttacttaacgttntaccgacgtacctaactatttattacctttaccgtttcctcgttacgtttccgggacggtacgggaaccgtaagggtagtacgtaactaaccgaaaacggtaaccttgggtacggtaccgtagacccgtaacctagttcccgtacgtttcccttacgtaacccg

SEQ ID NO: 65617 - DNA, 603 bp, Homo sapiens
  misc_feature: GYAE6OF02I7ZKA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattggccccacaataacaactactagcttgtaccagcagaaagtaggacagccctactaaacctcctagtactttacgtcgggtcttaccgtaccccgggctacgttcccggggttacctaacccgtattctaattggccgaggtcgggtcgtacgggaccgtatttcacttctacacctatacagcacgcctgcgagtctaggaacgagtggtcgacttagtttatactgcagacaactattattacttctttacgtcttaccgtttacgggcggtaacggtaccgaagggtcgagtaacgtacgtaaagtacgtaacgtggttacggtcgttacgaccgtacctattccgttcgttaccttacg

SEQ ID NO: 65618 - DNA, 618 bp, Homo sapiens
  misc_feature: GYAE6OF02JDJEM.31.78.H01.1.454.CMB.1.raw
  modified_base (360)..(360): a, c, t, g, unknown or other
  misc_feature (360)..(360): n is a, c, g, or t
  modified_base (612)..(612): a, c, t, g, unknown or other
  misc_feature (612)..(612): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagttgttttattcggccccaaccaataacaactacttagcttgtaccagcaagaaagtaggacagcctacctaaactcctagtatttacgtggtcttccgacccggctacgttcccgggttcctaaccggnttaccgagttggaccaggtccggggttactcggggacctagtttccaccttctacctaacccattccgagaccgtacgccctagccgaggtctagaaacgtgtcggtggtaccttaggttttaacttacgtgtacaggtaccaaacttattacttactttctttcgtacttacgttcggcgggtacggtacgaaggttcggatactacgaaacggtagtggtaggactggccaacgtctcgttagttacctntacccg

SEQ ID NO: 65619 - DNA, 712 bp, Homo sapiens
  misc_feature: GYAE6OF02GCDD9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagcctccctggctgtgtctcgtgggcgagcggccacatcaactgacaagtccagccaagtagttgttttattccggaccccaacaaataaccaacttacttagtcttaggaccagacaagtaaagtaggacagaccctacctaaacctcctagtaactttacgtcgggtacctttaccgtaccccgggctaacggttccccggggttacctaaaccgtattccgagttcggactacggtcgggtctagggacctatttcactctaccacctatccgagctacgcctgaccgaggtctaggaacgtagtcggtacggtacttaagtttacttaccgttgtacctaacgtacctaaacttactttaacgttaccctttcgttttaccgtacctttaccggtttccggggaccggtaaacgggtaaccgtaacggggtacggtaacgttaacgtaacccgtaaaacggtaccgtttagggtaccgtaccgttacggacccgttaaccgtacgttacgttacggtttaccttaccgttaacccg

SEQ ID NO: 65620 - DNA, 768 bp, Homo sapiens
  misc_feature: GYAE6OF02GR530.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcctggcttgtgtctcgtgggacgaggacgggccacatcaactgacaagtccagccaagtagttcgtttttagttcggacccccaactaaagtaaaccaacttaacttagtcgttacggtaaccagacaaggaaaacgtacggaacacgacccttaccttaaaacctcctagttactttacgtcgggtaccttccgtacccgggtactaacggttcccggggttacctaaccggtacttactacgttcggactagggtccgggttccggtaggggtaacccgtattttaccgacttcctaccgtaacctacgtacgacgtcgtacgtacccgtcggtaccgtacgggtcgtaacggaacgtaacgttcggtacggtaccgttaaaggttttacgttacgttcgtacgtagtacctaaacgttactttaacgtttaccgtttcgttttaccgttaccgttaccggtttacgggaccggttaaacgggtaacccgtaagggtacggtacgaccgttaaacgtaaaccggttaacgttaggttaccggtacgtaccgacgtaaccgtacttacgttcggttaccgttcgtaacccg

SEQ ID NO: 65621 - DNA, 693 bp, Homo sapiens
  misc_feature: GYAE6OF02HUQE4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgacaagtccagccagagttgttttattcggcccccaacaataaaccaactacttagcttggtaccagcagaaagtaggacagcctacctaaactctgtactttacgtggtcttcgtacccgggctaacgttcccggggttacctaaccggtattaccagttcggctacggtccgggtcgtcggggtaacccgtattttaccgacttcctaccaaccctagtacaacgacacgtcccgtggaccgacgggtccgttaggaaacgtcgtacgggttacggtacttaaggtttttacttaaccgttcgtacgtaacactaaacttaatttaacttacccgtttccttttaccgtcttaccgtttcgggacgggtaacggtaaccgtaaggggtacggagtaacgtaaccggaaaacgtaacgttacggtgggtacccgtacgaccctaacccgtattcccgttacgttcccttacgtaccg

SEQ ID NO: 65622 - DNA, 680 bp, Homo sapiens
  misc_feature: GYAE6OF02F2DSG.31.78.H01.1.454.CMB.1.raw
  modified_base (327)..(327): a, c, t, g, unknown or other
  misc_feature (327)..(327): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgccagtttccagacctccctggctgtgtctcgtgggcgaggacgggtcaccatcaactgacaagtccagccagtagttgttttattccggaccccaccaaataaccaactacttagcttgtaccagcaagaaagtagacagcctactaactcctagtatttacgnggcttccgtaccggctacgttccgggttacctaacgtattcacttggcgacggtccgggtcgtcggggtacctctttaccgacttcctaccacctatccagccacgcctgacgagtcagtaagagttggtacgtacttaagttttacgttacgttcgtacgacgtactaaacgttatttaacgttaccttttccgtttacccgttaccttaccgggttttaccggggtacgggaaacgggtaacccgtaagggtacgggtaataacgttaaccggaaaacgttaacggttcgggtacggtaccgtacgtacccaaccgttaccgttccgttacgtttacccttacgttacccg

SEQ ID NO: 65623 - DNA, 667 bp, Homo sapiens
  misc_feature: GYAE6OF02FY773.31.78.H01.1.454.CMB.1.raw
  modified_base (231)..(231): a, c, t, g, unknown or other
  misc_feature (231)..(231): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagngttgtttattcggcccacaataacactacttagcttggacagcaagaaagtaggacagcctactaaactcctagactttacgtgggcttcgtacccgggctaacgttcccggggttacctaaccggtattccgagtttcggacacggtccgggtctacgggggacctagttttaccacgttctaccaaccgtatccgagtacctacgtcccgtgaccgtacgggtctaggaaacgtacgttggtacgggacttacggttttaacttacgttcgtacgtacgtacctaaacgttaacgtttaattaaccgtttcgttttaccgtccttacgttttccgggcggtaacgggtaccgtaagggttggagtacgtaaccgaaacggtaactggtacggtccgtacgaccgtaccgtaacgttcgtcgttacttcgtaccg

SEQ ID NO: 65624 - DNA, 660 bp, Homo sapiens
  misc_feature: GYAE6OF02JRLW2.31.78.H01.1.454.CMB.1.raw
  modified_base (355)..(355): a, c, t, g, unknown or other
  misc_feature (355)..(355): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggccaccatcaactgccaacgtccagccagacgttgtttttactcggaccccctacaataaccaacttactagcttaggaccagcaaggaaacgtggacacgtccctacctaactctagtactttacgtgggtaccttcggtaccccgggtntacggttcccggggttaccaacccgtattctagttcggcacggtccggggtctaggggaccctatttccaccttcacctaaccgactcgacgtaccgacgtcctaggccctaggaccttaggaaacgtacgtgggttacggtactaggttttaacttacgtcgtacacggtactaacgttatttcttaccgtttcgtttaccgtaccttacggtttccgggacgggtacggtaccgtaagggtcgagtacgaacgtaaacgtacgttgtcggacgtgcccgtactactacgttcttcgtactacc

SEQ ID NO: 65625 - DNA, 791 bp, Homo sapiens
  misc_feature: GYAE6OF02JMZK7.31.78.H01.1.454.CMB.1.raw
  modified_base (356)..(356): a, c, t, g, unknown or other
  misc_feature (356)..(356): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtcctcgtgggcgaggacgggccaccatccaactgacaacgtcccagcccaggtagttgttttattccggcccccaactaaataacaaccttaacttagcctttcggtaacccaggtaccaaggaaaagtaggaccacgcccttacctaaacctcctagtactttacgngggtccttccgtaaccccgggtctaacgttccccgggggttaccctaaacccggttattcctaaggttccggaccgacggggtaccgggttccgtacggggtaacccgtattttaccgacctttcccgtacaccctagttccgaagaccgtaccgtccccgtggaccgtagggtacctaacggtaacggtacttacggggttacggacccgtttaaggtttttaacgttaccgttacggttaccgtaacgtaaacctaacggttaacttttaacttaccgttttaccttttacccggtaccttaaccggttttccgggaacgggtacggtaacccggtaagggtacggactaacggtaaccgtaaacggtacttcggggtacctaggtaccgtacctaaccggttaacttccggttacgttaccttacttacccg

SEQ ID NO: 65626 - DNA, 638 bp, Homo sapiens
  misc_feature: GYAE6OF02IVML1.31.78.H01.1.454.CMB.1.raw
  modified_base (307)..(307): a, c, t, g, unknown or other
  misc_feature (307)..(307): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctctggtgccgtacggggacatcgtgatgagcctagtttccagactccctggctgtgtctcgtgggcgagacgggccaccatcaactgacaagtccagccagtagttgttttacttcggaccccaacaactaacctaacttacttagcttacggtaccagcaagaaagtaggacngccctacctaaactcctagtatttacgtgggtccttccgtacccggctacgtcccgggttaccaccggtattcgagttcggctaggcgggtctcggggtacctagtttccacttctaccacgtactccgagctacgtcctacgcgtaggctagaagagtgtggtacttaggtttattacgtgttacacgtacaactatttaacttactttccttcgtaccttacggttcgggacggaagggtaccgtaaggggtacggagtacgtaacgtaaacggtaacgtgggtaacggcgttagacccgtaactaccgttcgtacgttcctacgtacc

SEQ ID NO: 65627 - DNA, 633 bp, Homo sapiens
  misc_feature: GYAE6OF02H576F.31.78.H01.1.454.CMB.1.raw
  modified_base (257)..(257): a, c, t, g, unknown or other
  misc_feature (257)..(257): n is a, c, g, or t
  modified_base (382)..(382): a, c, t, g, unknown or other
  misc_feature (382)..(382): n is a, c, g, or t
  modified_base (469)..(469): a, c, t, g, unknown or other
  misc_feature (469)..(469): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatccaactgacaagtccagccagagttgttttattcggacccccanaactaacaacttacttagcttggtaccagacaaggaaagtaggacacgcctaccctaaactcctagtacttacgtcggtccttccggacccgggtctacggttcccggggttaccctaaccggtnttccgtagttcggcctaggtcgggtctcggggaccttatttccaccttctaccacctatcacgcacgccgtcgcgaggcgtagaagngtaggtggtacttaagtttcgttactgcaagctaacttattactactttcttacgtcgtacgtttacgggcggtacggaccgtaaggtaggacgtactaacgaacgtacgtacgggtacgtacgtcggacctaccgtacgttcgttacgttaccttacgtaccc

SEQ ID NO: 65628 - DNA, 713 bp, Homo sapiens
  misc_feature: GYAE6OF02H988D.31.78.H01.1.454.CMB.1.raw
  modified_base (398)..(398): a, c, t, g, unknown or other
  misc_feature (398)..(398): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggcccaccatcaactgcaagtccagccagagttgttttacttcggacccccaataaactaacaaaccttacttagtacttacggtaccagactaaaggaaagtggaacacgtacctacccttaaacgtcctagtactttacgtcggtaccttccgtaacccgggctacggttaccccggggttacctaaccggtnttaccgtagttcggactacggggtcccgggttacgtacggggtacccgtattttcccgaccttcctacctacccgtaactccgaacggtacctacggtccctacggaccgtacggaccttaaggaaacgtagttcggtacggtacgttaactttaagttcgtgtaccagtactaacgttatttacctactttccgtttacgtaccgttacgtttccggacgggtaacggtaacgtagggtacgtagtacgtacgtaaaccggtactcgggtacggtcacggtaccctacgtacttcgtcttaccgttacctaccg

SEQ ID NO: 65629 - DNA, 617 bp, Homo sapiens
  misc_feature: GYAE6OF02FV0TX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactactagctggtaccagcagaaagtaggacagcctacctaaactcctgtatttactgggcttcgtacccgggcaatcccggggttcctaaccgtattcattggcagcgggtctgggaccgtatttcactctcaccatcagcagcctagcaggctagaacgatggtggctagtttaacttacgtagttccaagccaaatactttaatacctttacgtttccgttccgtacgttttccggggacggtaacggggaaccctaaggggttacgggacgtaacgtaacgtaaaaccggtaaaccgttgggttacggtacgtacggtaccaaccgtaagttaccctcggttacctttacctaacccg

SEQ ID NO: 65630 - DNA, 615 bp, Homo sapiens
  misc_feature: GYAE6OF02I7HSH.31.78.H01.1.454.CMB.1.raw
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
  modified_base (394)..(394): a, c, t, g, unknown or other
  misc_feature (394)..(394): n is a, c, g, or t
  modified_base (426)..(426): a, c, t, g, unknown or other
  misc_feature (426)..(426): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagaggccaccatcaactgcaagtccagccagagttgttttattcggccccacaataacaactacttagcttggtaccagcagaaagtaggacagacctacctaaactcctgtactttacgtgggccttcgtacccgggnacgttccgggttacctaaccgnttcattcggcaggcggtctcgggaccatttccacttcncgaccatcagcacgcctgccaggctagaaagnttcggtggtacttaagtttattacctgtaccatacctaataatttacttacttttccgtttacgtaccttacgtttaccgggacggtaacgggtaacctaaggggtggaagacgttaaacgaaacggtaaccgttaggtaccggtacttacggaccctacctagttaccttcggttaccctttgtaacc

SEQ ID NO: 65631 - DNA, 554 bp, Homo sapiens
  misc_feature: GYAE6OF02I9RO9.31.78.H01.1.454.CMB.1.raw
  modified_base (427)..(427): a, c, t, g, unknown or other
  misc_feature (427)..(427): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcgtacccgggcacgttcccggggttcctaaaccgtattcagtttggcaggccgggtctcgggaccgtatttcactctccacctatccagcacgcctgcaggctagaagntggtgctagtttattactgtcagctaatattatacttctttccgtctcgtttacgggcggacgggacctaagggtggagtactacgaaacggtaagtcgtgcctgactaccgatctcgtcttctacg

SEQ ID NO: 65632 - DNA, 691 bp, Homo sapiens
  misc_feature: GYAE6OF02HPILK.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtagtctctgggccgagacgggcccacatcaactgcaagtccagccagagttgttttattcggcccccaacaataaccaactactagcttggtaccagcaagaaagtaggaacacgcctacccgtaaaacttcctagtacttacgtcggtaccttcggtaccccggntacgtcccggggttacctaaccggtacttcgaagttcggccaggtccgggtacgtcgggaaccgtagttttccaacgtcctacaacccgtatacgacgtaccaacgtcccgtacgacgtacggacgttacgaagtagtcggtacgtacgtaagtttacgttaacgtcgtacgacgtacaaaccttagtttaacttacctttaccttacgttcgtaacgttttccgggacgggtaacggtaaccgtaagggttacggacgtaacgttaacggaaaccgttaacggttaccggtaggtaccgttcggaaccgtaaccgacgtttcctagtttcctacgttaccc

SEQ ID NO: 65633 - DNA, 804 bp, Homo sapiens
  misc_feature: GYAE6OF02GSLDM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagttgttttattcggccccacaataacaactactagcttggtaccagcagaaagtagacagcctactaaactctagtatttacgtgggcttccgtacccgggctacgttcccggggtttaccctaaaccggtactttctacgtttcgggacctaaggtccgggttacgttacgggggaaccccgtaattttccgaaccgttcctacccgtaaccctaagttccgaacggaccgtaacggtcccgtcggaccgtaacgggtcgtaacggaaagtaacgttcgggtacgggtaccgttaaggtttttaacgtttaaccgttacggttaccgaacgtaacctaaaccgttaacttttaaactttaaccgtttttaccgtttttacccgtttaaccgtttacccggtttttaccgggggaaccggggttaaaccggggaaacccgttaaacgggggttcgggaacgttaacggttaacccggtaaaaaaccgggttaaccggttacgggttacgggtaccgttaccggacccgtaacccgttacgttccgtttacgttacccgtttaccgttaaccccg

SEQ ID NO: 65634 - DNA, 602 bp, Homo sapiens
  misc_feature: GYAE6OF02IR4U8.31.78.H01.1.454.CMB.1.raw
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcagtccagccagagttgttttattcggcccccaacaactaacaactacttagcttaggtaccagcaggaaagtaggacagcctaccgtaaactcctagtactttacgtgggtccttaccgtacccgggctacgttcccggggttacctaaccgattacgagttcggcagcgggtctacgggacctatttcactactcaccatcagcacgcctgcaggctagaagntgnggctagtttactacgtgtcacgactaactattaacttactttctttacgtacttaccgtttcgggacggtaacgggtaaccgaaggtcggagtaacgttaccgaaacgttacggtaggtacggcgttgactaccgtattcgtacgttccttcgtacc

SEQ ID NO: 65635 - DNA, 731 bp, Homo sapiens
  misc_feature: GYAE6OF02G1I8U.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccgtggctgtgtctcgtggacgaggacggccaccatacactgactaacgtccacgaccaggtagtttagttttacgttccggaccccctaacctaaactaaacctaaccttaacgttacgtcgtttacggtaaccagacaaaggtaaaggtacggacacgtaccctaacctaactctagttacttacgtcggtaccttaccggtaccggactacggttcccgggttaccctaaccgttattcctagttcggacgtacgggtccgggtcgtacgggtacccgttacttccacttccctaaccgacctacgtccgacgccgacgtcccgtggaccgtacggacgtaaggaaagtcggttagggtacggtaagtttaacggttttacttacgtcgtaaccgaacgtaacctaattacgtttaatttacccgtttcgttactaccgttacggtttccgggacgggtaaacgtaacgtaagggtcggtaactcgtaaaccgtaaacgtgttacgggcgtcgtacgacccgtacttacgtccgttctttacctactacccg

SEQ ID NO: 65636 - DNA, 660 bp, Homo sapiens
  misc_feature: GYAE6OF02IKRBA.31.78.H01.1.454.CMB.1.raw
  modified_base (341)..(341): a, c, t, g, unknown or other
  misc_feature (341)..(341): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgcctacggggacatcgtgatgagccagtttccagactccctggctgtgtctcgtgggcgagacgggccaccatcaactgacaacgtccagccagtagttgttttattcggccccaacaataaaccaactacttagcttggtaccagcagaaagtaggacacgcctacctaaactcctgtatttactgggctttccgtacccggntacgttccgggttacctaacgtattcgattcgcgtaggcgggtctcgggacctatttccactccgtacaccatcgacgtcacgtccctagccgaggtccgtagaaagtatggtacggtaccttaaggttttaacgtttacgttggtaccaagtaccaaacttactttaacttaccttttctttacgtacctttaccggtttccgggacgggtaaacgggtaacgtaacgggtagggtaacgtaacgtaacgtaaacggtaccgttaggtacggtccttacgaccgtaacctaacgttccgttcggttacttccgtaccc

SEQ ID NO: 65637 - DNA, 906 bp, Homo sapiens
  misc_feature: GYAE6OF02HYWIQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctcgtgggcgagacgggccaccatcaactgacaagtccagccagagtgttttacttcgccccacaataacaacctacttagcttaggtaccagacaagaaagtaggacacgcctacctaaacgtcctagatttacgtcggctttacgtacccgggctacgtcccggggttacaacccgtattcaacgtttggaccgtacggtcggggttacctagggggaacccgtagttttaccgacttaccgttacccgaaccccgtaaagttaccggaacgtaccgtaaccggtaccccgttagggtaaccccgtaaacgggggtacccgtttaaaggggaaaaacgtaacggtttacggggtttaacccggggtaacgtttaaacgggttttttaaaaccgttttaacccggttaaggttaccccgtaaagggtaaccctaaaagtttaaacctttttaaaccgtttaaccgtttttacccgttttttaacccggttaaccgtttaaaccgggttttttaccccgggggaaaccggggttaaaaccgggggttaaacccgttaaaacggggggtttacgggtaaaacgggttaaccgttaaacccggtaaaaaaccgggttaaccggtttaacggggttccgggttaaacccgttcgggtaaccccgtaaccgttaaaccgttaaccccgggtttaacgttttacccggtttaccttaaaccccgg

SEQ ID NO: 65638 - DNA, 698 bp, Homo sapiens
  misc_feature: GYAE6OF02I59PA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaaccatcaactgcaagtccagccagagttgttttattcggccccaaccaataacaactacttagcttggtaccagcaagaaagtaggacagcctacctaaactcctagatttacgtgggccttccgtacccgggcaacgttcccgggggttaccttaaccgtactttccaagtttcggctaacggtccggggtccgtacggggtaccggtattttccaaccttctacccgaaccctataccgagacacggtccctcggacgtacgggtcctaggaaacggtagttcggtacgggaccgttaggtttttaacgtttaactcgtttacgaaggtaccaaacgtaatttacttaccttttcctttacgttaccttaaccgttttccgggacgggtaccgggtaaacgtaaggggttcgggaacgtacgtaaccgaaacggttaacgtacggtcggacgttacgaccgtaccgtatccgtagttccgttactaccg

SEQ ID NO: 65639 - DNA, 688 bp, Homo sapiens
  misc_feature: GYAE6OF02GTXN8.31.78.H01.1.454.CMB.1.raw
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaagtccagccagtagttgttttagttccggaccccaactaaataaactaactacttagcttacggaccagacaagaaagtggacacgcctactaaactctagtactttacgnggtccttaccgacccggntacggttcccgggttaccaaccgtattcacgtttcggacgacgggtccgggttcgtacggggacccttatttccgaaccttcctaccgaaccctatccgaacgtcctacgtcccgtaggccgaggtacgtaggaagtacgttgggtacggactttaagtttaacgttcttacggtaccaagtaacctaaacgttattaacgtttaccctttcgttttaccgtaccgtttaccgggtttccgggacgggtaacggaaccgtaagggtgggaactaacgtaaccgaaacggtacgtggtcgtcgacgacccgtacctagtccttcgtaccgttcgtaccg

SEQ ID NO: 65640 - DNA, 724 bp, Homo sapiens
  misc_feature: GYAE6OF02GOT3J.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttggctctggatctctggtgcctagggacatcgtgatgagccagttccagactcccgtggctgtgtctcgtgggacgaggacgggccaccgatcaaacctgctaacgtccagccagagttgttttattcggccccaacgaataaccaacttacgttagtcgttaggtaccagacaagaaagtacggacacgtccctactaaactcctagactttacgtgggccttccgtaacccgggctaacggttacccggggtttacctaaaccggtattaccgagtttcggacgtaacgggtccgggttactacgggggaacccgttacgtttttaccacctttccgtaccctaacctattaccgaagccgtacggtacccgtcggaccggtacgggtaccgttaacggaagtacgttacggtacggtacttaacggttttaactacgttagtccgtaacgactaaactaactttaactaccttttacgtttaccgtaccttaccggtttacgggtacggtaaccgggtaacgtaagggtacgtagtacctaacgaaaacgtacggtaggtcgtacgtcggactaccgtatcgtacgttcctacgttaccc

SEQ ID NO: 65641 - DNA, 677 bp, Homo sapiens
  misc_feature: GYAE6OF02IUN8A.31.78.H01.1.454.CMB.1.raw
  modified_base (412)..(412): a, c, t, g, unknown or other
  misc_feature (412)..(412): n is a, c, g, or t
  modified_base (440)..(440): a, c, t, g, unknown or other
  misc_feature (440)..(440): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtggcgaggacgggccaccatcaactgcaacgtccaagccagtagttgttttacttcggaccccaacctaaataactaactacttagcttacggtaaccagacaaggaaagtaggaacaggacccttacctaaacctcctagtacttacgtgggactttccgaccgggctacgttcccggggttacctaacgtattcagtggacaggcggtcgtggaccgtnttcactctcacactcagcacgctcgacnggacgtagaagtagtcggtacggtacttaggttttaactaccttggtaccaacgaacctaaactatttaaacgttaaccttttccgtttacgtaccctttacggtttaccgggggtacggaaacgggtaaccgtaaagggtcgggtaacggttaacctaacggtaaaaccggttaaacggtcgggtacggtaaccgtgaaccctaacgtcgttaccgtacgtttcctaccttacccg

SEQ ID NO: 65642 - DNA, 647 bp, Homo sapiens
  misc_feature: GYAE6OF02GCWP6.31.78.H01.1.454.CMB.1.raw
  modified_base (211)..(211): a, c, t, g, unknown or other
  misc_feature (211)..(211): n is a, c, g, or t
  modified_base (404)..(404): a, c, t, g, unknown or other
  misc_feature (404)..(404): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagtttccagactcctggctgtcgtctcgtggcaggacggccaccntcaactgacaagtccaggccaagtgttgttttatcggacccacgaataaccactacttagcttaggtaccagctaaagtaaagtaggaccagtccctacgtaaactctgtactttacgcgggtctaccgtaccggctaacggtccgggttaccaactgttcacgttcgactacggtcggtctagggacccttntttcacgtcacgaccgtatcgaacgcacgcctgacgtgntcggtaaancgtcggnggtaacttgtttaacgtcgtacgttacgacgtacgaactagtttacttaacgtttcgtttccgttactaaccgggttttcggaaccggtacgggaaccttagggcgttaacgacgtaaccgtaaggtaaccgttggtcgggtacctacgtacccaacgttgttacccttggttaccttacggttaccc

SEQ ID NO: 65643 - DNA, 656 bp, Homo sapiens
  misc_feature: GYAE6OF02H7K9V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagctagtttccagacctccctggatgtgtctcgtgggcgaggacgggccaccatacaactgactaacgtccaggccaaggtagttgtttttacttcggaccccacaaataacaacttaacttagcttaggtaccagacaagaaagtagacagtacctacctaaactcctagtattacgtggtactcgtacccggactacggtccgggttacctaacgtcttacacgttacggacctacggtcgggtaccgtacgggtacccgtacgtttacacctctaccacctatccgaacgtcacgtcctagccgtaggctaacggatagtggtagacttagtttacttactgtacagtactaattactttacttactttcgttcgtacgttcgttcgggaacggacggtaaccgtaggtcgtaagtacgtaacgaaacggttacgtacgggtgtaccttacggaccttacctaaccgttcgttacggttccttactacccgg

SEQ ID NO: 65644 - DNA, 845 bp, Homo sapiens
  misc_feature: GYAE6OF02JP6CQ.31.78.H01.1.454.CMB.1.raw
  modified_base (208)..(208): a, c, t, g, unknown or other
  misc_feature (208)..(208): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtggcgagagggccaccntcaactgctaagtccagccagagttgttttattcggcccccacaataacaacgttctagcttaggtaccaggcaagaaagtacggacagtccctacctaaacctccttaggtaacttttaccgtggggtaccctttaccggtaccccgggggactaaccgggtttccccgggggtttaaccccttaaaccccggtatttcctaaacggtttcggaccgtaaacggggtccgggggtttacctacggggggtaacccttaagtttttcccgaaaccgtttcccttaacccaacccgtaacgttcaaccggtccgaacgtaccccgttggtaccggaacggtaccgtttaagggaaaacgtgttacgggttcgggtaacctttaaagggtttttaacctttaaccggttcgttaacccgtaaggaaccctttaaacgttaaccgttttacgtttaaacccttttcccgtttttcggtaacccgtttaaccggtttttccggggaaccgggtaaagggttaacccgtaaaggggttccggtaagttaccgtaaccgttaaaaaccgggtaattcgggtaccggtaccgttacggacccaacccgtttaagttcccgttacggtttttccaagtttccccg

SEQ ID NO: 65645 - DNA, 729 bp, Homo sapiens
  misc_feature: GYAE6OF02F9ORL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagtgttttattcggccccacaataacaactacttagcttggtaccagcaagaaagtaggacagcctacctaaactcctagtactttacgtgggtcctttccgtaccccggggctacgttccccgggggtttaccctaaacccggtatttccgtaacgtttcggaccgtaacggggtccggggttcgttacgggggtaccccgtaagtttttccaaccgttccttacccaacccgtattccgaacgccacggtcccttggaccgaacgggtcctaaggaaacgtgttgggtacggtacttaaggtttttacttaccgttgtaccgaagtacctaaacgttatttaacttaccttttcgttttccgttaccgttaccgtttccggggaccggtaacgggtaaccgtaagggtcggtacgtaacgtaccgtaaaacggtacgttaggtcgggtaccttacggaccctaccgttacgttccgttcgtttaccttaccgttaccg

SEQ ID NO: 65646 - DNA, 753 bp, Homo sapiens
  misc_feature: GYAE6OF02HE8RR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgtttattcggcccacaataacaactactagcttggaccagacagaaagtaggacagccctacctaaactcctagactttacgtgggccttccgtacccggggctacgttcccggggttaccctaaccggacttcaagtttcggacgaggtcggggtctaggggtaacccgtattttaccgaaccttccgtacctaacccactaccgaacgccacgtacccgtcggtaccaacggggtcccttaagggaaacgtaacggttcgggtacggtacccgttaaggtttttaaacttaccgttaggtaccgtaacgtaacctaaaccttaattttaacgttaacccgtttaccgtttttaccgttaccgttaccggttttaccggggtacggggtaaacgggtaacccgtaaggggttaccgggaagttaaccgttaaccggtaaaaaccggtacgttcgggtaaccggtaccgtacgtacccggtaacccctaatttcccgtacggtttacctaccgttacccg

SEQ ID NO: 65647 - DNA, 526 bp, Homo sapiens
  misc_feature: GYAE6OF02FHYCU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgttttattcggccccacaataacaactactagcttgtaccagcagaaagtaggacagcctacctaaactcctgatttactgggcttcgtacccgggcagtcccggggttacctaaccgattcattggcagcgggtctgggacgatttcactctcaccatcagcagcctgcaggctgaagatgtgctagtttatactgtcagcaactattaatacttctttcgtactactttcggcggtaggacaagggtgagatacgaaacgtactaggtcggctagcaccattctcgtcttctac

SEQ ID NO: 65648 - DNA, 643 bp, Homo sapiens
  misc_feature: GYAE6OF02ITPU7.31.78.H01.1.454.CMB.1.raw
  modified_base (276)..(276): a, c, t, g, unknown or other
  misc_feature (276)..(276): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaacgtccagccaggagttgttttacgttcggccccaacaactaacaacttacgtancgttaggtaccagacagaagtaggacagcctacctaaactcctgtattacgtggcttccgacccgggtcacgttcccggggttacctaaccggattctacgtttcggacgtacgggtcgggtcgttacggggaacccgtagtttccaccttctacccgaccactacacgcacgccctgaccgacggtcgtagaagtagtggtacggacttaggttttaactacttgtacagtacctaaactatttacttactttcctttcgtacctacgtttcgggacgggacggtaaccgtaagggtcggagtagtaaccgaaacggtacgtcggaggtacgtcgtaaccactagtcctcggtttcttacgtaccg

SEQ ID NO: 65649 - DNA, 669 bp, Homo sapiens
  misc_feature: GYAE6OF02IPTME.31.78.H01.1.454.CMB.1.raw
  modified_base (474)..(474): a, c, t, g, unknown or other
  misc_feature (474)..(474): n is a, c, g, or t
tcagcagtagacgtcacgaccggtgctcgatttagtgtgagtagtttggggtttggggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatccaaactgcatcgtccagccgagtagttgttttactttcggacccccaacgtaaataaccaaacttacttagacctttggtaaccagacgaaagtaaaggtacggacacgccctaacctaaacctccgtagtactttacgtcggtccttaccgtacccgggctacggttaccccggggttaccctaaccgtacttctagttcggcgaggtccgggtcgtacgggtacctatttccgtactcctaccacctatccagtccncgacctacgcgacggctagaagtagtgtggtacgttaagttttacttacgtgtacacactaactacttattaccgtttcttacgtcttaccgttcgggacggtaagggtacccgtaagggtaggaacgtacgtaaacgtaaaccgtacgtcggtcggtaccgtcgtaccgtacctacgttacgttctacttaccg

SEQ ID NO: 65650 - DNA, 559 bp, Homo sapiens
  misc_feature: GYAE6OF02JD4JP.31.78.H01.1.454.CMB.1.raw
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
  modified_base (418)..(418): a, c, t, g, unknown or other
  misc_feature (418)..(418): n is a, c, g, or t
  modified_base (444)..(444): a, c, t, g, unknown or other
  misc_feature (444)..(444): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactactagcttggtaccagcaagaaagtagacagccctactaaactcctgtatttactgggcttccgacccgggnagtcccggggttcctaacgtnttcattggcaggcggtctgggactatttcacgtctcaccatcgagcagcctgcacggctaggaangtgtcgcttagtttactacttgtacngaaccactattacttactttctttcgtcctacgtttcgacgggacggacgtaagggtcgagtactaacggaactacgtcgtggctcggacctacattctacgttcgtacttaccg

SEQ ID NO: 65651 - DNA, 733 bp, Homo sapiens
  misc_feature: GYAE6OF02FP9S1.31.78.H01.1.454.CMB.1.raw
  modified_base (230)..(230): a, c, t, g, unknown or other
  misc_feature (230)..(230): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagngtgtttattcggccccacaataacaactacttagcttggtaccagcaagaaagtaggacagcctaccaaactcctgtactttacgtgggtcctttccgtacccgggcacgttcccggggttacctaaaccgattcagttcggcagggtcgggttcgtacggggaacccgtattttccgacttccgtaccaacccgtaactccgaacggtccacggtccctaggcccgaaggggtcctaggaaacggtacgttcggggtaggaccgtttaaggttttaacttaacgttggttaccgaaggtaccaaacgttaatttaacttaccttttaccgttttaccgttacgttaccggttttacggggaccgggtaaacgggtaacccgtaaaggggttaccgggtacggtaacgtaaccgtaaaaccgggtaaacgttcgggttaacgggtccgttaacggacccgttaacccgttagttacccgtttacggttaccttacccgttacc

SEQ ID NO: 65652 - DNA, 640 bp, Homo sapiens
  misc_feature: GYAE6OF02IJ7XS.31.78.H01.1.454.CMB.1.raw
  modified_base (482)..(482): a, c, t, g, unknown or other
  misc_feature (482)..(482): n is a, c, g, or t
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgcctacgggacatcgtgatgagccagtttccagactccctggctgtgtctcgtgggcgagacgggccaccatcaactgcaagtccagccagtagttgttttacttcggacccccaccaaattaacaacttacttagcttcggtaccagacaaggaaagtaggaacacgtaccctaccctaaaaccttcccgtagttactttaccgtgggtccttaccgtaccccgggctacggtcccgggtttacctaaacccggtatttcgatttcggaccgaggtccgggtcgtggaccgttatttccgacttccgtccactctacacgtcacgctggctaggactagaagtntggtaggtcttaagtttactactgtacacacgtaactnttaacttactttctttaccgtcttaccgttcggacgggtacggaaccgtaagggtcgtacgacgtaacgaacggtacgtcgtacggctacgacctacctacgtactcgttcctatacccg

SEQ ID NO: 65653 - DNA, 718 bp, Homo sapiens
  misc_feature: GYAE6OF02GEUV9.31.78.H01.1.454.CMB.1.raw
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgccgtacggggacatcgtgatgagccagtttccagcctccctggctgtgtctcgtgggcgagacgggccaccatcaactgcaacgtccaagccagagttgttttattcggaccccacaataacaactacttagcttggtacctagcagaagtaggacacgcctactaaactcctagtactttacgtgggtccttccgtacccgggctacgttcccggggttacctaaccggtactttcgacgtttcggaccgtaacgggtcgggttaccgtacgggggtaccgtaaggttttccaacgttcccttaccaccgtacttacccgaacgtcctaacgtccctacggccgtacgggtaccctaagggaacgtaacgtggtcgggtaccgttaaggttttaacttacgttagttcaacgtaccgaaacttacgttaactttacgtttccgtttacgtttaccgtacggttttccgggacggtaacggtaaccgtagggtacggtacgaaccgttaacgaaacggtaagttccgggtaggtcccgtagtacccacggttatccgtacgtttacctacggttaccc

SEQ ID NO: 65654 - DNA, 624 bp, Homo sapiens
  misc_feature: GYAE6OF02HDMTJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactacttagcttggtaccagcaagaaagtaggacagcctacctaaactcctgtatttacgtgggtaccttccgtacccgggctacgttcccggggttaccctaaaccggtattccgatttcggccaagggtccgggtctcgggggaccctatttccgactcctacacctataccagccagccctgaccgaggcctagaagtattggtacggacttaggttttactacgttgctaagactaactatttacttacctttctttcgtacttacgtttacgggaccggaggaccgtaagggtggacgtataacgaaacggaacgttggtacgaccttgacctacgtattccgttacgttcccgttataccg

SEQ ID NO: 65655 - DNA, 587 bp, Homo sapiens
  misc_feature: GYAE6OF02IJ8H7.31.78.H01.1.454.CMB.1.raw
  modified_base (433)..(433): a, c, t, g, unknown or other
  misc_feature (433)..(433): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaagtccagccagtagtgtttattggaccccacaataaccaatacttagcttaggaccagcaagaaagtaggacagcctacctaaacttcctgtaactttacgtgggtcttaccgtacccgggctacgtccggggttacctaaccgtattcattggctagcgggtctgggaccctatttcactctacaccatcacgacacgcctgcaggctagagngtgtggtactagtttatacgtagtacaacacaaatattattactttctttacgtctacgttacgggcggaacggtaccgaagggtggacgtataaccgtaaacgtaaccgtggtcggaccgtagcctaacctattcgtacgttccttactaccg

SEQ ID NO: 65656 - DNA, 766 bp, Homo sapiens
  misc_feature: GYAE6OF02GNN74.31.78.H01.1.454.CMB.1.raw
  modified_base (97)..(97): a, c, t, g, unknown or other
  misc_feature (97)..(97): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
tcagcagtagacgtcacgaccggtgctcgatttagtgtgagtagtttgggtttgggggagctacaacaggcaggcaggggcagcaagagtggtgttncgagacccaggttcttcatttctctgttgctctggatctcgtggtgcctacggggcatcgtgatgagcctagtttccagacctcccgtggcctgtcgtctccgtgggcgtagacgggcccaaccgatcaaccgtgctaacgtccacgcccgagtagttgttttatcggacccccaacaactaaccaactacgttagccgttggtaacccagtacaagtaaagtaggaccanccctactaaactccgtgaatttcgnggccttcgacccgggntacgtccgggttaccaacgtacttcgattggacaggtcgggtcgtacggggacccttaatttccgaaccgttcgacccaacccgtgtacccaacggtaccaccgtaccgtcggaccgtacggccgtaaggtaaacggtacgttacgggtacggtaccgttaagttttaacgtttaccgttacgtacgtaacgtaacctaacttaaacgtttacttaccgttttacccgtttacgttaccgttaccggttttaccgggaaccggttaacgggtaacccgtaaggggtacgggtaacgtaacgttaaccgaaaccggttaaaccgttagggttaccggaccgttacggtacccgttaaccgtacgtttacccgttacgtttacccgttacgttaacccg

SEQ ID NO: 65657 - DNA, 665 bp, Homo sapiens
  misc_feature: GYAE6OF02HTVXM.31.78.H01.1.454.CMB.1.raw
  modified_base (329)..(329): a, c, t, g, unknown or other
  misc_feature (329)..(329): n is a, c, g, or t
  modified_base (634)..(634): a, c, t, g, unknown or other
  misc_feature (634)..(634): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggagggccaccatcaactgcaagtccacgccagagttgttttacttcggccccaacaataaccaacttacttagcttggtaccagacaagaaagtaggacacgccctacctaaactcctgtactttacgngggtccttaccgtacccgggctacggttcccggggttacctaaccggtattcgtagttcggactacgggtcgggttcgtcggggacccgttatttcccgacttcctccaacctataccgagtccgacgccctggccgacgggtaccgtaggaagtacgttgggtacggtacttaggttttaacttcgtacggttacaacgactaactatttaacttacctttcgtttcgtcgttaccgtttcggggaccggaggaaccgtagggtaggacgttactaacggtaaaccgtaacgttggtcggtacngacccgactagttccttagtccttacgtacc

SEQ ID NO: 65658 - DNA, 672 bp, Homo sapiens
  misc_feature: GYAE6OF02JZELY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctctgggcgagagggccaccatcaactgacaagtccaagccagagttgttttacgttcggccccaacaaataaccaacttacttagacttggtacccagacaagaaagtacggacacgcccttacctaaactcctagtactttacgtgggccttaccgtacccgggctaacgttcccggggttacctaaccggtattacgtattcgggacctaggccgggttcgtacggggacccgttatttccgaccttcctaccacctagttcaacgccacgtctacgcgacggactacgaagtaacttggtacgggtattacggttttaattacccgtgtaccgagtaccgtaaccttagttacttaacctttccgtttaccgtacgttaaccgtttccgggaacgggtacggaaccgtaggtaggactacgtacgaaaccggtacgttcggacgtcttaggcctacctacttacgtcgtaccttctaccg

SEQ ID NO: 65659 - DNA, 573 bp, Homo sapiens
  misc_feature: GYAE6OF02F2N3V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaccaataacaactacttagcttggtaccagcagaaagtaggacagcctacctaaactcctgtatttacgtgggtcttacgtacccgggctacgtcccggggttcctaaaccggtattcgatttcggcaggcgggtctggggacctatttcactctcaccatcagcagcctgcgaggctagaagtatggtggctagtttattactgtcagaccaatattatactttctttcgtcttacgttccgggacggtacgggacctaagggtcggagtactacgaaaacgacgttggtacggctagccaacctagtctcgttcctacgtaccg

SEQ ID NO: 65660 - DNA, 682 bp, Homo sapiens
  misc_feature: GYAE6OF02JNDKL.31.78.H01.1.454.CMB.1.raw
  modified_base (386)..(386): a, c, t, g, unknown or other
  misc_feature (386)..(386): n is a, c, g, or t
tcagcagtagacgtcacgaccggtgctcgatttagtgtgagtagtttgggtttgggggtaggcgtacaacaggcaggcaggggcagcaagatggtgttgcagacccaggtcttcatttctctgttgctctggatctctggtgccgtacggggacatcgtgatgagccagtttccagactccctggctgtgtctcgtgggcgagagggccaccatcaactgcaacgtccagccagagttgttttattcggccccaacaataaacaactacttagcttggaaccagacaaggaaagtaggacacgtccctaccctaaaactcctagtaactttacgtgggtccttccgtaaccccggggctaacggttcccggggttacctaaaccgnttactagttcggcaggtcgggtcgttacggggaccgtatttcacttctacaacctatcgaacgcacgtcctacgcgacggtcgtagaacgtagtacggtcggtacgttaagtttactttacgtacgttcgaacgtacaacttaagttaacttacttttacgtttaccgttacttaccgttttaccgggtcgggtaaacgggtaacccgtaagggtacggacgtactacggtaaaacgtaacgttaggtacgggtactacggtaccaaccgtctaccgttcgttacgttacgtaccg

SEQ ID NO: 65661 - DNA, 526 bp, Homo sapiens
  misc_feature: GYAE6OF02FHSAX.31.78.H01.1.454.CMB.1.raw
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (327)..(327): a, c, t, g, unknown or other
  misc_feature (327)..(327): n is a, c, g, or t
  modified_base (403)..(403): a, c, t, g, unknown or other
  misc_feature (403)..(403): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgcctacgggacatcgtgatgagcccagtttcccagacctccctggcctgtgtctctgggcagacggccacatcaactgcaagtcccagccagagttgttttattcggccccctacaataaccaactacttagcttggaccagcagaaagtgacancctcaaactctgatttacnggcttctaccccgggnacgtcccggggttcctaaccggattccaattggcagtcgggtctgggaccatttccactctacaccatccagcacncctagcaggctagagatgtgctagttattactgtcagcaacattacacttctttctctactttgcgtaggaccaggtgagatacgaaaacgacctagtcgctaggtcacatctgtctntaacg

SEQ ID NO: 65662 - DNA, 747 bp, Homo sapiens
  misc_feature: GYAE6OF02IKLO5.31.78.H01.1.454.CMB.1.raw
  modified_base (345)..(345): a, c, t, g, unknown or other
  misc_feature (345)..(345): n is a, c, g, or t
  modified_base (480)..(480): a, c, t, g, unknown or other
  misc_feature (480)..(480): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgccagtttccagtactccctggctgtgtctcgtgggacgaggacgggcccaccagtcaacgtgacaagtccagccagtagttgttttattcggaccccaaccaataaaccaacttacgtagtcttacggtaccagacaaggaaaggtacggacacgacctacctaaactcctagtactttacgnggtaccttccgaaccccggtctaacggttcccggggttacccttaaaccggtattccgtaagtcggacctaacgggtcggggttacgtaccggggtaacctacgttttccaaaccttcctaacccaaccggttanaacctacggacccgaacgtcccgttacggaccggtacgggtacccttaggaaaacggtcggttaaggttacggggaacctttaagggtttaaacttaccggtacgttaacgaccgtactaaactactttaacttaccgtttaccgtttccgtaccgttacgtttacgggaaccggtacggtaaacggttaggtaggacgtaacgtaacgaaacggtagttacgaggtactcgtacctaacgtacgttccgtaatcgttaccgtaacc

SEQ ID NO: 65663 - DNA, 634 bp, Homo sapiens
  misc_feature: GYAE6OF02FKQ5X.31.78.H01.1.454.CMB.1.raw
  modified_base (317)..(317): a, c, t, g, unknown or other
  misc_feature (317)..(317): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccctacaataacaactacttagcttggtaccagcagaaagtaggacagcctacctaaactcctgtatttacngggtcttcgtacccgggctagtcccggggttacctaaccgtnttcattggcagcgggtctcgggacctatttcacttctcgaccatcagcagcctgcaggctagaagtatggtcgactagtttatacgtgttcgatacgaactattaacgtacctttcgtttaccgtacttaccgttttccggggacggaacggttaccgtaagggtgggtaacgacgttaaaccggtaaaaccggtaacgtttacgggttacgggtaccttacgggaccctaacccgttacgttaccgtttccggtttacctttaccgttaacccg

SEQ ID NO: 65664 - DNA, 538 bp, Homo sapiens
  misc_feature: GYAE6OF02F5OIE.31.78.H01.1.454.CMB.1.raw
  modified_base (139)..(139): a, c, t, g, unknown or other
  misc_feature (139)..(139): n is a, c, g, or t
  modified_base (231)..(231): a, c, t, g, unknown or other
  misc_feature (231)..(231): n is a, c, g, or t
  modified_base (399)..(399): a, c, t, g, unknown or other
  misc_feature (399)..(399): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtncctacggggacatcgtgatgagccagtttccagactccctggctgtgtctctgggcgagagggccacatcaactgcaagtccagccagagtnttttattcggccccacaataacaactacttagcttggtaccagcagaaagtaggacagcctcctaaactcctgatttactgggcttctacccgggcatcccggggttcctaaccgattcattggcagcgggtctgggaccatttcactctcaccatcagcagcctgcnggctgaagatgtggctagtttatactgtcagacaactatttatactttctttacgttctacgtttcggacgggtaggaccgaagggtgagtactacgaaacgaactggtggtctgccacgtatcgtcgttacttctacg

SEQ ID NO: 65665 - DNA, 590 bp, Homo sapiens
  misc_feature: GYAE6OF02JA1X1.31.78.H01.1.454.CMB.1.raw
  modified_base (457)..(457): a, c, t, g, unknown or other
  misc_feature (457)..(457): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgttttattcgaccccacaataacaactacttagcttggtaccagcagaaagtaggacagcctacctaaaactcctgatttaactgggcttctacccgggcacgtcccggggttcctaaccggtattcattcggcagcgggtctgggaccgtagtttcactctcaccatccagcagcctgcaggctagaagtatggtggactagtttacttactgtacagtacaactntttaactactttcttttacgtccttacgtttccgggtcggtaacggtaccgaaggtcggagtacgtacgtaaacggaacttggtacgtccgttagacctaacccgtaagttccgtcgttaccttacttacccg

SEQ ID NO: 65666 - DNA, 753 bp, Homo sapiens
  misc_feature: GYAE6OF02JMJMN.31.78.H01.1.454.CMB.1.raw
  modified_base (198)..(198): a, c, t, g, unknown or other
  misc_feature (198)..(198): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagactcccgtggctgtgtctcgtgggngagcgggccacatcaacgtcgactaagtccagccagtagttgttttactcggaccccactaataaccgtaactacttaagccttaggtaaccaggaccaaggtaaacgtaggaaccaggtacccttacctaaacctccgtagttactttaaccgcgggtacttacccggtacccgggctaacggttcccggggttaccctaaaccggtacttccgtaagttcggacgtaacgggtccggggtagtacggggtaacccgtagttttaccacgttaccgtacctacccgtagtccgtacgacctacggccgttacgaccgnggtacgtacggaaagtacgttggtacggttacttaagtttacgttaaccgttcgtacgtaaccgggtactaaacctttacgtttaactttaccgttttaccgttttaccgaacgtttaccgttttaccgggggccgtaaacggggttaaccgaacggggttctaaggcgtttaaccggaaacgtacgttgggacgtactaccgactaccgttagttccgtagttccgtacttaccg

SEQ ID NO: 65667 - DNA, 749 bp, Homo sapiens
  misc_feature: GYAE6OF02I7NY5.31.78.H01.1.454.CMB.1.raw
  modified_base (208)..(208): a, c, t, g, unknown or other
  misc_feature (208)..(208): n is a, c, g, or t
tcagcagtagacgtcacgaccggtgctcgatttagtgtgagtagtttgggtttgggggagctacaacaggcaggcaggggcagcaagatggtgttgcacgacccaggtcttcatttctctgttgctctggatctcgtggtgaccctacggggacatcgtagatgagcctagtttccagacctccctggctgtgtctcgtgggcgaggngggcccaaccataccaactgacaacgtccagaccagtagtttcgttttagttccggaccccctactaaataaccaacttacttagcttacggtaaccagacaaggaaagtacggaccacgccctacctaaacctcctagtactttacgtcgggtaccttcccggacccgggtactaccggtcccggggttaccctaaccgtacgttctaagtttcgggacacggtacgggttccgtacggggtacccttagttacctacgtaccctcaacccgttactccgtaacgccgtaccgccgtacggactaacggggtcgaggtaaaccgtgttagggtcgtactttaaggttttaacttaccgtcgttaaccgaactaccgtaaatactttacttaccgtttctttaccggttcttaccggtttacggaacgggtaccggtaaagggaccggtagggaacttaacggtaaccgtaaacgttaacggtcggttacggtaccgtagtaaccgaaccttagttaccgttccgttacgttaccttaccc

SEQ ID NO: 65668 - DNA, 743 bp, Homo sapiens
  misc_feature: GYAE6OF02IC4XA.31.78.H01.1.454.CMB.1.raw
  modified_base (327)..(327): a, c, t, g, unknown or other
  misc_feature (327)..(327): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctcgtgggcgaggacgggccaccatcaactcgacaacgtccagcccagtagttgttttacttcggacccctaaccaaattaacaacttacttaggctttacggtaccacgtcaagaagttacggacacgcctacctaaacnccgttgtaactttacctagggttccttaccgtaccccgggacttaacgtcccgggggtttaccctaaaccgggtactttaccgtacgtttacggccgtaacggtcgggggttacctacggggtaccgttaacttttccaaccgttcctaccaaccgtattccgaacgtcgaacggtcccttgaccgagggtcctagaaacgtcgttgacgggtacttacgtttaagttacgtacgtacgaacgtaccaaacgttactttattaccgtttacgtttcgtacctttaacggtttccggacgggtaacgggttaaccgtaagggtacggtactaacggtaccgtaaaacgggttacctacggttccggacgttacggactacccggtaattcccgttaagtttcccttacgttaacccg

SEQ ID NO: 65669 - DNA, 583 bp, Homo sapiens
  misc_feature: GYAE6OF02HCJPO.31.78.H01.1.454.CMB.1.raw
  modified_base (474)..(474): a, c, t, g, unknown or other
  misc_feature (474)..(474): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcaagaaagtaggacagcctacctaaactcctgactttacgtgggcctttccgtaccccggggctacgttcccgggggtttaccctaaacccggtatttccgaatttcggacctaggccggggttctgggggaacctattttccgaacttcctacaccatcagcagcctgcaggctagaagatggtgctagtttattacngtcagacaactatttatacctttctttacgtctacgtttcggcggtaggacctaagggtgagactacgaaacgtagtaggtgactgactaccagttcctgttctctacg

SEQ ID NO: 65670 - DNA, 773 bp, Homo sapiens
  misc_feature: GYAE6OF02HBELC.31.78.H01.1.454.CMB.1.raw
  modified_base (364)..(364): a, c, t, g, unknown or other
  misc_feature (364)..(364): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgcctagtttccagacctccctggctggtgtctcgtgggcgaggacgggccaccgatccaactgacaagtccagccagtagttgttttacttcggccccaactaaataaccaacttacttacgacgttacggtaaccagacctaagtaaaaggttacggacctaagccccttacccgtaaaacttcccgtagtaacttttacgngggtaccttccgtacccgggactacggttcccggggttacctaaccggatttccgaagtttcgggacctagggtccgggtacgtacggggtaacccgttattttaccgaccttccgtaccgaacctacgttccgacgtaccacggccttagaccgacggcttaagggaaagtacgttggtacggtaccgttaagtttacttacgtacgtacgaagttaccaaagttactttaacgtttaccctttcgttttacccgtaccgtttacggtttaccggggtaacggggaacggttaacccggtaagggggttcgtaacggtaacgtaacccggtaaaacggtcggttaacggccgggttacgacggtaccgtaaccgttacgttaccgttacggtttccttacctacccgg

SEQ ID NO: 65671 - DNA, 898 bp, Homo sapiens
  misc_feature: GYAE6OF02FZCGS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggccccaacaataacaactacttagcttggtaccagcagaaagtaggacagccctacctaaactcctagtactttacgtgggtccttaccgtacccgggctacgttccccgggggttacccttaaaacccggtattttaccgtaacgtttcgggaccgtaacggggtccgggggttaccgttacggggggaaccccgttaagttttttacccgaaaccgtttccctaacccgtaaccccgtaacgttacccaacgggtacccaacgggtccccctttagggaccccgtaacggggtacccgttaagggaaaaaccgggttaacgttacggggttacggggtaccctttaaagggtttttttaaccgttaaccgttacggtttaccgaacggtaaccctaaaaccgttaacttttaaacgtttacccttttttacccgttttacccgttacccgtttaacccgttttttacccgggggaaccgggttaaaccgggggtaacccgttaaaggggggttcggtaaacgtaacccgttaaaccgggttaaaaacccggttaaaccgtttcgggggttaaccggttacggtttaaccggacccgttaaacccggttaaccgtttaccggtttaacgggttttaccctttacgttaaccccg

SEQ ID NO: 65672 - DNA, 778 bp, Homo sapiens
  misc_feature: GYAE6OF02JKR76.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagacgttgttttacttcggccccaacaataacaacttactagcttaggtacagcaagaaagtaggacacgacctacctaaactcctagtacttacgtcggtcttaccgtacccgggctacgttcccggggttaccttaaaccggtatttaccgaacgtttcggaccgtaacgggtccggggttaccgttacgggggtaacccgtaacgttttaccaaccgtttccgttaccccgtaaaccctacgttacccgtaaagggtcccgtaaccggtacccgttacggaccgtaacggggtaccgtttaagggaaaacggtacgttcgggtacggtaccgttagttttaacgtttaccgtaggttaccgtacgtaaacctaagtaacgtttacgtttaccttttaccgtttccggttaccttaccggttttaccgggaaccgggtacgggtaaacccgtaagggttacggagtaaccgtaaccgtaaacggtaacgttcggtaacggtacctacggtacctaaccgtacgttaccgttcgtttccttacgtacccg

SEQ ID NO: 65673 - DNA, 657 bp, Homo sapiens
  misc_feature: GYAE6OF02IIPWF.31.78.H01.1.454.CMB.1.raw
  modified_base (187)..(187): a, c, t, g, unknown or other
  misc_feature (187)..(187): n is a, c, g, or t
  modified_base (485)..(485): a, c, t, g, unknown or other
  misc_feature (485)..(485): n is a, c, g, or t
  modified_base (619)..(619): a, c, t, g, unknown or other
  misc_feature (619)..(619): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggcctgtntctcgtgggcgaggacgggccaccatccaactgcaagtccagccagagttgttttagttcggaccccaacaaataacaactacttagcttacggtaccagacaagaaagtaggacagtaccctacctaaactcctagtactttacgtgggtcttaccgtacccgggctacgtcccggggttacctaaccggtatttcgagttcggcctaggtccggggtacgtcgggtaaccgtatttccgacttactccaaccactccgaacgcgtacgtccctagacgacggtacgtaggtaacgngtggtaggtacttaggtttaattacgtgtacgacgtactaacgtatttacttactttcttaccgttcttacgttcgggacggtacggaacgtaagggtggacgacgtaaccgaaacgtacgtcggtacggtacncggtacctacctacgttcctacgttccttacgtacccg

SEQ ID NO: 65674 - DNA, 760 bp, Homo sapiens
  misc_feature: GYAE6OF02JS0I2.31.78.H01.1.454.CMB.1.raw
  modified_base (162)..(162): a, c, t, g, unknown or other
  misc_feature (162)..(162): n is a, c, g, or t
  modified_base (354)..(354): a, c, t, g, unknown or other
  misc_feature (354)..(354): n is a, c, g, or t
tcagcagtagacgtcacgaccggtgctcgatttagtgtgagtagtttgggtttgggggtagctacaacaggcaggcaggggcagcaagatggtgttgcagacccaggtcttcatttctctgttgctctggatctctggtgcctacggggacatcgtgatganccagtttccagactccctggctgtgtctcgtgggcgagagggcccaccatcaactgcaagtccagccagagtttgttttattcggcccccaactaataaccaacttacttacgcttggtaccagcaagaaaaggtggacacgccctaccctaaatcctgtaactttacgtgggccttaccggtaccccgggntaacggtttccccgggggtttaccctaaaccggacttttacaacggttttcgggaccgttaacggggccgggggtttactacgggggggtaaccccttacgtttttcccaaccgtttccctaaccaacccgtacttacgaccggtacctacggacccgttcgaccgtacggggtacctaggaaacgtaacggttggttacgggtaccgttaagggtttttaacttaccgtgtttaacccgagttaccaacgttaattttaccgttaccttttaccgttttccgacctttacgtttaccgggcgggtaaaccgggtcggtaaagggtccggtagaaccgttaccaaaacggttcctaggttccggcgttacgcctaacccgtatccgtttagttccttaccgtaccc

SEQ ID NO: 65675 - DNA, 678 bp, Homo sapiens
  misc_feature: GYAE6OF02IBFCD.31.78.H01.1.454.CMB.1.raw
  modified_base (385)..(385): a, c, t, g, unknown or other
  misc_feature (385)..(385): n is a, c, g, or t
  modified_base (482)..(482): a, c, t, g, unknown or other
  misc_feature (482)..(482): n is a, c, g, or t
  modified_base (657)..(657): a, c, t, g, unknown or other
  misc_feature (657)..(657): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggcccaccatccaactgacaacgtccagccagtagttgttttacttcggacccccaactaaataaccaacttacttacggcttggaccagcaagaaagtaggacacgcctacccgtaaactcctagtactttacgtgggtccttaccgtacccgggctacggtcccggggttacctaaccgntttcagttaggccgtaggtcgggtcgtcggggaccctatttccacgtctaccaccagtccacggccacgtcccgtcgccgtagggctaacgggaagnggttcggtggtacttaaggttttacttacgttcgtaccgaacgtacctaaacttaagtttacttaccgttttccgttttccgttaccgttaccggttttccggggacgggtaacggaccgtaaggggtcgaagtacgtaccgaaacggtacgtggtacggtctagcctaaccgtnttccgttagttccctgtaccc

SEQ ID NO: 65676 - DNA, 643 bp, Homo sapiens
  misc_feature: GYAE6OF02JWKN7.31.78.H01.1.454.CMB.1.raw
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (449)..(449): a, c, t, g, unknown or other
  misc_feature (449)..(449): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctcgtgggcgaggagggccaccatccgaactcgcaagtccagccgagtagttgttttattcggccccacgtaataacgaacttacttagtcttaggtaccagacaagaagtagacacgcctactaactccgtagactttacgcggtcttaccgaccggntacgttccgggttacctaacgnttcagttggactaggcggtcgtagggacccgttattccacgtcctacgaccatcgaagctacgactcgacgaagtcagaagngtgtggacttagtttacttacgtgtacacgtacaacttattacgttacttccgttttacgtaccttacgtttaccgggacggtaaccgggttaacgtacggggtaacgtacgtaactaccggtaaacgttaacgtggttacggtaccgtacgtaccgaaccttcggtaacctttcgttaccgttacttaccccg

SEQ ID NO: 65677 - DNA, 549 bp, Homo sapiens
  misc_feature: GYAE6OF02HTYNV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaagtccagccagagttgttttattcggccccacaataacaactacttagcttggtaccagcaagaaagtagacagcctcctaaactcctgatttactggcttctacccggcacttccgggttacctaaccgattcattggcagcgggtctgggaccgtacttcactcgtcaccactcagcagccctgcaggctagaagagtgtgctagtttattctgtcagctaaacattattactttctttgtctacgtttcggacggtaggacctaaggtggagtatacgaaaacgtactaggcgtctagactaccgattcccgtagttccttctaaccg

SEQ ID NO: 65678 - DNA, 627 bp, Homo sapiens
  misc_feature: GYAE6OF02IAMMC.31.78.H01.1.454.CMB.1.raw
  modified_base (405)..(405): a, c, t, g, unknown or other
  misc_feature (405)..(405): n is a, c, g, or t
  modified_base (452)..(452): a, c, t, g, unknown or other
  misc_feature (452)..(452): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggagggcccacatcaactgacaagtccagccagagttgttttattcggaccccacaaataacaaactactagcttaggtaccagacaagaaagtaggacacgctacctaactcctgtacttacgtggtcttaccgacccggcacgtccgggttacctaacgtattacgattggctaggtcgggtacgtacgggaccgtattaccnctctacactatacgacgacacgccgtgactaggctagaagtctgggngtacttaagtttaacttactagtacgtagacctaaactattttaacctactttcgttacgttaccttacggtttacggggaccggaaaggtaccgtaaggggtcgaagtaacgttacgaaaacggttacgtgggtacgtactcgacctacactttcgtacgttacttctacccgg

SEQ ID NO: 65679 - DNA, 575 bp, Homo sapiens
  misc_feature: GYAE6OF02GGJNY.31.78.H01.1.454.CMB.1.raw
  modified_base (568)..(568): a, c, t, g, unknown or other
  misc_feature (568)..(568): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggaccaccatcaactgcaagtccagccagagttgttttattcggccccacaataacaactacttagcttggtaccagcagaaagtaggacagcctcctaaactcctgatttactgggcttcgtacccgggcagttcccggggttcctaacccgattcattggcagcgggtctgggacctatttcactctcaccatcagcagcctgcgaggctgaagatgtggctagtttatacgttgtacagctaactatttaactacctttcgttttccacttaccgttttccgggacggtagggtaacccgaagggtaggagtagtaccaaacggtacttcggtggtctaggacctaaccgtattccgtcgttcctnttacccg

SEQ ID NO: 65680 - DNA, 969 bp, Homo sapiens
  misc_feature: GYAE6OF02FMQDT.31.78.H01.1.454.CMB.1.raw
  modified_base (280)..(280): a, c, t, g, unknown or other
  misc_feature (280)..(280): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggacccccacaataaccaactacttagcttggtaccngcgaagaagtagacacgcctacctaaactccgtagtacttttacgcgggtcctttccgtaccccggggtctacggtttaccccgggggtttacccttaaaacccggtacgtttccgtaacgtttcggaccgtaacggggtccgggttaccggttcgggggtaaccccgtatttttacccgaacctttcccgttaacccgaacctagtttacccgaacggtccaaccggtcccgttaacggcccgtaaacgggggtcccttaaaggggtaaaacggtacgtttagggggtacccgggttaccgtttaaaagggtttttttaccgtttaaaccgtttcgggttacccgtaaacggttaacctaaaaacccgtttaagtttttaaccgttttaaccgtttttttaccccgtttttttacccggttaacccgtttttaaccgggttttttccggggggtaacccggggggttaaaaccggggtttaaaaccccgggtttaaaagggggggttttaacccggggttaaaaccgggtaaaccggtttttaaaaaccccgggtaaaaaaaccccgggtttaaccggtttacgggggtaacccgggggtttaacccttaccgggtaaccccgtacccggtttaaacccggttcccggttttacggtttttacccccgtttaacccggtttaaccccg

SEQ ID NO: 65681 - DNA, 668 bp, Homo sapiens
  misc_feature: GYAE6OF02H518W.31.78.H01.1.454.CMB.1.raw
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagtttccagacctcccgtggctgtgtctcgtgggcgaggacgggccaccatcaactgcaacgtcctagccagagttgttttacgttcggacccccaacaaataacaactacttacgtcttcggtaccagacaagaaagtagacacgtacctaccctaaactcctagtaatttaccgtggtaccttccgtacccggctacggttcccgggttacctaaccgtgttcaagttcgacgtaggcgggtcgtacgggaccgtntttccgaccttctaccaccctagtaccgacgccacggtcctaggaccgaggtacctaagaagtgtcggtcgtacgttagtttacgttacgtcgtactaagtacctaacgttatttacttaccttttcgtttccgtacgttaccgtttcggggaaccggtaggtaaccgtaagggtagacgtacgtaacgaacgtacgtagggtcgtacgtcgacctacgtacttccgtacgtttctactacccg

SEQ ID NO: 65682 - DNA, 689 bp, Homo sapiens
  misc_feature: GYAE6OF02F6A22.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagtagttgttttattccggccccaacaataaccaactactagcttggtaccagcaagaagtagacagcctacctaaactcctagtactttacgtgggtccttaccgtacccgggtcctacggtttcccggggttacccctaaaccggtcttaccgtagttcggctacggtcgggtcgtacggggaccgttattccgacgtcctcgaaccctagtccgagccgacgcgtcgacgacggtctaggaaagtacgtcggtaggactttaaggtttaacttacggttacgtaccgaacgtaccgtaaacttacgttttaacgttaccttttcccgtttacgtacgttacccggtttacgggcgggtaaacggtacccgtaagggttacgacgtaacgtaaccgaacggttaacggtcggtcggacgttcggaccctacgtagttcctacggttcctacttacccg

SEQ ID NO: 65683 - DNA, 617 bp, Homo sapiens
  misc_feature: GYAE6OF02HLONL.31.78.H01.1.454.CMB.1.raw
  modified_base (448)..(448): a, c, t, g, unknown or other
  misc_feature (448)..(448): n is a, c, g, or t
  modified_base (488)..(488): a, c, t, g, unknown or other
  misc_feature (488)..(488): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgaggacgggccaccgatccaactgacaacgtccagccagtagttgttttacgttcggcccctaacaaactaactaactacttagcttcggtaaccagacaagaaagtaggacacgcctacctaaactcctagtattacgtcggtcttccgtacccggctacggttcccgggttacctaaccgtattcgagttcggcgacggcggtcgtgggtaccgtattcactctccaccatcacgcacgcctgacgnggtacaggaactagttgggacgtgttaattttactacgtnacgataccaatattacttctttcgttctactacgtttcgggaccggtacggtaaccgagggtcgtagactacgaaacgtcgtacgtggacctagtaccctacgtaccgttcgtacttccgtacgtcccg

SEQ ID NO: 65684 - DNA, 513 bp, Homo sapiens
  misc_feature: GYAE6OF02JIJPQ.31.78.H01.1.454.CMB.1.raw
  modified_base (308)..(308): a, c, t, g, unknown or other
  misc_feature (308)..(308): n is a, c, g, or t
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagtgttttattggccccaacaataacaactactagcttggtaccagcagaaagtaggacagcctcaaactcctgatttacnggcttcaccgggcagtccgggttcctaacgattcattggcagcgggtctgggaccatttcgactcacaccatcagcagcctgcaggctgaagactgtgctagtttatactntcgagacaacattatactttcgtttacnctacgtttcgcggtaggacaggtganatcgaacgactgtacggctgcacgtntctacgtntacgtc

SEQ ID NO: 65685 - DNA, 541 bp, Homo sapiens
  misc_feature: GYAE6OF02F1PKG.31.78.H01.1.454.CMB.1.raw
  modified_base (312)..(312): a, c, t, g, unknown or other
  misc_feature (312)..(312): n is a, c, g, or t
  modified_base (420)..(420): a, c, t, g, unknown or other
  misc_feature (420)..(420): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctggcgagagggccaccatcaactgcaagtccagccagagtgttttattggccccacaataacaactacttagcttggtaccagcagaaagtaggacagcctacctaaactcctagatttacngggtcttcgtacccggggcacgttcccggggttcctaaccggattcattcggcaggcgggtctggggaccatttcactctcaccatcagcagcctgcaggctgaagtntgtggactagtttatactgtcagactaactattactacttctttcgtctacgtttcggacggtacgggtaccaagggtgacgatacgaaacgaactggtgctgccactatctgttctctac

SEQ ID NO: 65686 - DNA, 757 bp, Homo sapiens
  misc_feature: GYAE6OF02HLTLH.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacgggccaccatcaactgacaacgtccagccaggtagttgttttacttcggaccccaacaaataacaacttacttagcttggtaccagacaagaaagtaggacacgcctaccctaaactcctagtactttacgtcgggtccttccgtacccgggactacggttcccggggttacctaaccggtattcctagttcggcgacgggtcggggttacgtcggggtaaccctacgttttccaaccttctacccaaccgtatccgacgccacgccgtcgacgacggacgtagaagtagtaggtcggtacgttagtttacgtttacgttacgtacgtacgtactaacttaactttaactttacctttaccttttccgttaccgttaccggtttaccgggtacgggtaacgggtaaccggtaacgggtacgggtacgtaacgtaaccgtaaaccggtaacgacgggtttttttttttttttttttttttttttacgggaccggttaccggtaccgtaaccgtaccgttaccgtttacggtttaccgtttaccgttaaccg

SEQ ID NO: 65687 - DNA, 615 bp, Homo sapiens
  misc_feature: GYAE6OF02ISNOO.31.78.H01.1.454.CMB.1.raw
  modified_base (398)..(398): a, c, t, g, unknown or other
  misc_feature (398)..(398): n is a, c, g, or t
  modified_base (477)..(477): a, c, t, g, unknown or other
  misc_feature (477)..(477): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagacgggccaccatcaactgcaagtccagccagagttgttttattcggaccccacaataacaactacttagcttacggtaccagacaagaaagtaggacacgtcctacctaaactcctagtatttacgtgggccttccgtacccggctacgtccgggttacctaacgtattcagttcggacacggcggtcgacgggaccgtntttccacttcctaccacctatcaacgcacgccgtagcacggcgtagaagagtgtcgtacttagtttattactgtacganactaactacttacttactttcctttcgtaccgttacggttccgggacggaacgggtaaccgagggtaggagtaacgtaaccgaaacggtaaccgtggtcggtacgtacgacctactacgttcgtcgttctacttaccg

SEQ ID NO: 65688 - DNA, 610 bp, Homo sapiens
  misc_feature: GYAE6OF02JIND4.31.78.H01.1.454.CMB.1.raw
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggtaggctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagacgttgttttatttcggccccaaccaataacaactacttagtcttcggtacctagcaagaaagtaggacacgccctactaaactcctagtatttactgggtccttcgtacccggcacgttccggggttacctaacgacttcagttcgcgacgtcgggtcgtcgggtaccgactttcgactctacacctntcaagcacgcctgcgagtcctagtaagagtggcgtactagtttacttacttagtcgacgtcaactatttaactacctttctttccgtcgtacgtttcgacgggacggtaaccgtagggtcgacgtataccgtaaacgtaacgttggtcgacgttcgaccctacgacgtttacgtcgtttcgtacttacccg

SEQ ID NO: 65689 - DNA, 839 bp, Homo sapiens
  misc_feature: GYAE6OF02HQALK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgcaagtccagccagagtgttttattcggccccaacaataacaactacttagcttaggtaccagacaagaaagtaggacagccctacctaaacctcctagtactttacgtcgggtccttccgtacccgggctacggttcccggggttacctaaccggtacttacagttcggaccgtacggtccggggttacgtcggggtaacccgttaacttttccaaaccgttcctacccaaaccctaacttaccgaacggtaccgtaaccggtaccccgttagggttaacgggtacctagggtaaacggtaagttcgggttacggggtacttaaacgggtttttactttaaccgttacggttacctaacggtaccctaaaaccgttaacttttaacgttttaacccttttaccggtttttacccggtacccgtttaacccgggttttacccgggggaaccggggttaaacggggggtaaacccgtaaagggggttacgggtaaacggtaaccgttaacccggaaaaacccggtaacggtttaacgggtaccgggtaaccggttcggtaacccgtaacccgttaacgttacccgttaccggtttacctttacccgtacgttttcccccg

SEQ ID NO: 65690 - DNA, 784 bp, Homo sapiens
  misc_feature: GYAE6OF02FT2PN.31.78.H01.1.454.CMB.1.raw
  modified_base (321)..(321): a, c, t, g, unknown or other
  misc_feature (321)..(321): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggcccaccatcaactgacaagtccagccagagttgttttattcggccccaacaataacaactacttagcttggtaccagcaagaaagtaggacagcctacctaaactcctagtatttacngggtcttccgtacccggcacgttcccggggttaccctaaccggtattaccgtagtttcggaccgtacgggtccggggttcctacgggggtacccgttaacttttccgaaccgtttaccctaccgtaaccctaacgttacccgaacggcctaaccgtcccgttacggacccgtaacggggtcctaagggtaaacggtacggttacgggtcgggtaccgtttaacggttttttaacgttaacgttacgttaaccgaacgtaccctaaaccttaacttttaaccgttaaccttttacccgttttaccggttaccttaaccgggttttaccggggaccgggtaaccgggtaaccgtaacggggttacgggaacgttaacgtaaccggtaaaacggtaaccgttacgggtacggtaccttacggacccgttaaccgtacgttccgttacgttacccgttacctacccg

SEQ ID NO: 65691 - DNA, 594 bp, Homo sapiens
  misc_feature: GYAE6OF02GS3RZ.31.78.H01.1.454.CMB.1.raw
  modified_base (433)..(433): a, c, t, g, unknown or other
  misc_feature (433)..(433): n is a, c, g, or t
  modified_base (461)..(461): a, c, t, g, unknown or other
  misc_feature (461)..(461): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctagatttacgtgggccttccgtacccgggctacgttcccggggttacctaaccgtattcagttcggcaggtccgggtctcggggtacctatttcactctcaccatcagcagcctgcgaggctagaagntgtggctagtttactactgcagcaactnttatactttctttacgtctacgtttcggacggtacggtaaccgtaagggtcggtagtaacgtaccgtaaaacgtaaccgttaggtacggccgtacggacctaccacgtttcgtacgttaccgttactaacccg

SEQ ID NO: 65692 - DNA, 854 bp, Homo sapiens
  misc_feature: GYAE6OF02H7E7M.31.78.H01.1.454.CMB.1.raw
  modified_base (194)..(194): a, c, t, g, unknown or other
  misc_feature (194)..(194): n is a, c, g, or t
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagcgtacaacaggcaggcaggggcagcaagatggtgttgcacgacccgaggtcttcattttctctgttgctctggatctctggtgccgtacggggacatcggtgatgagccctagtttccagcctccgtggctgtntctcgtggcgagacgggccacatacaactgacaacgtccaggaccagtagttcggttttacgttcggacccccaacctaaactaactaaacttaccttaagtccgttacggtaaccccnggaacctaaaggaaaacggtacgaaccacgtaccctaccttaaaaccgtcgttaggttaagtttaaccgtggggttacccttccggttacccgggccgtaaccggttcccgggggttttaccaaaccggttcttcgtattcggacgacgggtcgggttacgtcgggtaacccgttattcctaaccgtctaccgtacctacgtaccgtaaccgaccgtaaccgtccgttacggaccggtacgggtccgtaaggtaaacggtacgtcgggttaacggtacttttaacggttttaactttaccggttagtacccgtacggtaaacctttaactaagtttttaaccgtttacctttttacggttaccgtttaccgtttaacccgggtttacgggggaaccggggttaacccgggtaaacggttaacggggtacggttaccggaacggttaaacccgaaaacgggttaacccggtggtttccgggaaccgttacgaacccgttaccttaccgtttaccggttaccctttcggttaaccttccccgg

SEQ ID NO: 65693 - DNA, 775 bp, Homo sapiens
  misc_feature: GYAE6OF02J26B6.31.78.H01.1.454.CMB.1.raw
tcagcagtagacgtcacgaccggtgctcgatttagtgtgagtagtttgggtttgggggagctacaacaggcaggcagggcagcaagatggtgttgcagacccaggtcttcattctctgttgctctggatctctggtcgccgtacgggacagtcgtgactgacgtcctagtttccagtactcccgtggctgtcgtctcgtcgggcacggacgggcccacctataccgaactggacctaacgttccagacctagtagtttcgttttacgtccggacccctaactaaactaacctaacttacgttacgtacgttacggaaccagaccgtaaacggtaaagtaccggaacctacggtaccctaacctaaccgttcgtatacgtttacggtcgggccctttaccggaccggtcgttacgtaccgggttacctacggtatcgtagtcgcgtacggcggttcgacgcttacttccactcctacgaacctagtcgacgtccgacgccgtacgcgacgtacgtacggtaacggtgttacggtacgtacgtttaccggttaagtttccggtacgtaccgtaacggtaaccttaaccgttaatttacccggtttaacccgtttccgtttaacccgtacgttacccggtttaccggggaccgggttaaaccggtaacgtaacggggtacgtaccgtaacgtttaaacccggaaccgtttaacggtcggtaccgttaccgtacgacccgttacgtacccgtttcgtacgttaaccgttccttaacccg

SEQ ID NO: 65694 - DNA, 548 bp, Homo sapiens
  misc_feature: GYAE6OF02F86CU.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacacgcctacctaaactcctagtatttacgngggtcttaccgtacccgggctacgtccggggttacctaaccgattcattggacaggcgggtctcgggacctatttccactctcaccatcagcagcctgcaggctagaagatgtggactagtttatactgtcagacaactattatactttcttcgtctacgtttcggcggacggactaggtgagtactacgaaacgtaactgtacggctagccactactctcgttctctac

SEQ ID NO: 65695 - DNA, 539 bp, Homo sapiens
  misc_feature: GYAE6OF02FIPBG.31.78.H01.1.454.CMB.1.raw
  modified_base (421)..(421): a, c, t, g, unknown or other
  misc_feature (421)..(421): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcttgatgagccagtttccagactccctggctgtgtctctgggcgagagggccaccatcaactgcaagtccagccagagttgttttattcggccccacaataacactacttagcttggtaccagcagaaagtaggacagcctacctaaactcctagtatttactgggcctttcgtacccgggcacgttcccggggttacctaaccgattcattggcaggcgggtctgggaccgtatttcactctcaccatcagcacgctgcagctgaagntgtgctagtttatactgtacagcaactattatactttcttcgtctacgtttcggcggtaggactaggtgagactacgaaacgtactggtgtctagcctactatcgtcgttctctaccg

SEQ ID NO: 65696 - DNA, 576 bp, Homo sapiens
  misc_feature: GYAE6OF02G6861.31.78.H01.1.454.CMB.1.raw
  modified_base (230)..(230): a, c, t, g, unknown or other
  misc_feature (230)..(230): n is a, c, g, or t
  modified_base (364)..(364): a, c, t, g, unknown or other
  misc_feature (364)..(364): n is a, c, g, or t
  modified_base (433)..(433): a, c, t, g, unknown or other
  misc_feature (433)..(433): n is a, c, g, or t
  modified_base (464)..(464): a, c, t, g, unknown or other
  misc_feature (464)..(464): n is a, c, g, or t
  modified_base (555)..(555): a, c, t, g, unknown or other
  misc_feature (555)..(555): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagngttgttttattcggccccacaataacaactactagcttggtaccagcaagaaagtaggacagccctacctaaactcctagtactttacgtgggtccttccgtacccgggctacgttccggggttacctaaccgnttcagtttcggcaggcgggtctcgggacctatttcactctacaccatcagcagcctgcaggctagaagntggtgctagtttactactgtacagactaatnttacttacttctttcgtcttacgtttcggacggtacggaaccgtagggtgagtacgtacgaaacggtactggtacgcgtcgacctaccgtnttcgtacgttccttctacccg

SEQ ID NO: 65697 - DNA, 513 bp, Homo sapiens
  misc_feature: GYAE6OF02FL7AR.31.78.H01.1.454.CMB.1.raw
  modified_base (370)..(370): a, c, t, g, unknown or other
  misc_feature (370)..(370): n is a, c, g, or t
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacactactagcttggtaccagcagaaagtaggacagcctcctaaactcctgatttactgggcttctacccgggcatccggggttcctaaccgattcattggcagcggtctgggaccgntttcactctcaccatcagcagcctgcaggctgaagatgtggctagtttatactgtcagcaanttatacttctttcgtctacgtttcggcgtaggacctaaggtgagatacgaaacgactgtgcgtgcaccatctcgtctctac

SEQ ID NO: 65698 - DNA, 656 bp, Homo sapiens
  misc_feature: GYAE6OF02HP9H6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcctggctgtgtctcgtgggcagagggccaccatcaactgacaagtccagccagtagttgttttattcggccccaacaataacaactattagcttgtaccagacagaaagtggacagcctacctaaactcctagtaactttacgtgggcctttccgtacccggggctacgttcccggggttaccctaaacgtatttccagttcggcctagggtccgggtactggggacctatttccactcctacacctatccagcacgtcctagcacggcgtagaagtagtcggtaggacttaaggtttacttacgtcgttaccaaggtacctaaacttatttaacttacctttccgtttaccgtccgttaaccgtttcgggaaccgggtaacggaaccgtaagggtcggaagtacgtaaccgaaaacggtacgttacggtacggtaccgttagacccgtaaccgtacttccggtacgttcttactaccg

SEQ ID NO: 65699 - DNA, 546 bp, Homo sapiens
  misc_feature: GYAE6OF02GB239.31.78.H01.1.454.CMB.1.raw
  modified_base (263)..(263): a, c, t, g, unknown or other
  misc_feature (263)..(263): n is a, c, g, or t
  modified_base (343)..(343): a, c, t, g, unknown or other
  misc_feature (343)..(343): n is a, c, g, or t
  modified_base (410)..(410): a, c, t, g, unknown or other
  misc_feature (410)..(410): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacactactancttggaccagcagaagtagacagcctactaactctgtattactggcttcgtacccggctacgtccgggttcctaaccgtnttcagttggacaggcggtcgtgggactgtttcactctcactatcagcacgcctgcgaggctagaagngtggtcgtctagtttaacttacgttgtacagtacaacttattacttacttcgtttacgtctacgtttcgggacggtacggacgaggtgagacgtacgaaacgactggtgtcngtcgactatccgtcgttactatac

SEQ ID NO: 65700 - DNA, 554 bp, Homo sapiens
  misc_feature: GYAE6OF02FWZF9.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcatccggggttcctaaccgattcattggcagcgggtctgggacctatttcactctcaccatcagcagcctgcaggctagaaacgngtaggtggacttagtttacttacgtgtcagcaactattatactttctttcgtactacgtttcggcggtacggaccgtaagggtggagatacgaaacgtaactcggtacggcgtcgccacctagttctcggttcttacgtacc

SEQ ID NO: 65701 - DNA, 664 bp, Homo sapiens
  misc_feature: GYAE6OF02FWBCR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgttttattcggcccacaataacactactagcttgaccagcaagaaagtaggacagcctacctaaactcctgtatttacgtcggtcttcgtacccgggcacgttcccggggttacctaaccggtattcagttcggcgtaggtcgggtctcggggacccgtatttccgaaccttcctccgaaccctataccgacgtacctacgtcctacggcgtacggtccgtagaacgtagtacggtcggacttaggtttacttacgttcgtacgtaacgtacaaacgttatttacttaccttttcgtttaccgttccgttacgttttaccgggacggtaaccgggtaaccgtaagggttacggagtaactaacggtaaaccggtaacgttcggtcggacgttacggacctaccgtaccgttcgttcgttaccgttactacccg

SEQ ID NO: 65702 - DNA, 661 bp, Homo sapiens
  misc_feature: GYAE6OF02IT3XF.31.78.H01.1.454.CMB.1.raw
  modified_base (519)..(519): a, c, t, g, unknown or other
  misc_feature (519)..(519): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgacaagtccagccagagttgttttattcggccccaacaataaccaactacttagcttaggaccagacaagaagtagacacgacctacctaaactccgtagtactttacgtcgggtacctttccgtaccccggggctacggttccccggggttacctaaccgtattccagttcggctacgggtccgggttacgtcggggacccttactttaccgaccttcctaccaacctcgtccgacgcaccggtcctacggcctaggctaggaagtacgtgggtcggtacttaagtttacttacgttancgagactaattacttaacttacctttccgtttctaccgttacgttccgggacgggtacggtaacgtagggtggagtacgtaaccgaaacggtacgttggtcgtcctacggtacctacgtacgttcctcgttactaccgtacc

SEQ ID NO: 65703 - DNA, 750 bp, Homo sapiens
  misc_feature: GYAE6OF02FR7NN.31.78.H01.1.454.CMB.1.raw
  modified_base (739)..(739): a, c, t, g, unknown or other
  misc_feature (739)..(739): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtaggacagcctacctaaactcctagtacttttacgtgggtccttcgtaccccggggctacgttccccgggggtttaccctaaacccggtaatttccgaagttttcgggcccgtaacggggtccgggggttaccgttacggggggtaaccccggttaatttttacccgaaccgtttacccttacccgtaaccccgtagttacccgaacggtccaacgggtccccttcgggaccgtaacgggtcccttagggaaaaccgttagttacgggttcgggtacccttaaggttttttaacttaccgttacggttaccgaacggtacctaaacctaacttttaacgtaacctttttccgttttaccgttacttaccgtttccggggacggtaacgggtacccgtaaggggtacggtagtacgtaacgaaacgtacgtggtcgacgtcgaccactacttcgtnttcctatcccg

SEQ ID NO: 65704 - DNA, 663 bp, Homo sapiens
  misc_feature: GYAE6OF02GL4VO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtaggacagcctacctaaactcctagtactttacgtgggtcctttccgtaccccgggctaacggttcccgggggtttaccctaaaccggtctttccgacgtttcggccgaaggtccggggtctacgggggaccctattttccgacctcgtccacctatccagcacgcctaggccgaggtccgtagaagtacgtggtacggtaccttaagttttattacgttcgtcaacgactaactattacttactttcctttcgttacctacgtttcgggaccggtacgggtaaccgtagggtcgggtacgtaactaccgtaaaacggtacgttacggtaggtccttacggacctacccgtagttccttaagttcccgttacttacccg

SEQ ID NO: 65705 - DNA, 812 bp, Homo sapiens
  misc_feature: GYAE6OF02HP4PB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccgtggctgtgtctcgtgggcgagacggccaaccatcaactgacaagtccagaccagtagttgttttacttcggaccccaactaaataacctaacttacttagtcttacggtaccagacaagtaaagtaggacacgtacctacctaaactccttagtactttaaccgtggtaccttaccggtaccccggggtactaaccggtttacccgggggttaccctaaaccggtactttaccgaagttccgggacgacgggttccggggttacgtacgggggtaacccgttacttttaccggaaccctttcctaccgtaaccctacgttacgaacggtacctaacggtcccctaggtacccggtaagggtccgttaaaggaaagtaacggttagggtacgggtaactttaaacggttttaacgtttaccgaccgggttactaaacggacccttaaaacgttactttttaaaccttaaccgttttcccgttttaccgtaaccgttaacggttttcccgggaaacggggtaacggaaaccgggtaagggtacggaacgtacgtaaacgaaaaccggtagtcgggtacgtaccgtacggtaacccgtaactacgttacccggttacgttacctaccgttaccg

SEQ ID NO: 65706 - DNA, 695 bp, Homo sapiens
  misc_feature: GYAE6OF02JVA9D.31.78.H01.1.454.CMB.1.raw
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctcgtgggcgagaggccacgatcaactgcaagtccaagccagtagtgttttattcggcccacaataacaactacttagcttcggtaccagtcaagaaagtaggacacgcctactaaactcctagtactttacgtggtccttaccgtacccgggntaacgtccgggttcctaaaccggtnttctaagtcggacctaggccgggttactcggggtaaccctatttccgaaccttccgtaccaacccgtagtaccacgtacctacggtcccttaggccgacggtactacgggtaaagtacgttcgggtacggtacgttaacggtttaacgtttaccgttaggtaccgtaacgtacaaacgttatttaacgttacctttacgtttccgttaccgtaacgttttcgggacggtaacggtaaccgtaacgggtaggtacgtaacgttaaccgaaacctaacggtggtaaccgtcgtacgtaccgaacctagttaccttacgttcctacgttaccg

SEQ ID NO: 65707 - DNA, 641 bp, Homo sapiens
  misc_feature: GYAE6OF02GJH82.31.78.H01.1.454.CMB.1.raw
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatccaactgcaagtccagccagagttgttttattcggccccaacaataacaactacttagcttaggaccagcagaaagtagacagcctacctaactcctagtactttacgngggtccttaccgacccgggctacgttcccggggttaccctaaccgtattcgagttcgggacctagggtcgggtcgtacggggtaacccgtatttccaaccgttcctaccaaccctatccagccacgccctgacagggcctagaagtcgtaggtcggacttaagtttactacgtggtacagtactaaactatttactacctttcgtttacgtcttacgtttccggacgggtacggacgtagggtaggacgtacgtaaccgaaacgtacgttggtacggtccgtacgacctacgtacgtccgttagttaccttcgtacccg

SEQ ID NO: 65708 - DNA, 659 bp, Homo sapiens
  misc_feature: GYAE6OF02JLXDA.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagtttccagacctcccgtggctgtgtctcgtgggcgaggacggccacatcaactgacaacgtccagccgaagtacgttgttttacgttccggacccccaactaaactaacctaacttacttacgccttacggtaaccagcaagaagtagacacgtcctaacgtaactcctagtacttacgtcggtccttccgacccggctaccgtcccgggttaccaacgtattcagttcggcacgggtcggtacncgggtacctagtttccactccgtacaccgtataccgtagccgtacgtccgtgccgtacgcgtagaacgtgtagtacgtaacgttagtttatacgttcgacgtaacgtaacctaaccggttatttaccgttaacctttcgtttacctccgttaacggttccgggaacgggtacgaaacggttgacggtactagtaactaaaccgtgtcggtacgtcgtaacgctaactctacggttctacgttctccg

SEQ ID NO: 65709 - DNA, 590 bp, Homo sapiens
  misc_feature: GYAE6OF02HWAVC.31.78.H01.1.454.CMB.1.raw
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
  modified_base (454)..(454): a, c, t, g, unknown or other
  misc_feature (454)..(454): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacgggccaccatcaactgaccaagtccagccaagtagttgttttattcggcccccaacaaataacaacttacttagcttacggtaccagcaagaaagtagacacgcctacctaaactcctagtatttacgnggtccttccgacccgggctacggtcccgggttacctaaccgtnttccagttggacaggccggtgtcgggacctatttacacttctaccaccatcgagcagcctgcgagctagaagagtggngtactagtttacttactgtacagtacaactattattactttcttacgtctaccgttcggacggtaggaccgaggtgataactacgaaacgtactggccgtactcgaccaccgtattccgtcgttaccttatacccg

SEQ ID NO: 65710 - DNA, 563 bp, Homo sapiens
  misc_feature: GYAE6OF02FQC5S.31.78.H01.1.454.CMB.1.raw
  modified_base (329)..(329): a, c, t, g, unknown or other
  misc_feature (329)..(329): n is a, c, g, or t
  modified_base (535)..(535): a, c, t, g, unknown or other
  misc_feature (535)..(535): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctactaaactcctgatttactgggcttcgtacccggntacgtccgggttcctaaccgattcattggcagcgggtctgggacctatttcactctacaccatcagcagcctgcgaggctagaagatggtcggacttagtttaacttacgttgtacagtaccaacgtattattactttctttacgtcttacgtttcgggacggtacggaaccgtagggtcgagactacgtaaacgtactggtcggngtcgacacctatctcgttcttcgtaccg

SEQ ID NO: 65711 - DNA, 684 bp, Homo sapiens
  misc_feature: GYAE6OF02I7D3A.31.78.H01.1.454.CMB.1.raw
  modified_base (402)..(402): a, c, t, g, unknown or other
  misc_feature (402)..(402): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccgatcaactcgcaacgtccagccaaggtagttgtttttattcggaccccctacaaataacaacttacttacgtcttaggtaccagacaaggaaaagtacggaaccacgtacccttaccctaaaaccgtcctagtacttttacgcgggtctttaccgacccgggtctacggttccggggtttacccaaccggtnttctagttcggacgaggtcgggtctacggggacctacgtttacacgttctaccaaccgtactacgacggcacgtccctggaccgtacgggtacgtaggaagtaggttacgtggtacgttaagtttacgttacgtaggttacaacgtactaacgtactttaacgtactttcgttactaccgttacgtttcggggaacggtaggaaccgtaaggacggtagtagtaacgtaaacggtactagggtacggtacgtacgaccacgttactcgttcgtactcgtacc

SEQ ID NO: 65712 - DNA, 588 bp, Homo sapiens
  misc_feature: GYAE6OF02JFICB.31.78.H01.1.454.CMB.1.raw
  modified_base (263)..(263): a, c, t, g, unknown or other
  misc_feature (263)..(263): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtggcgagagggccaccatcaactgcaagtccagccagagtgttttattggccccaacaataacaactactancttggtaccagcaagaaagtaggacagcctacctaaaactcctagtactttacgtgggcttaccgtacccgggacacgttcccggggttacctaaccgtattcattggacaggcgggtctagggaccgtatttcacgtctacaccatcagcacgcctgcaggctaganagtgngtactagtttattactgtcagctaaactagttactacttctttcgtacttacgttcgggacggtaacggtaccgtaagggtcggagtaacgtacgaaacgtaacgtcgtaggtcctaggacctaaccgtatacgtacgttccttacgtaccg

SEQ ID NO: 65713 - DNA, 569 bp, Homo sapiens
  misc_feature: GYAE6OF02HMRE4.31.78.H01.1.454.CMB.1.raw
  modified_base (340)..(340): a, c, t, g, unknown or other
  misc_feature (340)..(340): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (520)..(520): a, c, t, g, unknown or other
  misc_feature (520)..(520): n is a, c, g, or t
  modified_base (535)..(535): a, c, t, g, unknown or other
  misc_feature (535)..(535): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatacaactgacaacgtccagccagagttgttttacgttcggacccccaacaaataaccaacttacttagtcttcggtaaccagacaagaaagtcggacacgtcctacctaaactcctagtactttacgngggtccttaccgtacccggctaggtcccgggttacctacgtattctagtgcgagcggtcgtagggacctattcactcacacnctcagcacnctncgcgntagagngtgcgtatagtttactacgngttacacnctaatattattcttcttcgtcttacgttgacggagacgtaggtaganacgtacgaaacggtntacggtgactgacctacactctntccttntaccg

SEQ ID NO: 65714 - DNA, 603 bp, Homo sapiens
  misc_feature: GYAE6OF02FKRPL.31.78.H01.1.454.CMB.1.raw
  modified_base (322)..(322): a, c, t, g, unknown or other
  misc_feature (322)..(322): n is a, c, g, or t
  modified_base (364)..(364): a, c, t, g, unknown or other
  misc_feature (364)..(364): n is a, c, g, or t
  modified_base (437)..(437): a, c, t, g, unknown or other
  misc_feature (437)..(437): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggcccccaacaataaccaactacttagcttggtaccagcaagaaagtaggacagccctacctaaactcctagatttacngggcttcctacccggggcacgttcccggggttacctaaccgnttcattcggcaggcgggtctgggaccctatttcactctcaccatcagcacgcctgcgaacggtctagaaagtntggtaggcttaagtttaatactgtaccagacctaactagtttaactactttctttacgttacttaccgtttcgggacggtaacgggaacctaagggtagacgtaataacggaaaaccgtacgttaggacgtccgtagacctacctagttctcgttacctactaccg

SEQ ID NO: 65715 - DNA, 617 bp, Homo sapiens
  misc_feature: GYAE6OF02H0SJJ.31.78.H01.1.454.CMB.1.raw
  modified_base (139)..(139): a, c, t, g, unknown or other
  misc_feature (139)..(139): n is a, c, g, or t
  modified_base (454)..(454): a, c, t, g, unknown or other
  misc_feature (454)..(454): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtnccgtacggggacatcgtgatgagccagtttccagactccctggctgtgtctctgggcgaggaggccaccatcaactgacaagtccagccagagttgttttattcggccccaacaataacaactacttagcttagtaccagcaagaaagtagacagcctacctaaactcctgtatttacgtggcttaccgtaccggactacgttcccggggttacctaaccgtattctacgttggcacggtcgggtactgggtacccgtaactttccaccttcgtacctaaccatccacgcacgtcctgccgaggcgtacgaaagngtacggtggactttagtttaacgtttacgtgtaccagtacaaactatttactacttttcgttactactacgtttccggcgggtaaacggaccgtaagggtgacgtacgtaacgaaaacgtactggtcggactgacaccctattacgtacgttcctacgtaccc

SEQ ID NO: 65716 - DNA, 708 bp, Homo sapiens
  misc_feature: GYAE6OF02H8LV2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtcgtctcgtgggcgaggagggccacatcaactgacaagtccagccagagttgttttacttcggccccaacaataacaacttacttagcttggtaccagacaagaaagtaggacacgctaccctaaactcctagtacttacgtcggtcttccgtacccgggcacgtcccggggttacctaaccggtattccgaagttcggcgtaggccgggtcgtagggacccgtacgtttacaccgttctaccgaaccattccacgccgtagtccctggaccgacgggtctaggaaagtacgttcggtggtacttaacggttttacgtttacgttcgttaccgagtacctaaagttactttaactttacgttttccttttaccgttcgttaacccggttttcgggaccggggtaacggaacccgttaagggtcggtaagtaccgtaaccgtaaacgggtaaccgttggtaccggtaccgttaggacccgtaacccgtacgttacccgttccgtttacccgttcgttaaccccg

SEQ ID NO: 65717 - DNA, 647 bp, Homo sapiens
  misc_feature: GYAE6OF02H010T.31.78.H01.1.454.CMB.1.raw
  modified_base (334)..(334): a, c, t, g, unknown or other
  misc_feature (334)..(334): n is a, c, g, or t
  modified_base (461)..(461): a, c, t, g, unknown or other
  misc_feature (461)..(461): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacgggccaccatcaactgacaagtccagccagtagttgtttttacgttcggaccccctaacaataacaacttacttagcttggtaccagcaagaaagtaggacacgcctacctaaactcctagtatttacgnggtccttccgacccgggctacggttcccggggttacctaaccgtattcagttcggcaggtcgggtctcggggacccttatttccgactctaccaacctatcaacgcagactcggcaggctagaagtntggtggacttaagtttagtacgtagtacagacctaattagtttacctacttttcgtttaccgttcgttacgtttaccgggcgggttaaacggaccgtaaggggtacgtacgaacgtaaccggtaaacgagttcggtcggtaccgtacgacctaccgttacgtccgtttcgttaccttccgtaaccg

SEQ ID NO: 65718 - DNA, 607 bp, Homo sapiens
  misc_feature: GYAE6OF02I3GIU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgccagtttccagtacctccctggctgtgtctcgtgggcgaggacgggccaccatcaacgtcgcaagtccagccgagtagttgttttacttccggcccctaacaataacaactacttagcttcgtaccagcaagaaagtaggacacgtacctacctaactcctagtactttacgtgggtccttccgtacccggctacggttccgggttacctaaccgtattcgtagttcggcgaggtcgggtcgtcgggaaccgtcttttcacttcgtacaccgatccgacgcacgtccgtcgcgacggctagacgtagtgtcggctagtttatacgtcgtcacgactaagtacttacttactttcttcgtactacgttcggtacggacggtaacgagggtagacgtactaacgaacgtacgtggtacgcgtacgacacgtctctcgtacttcgtac

SEQ ID NO: 65719 - DNA, 609 bp, Homo sapiens
  misc_feature: GYAE6OF02GP98P.31.78.H01.1.454.CMB.1.raw
  modified_base (316)..(316): a, c, t, g, unknown or other
  misc_feature (316)..(316): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggccccacaaataacaactacttagcttaggtaccagcagaaagtaggacagcctacctaaactcctgatttacgngggtcttccgtacccggggctacgttcccggggtttacctaaccggtatttccgagtttcggacctaggtccggggtctacgggggacccgtatttcgaccttctccacctatccgagccagtcctggtacggctaggaagatggtggacttaggttattacgtgtacagactaactattactactttcgtttctctaccgtttcggacgggtaacggaccgaaggttcggagtactacgaacgtacgtaggtacggtactcgacgacctagtccgtgttcttacattacccg

SEQ ID NO: 65720 - DNA, 613 bp, Homo sapiens
  misc_feature: GYAE6OF02IUBIG.31.78.H01.1.454.CMB.1.raw
  modified_base (363)..(363): a, c, t, g, unknown or other
  misc_feature (363)..(363): n is a, c, g, or t
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcttgatgagccagtttccagactccctggctgtgtctcgtgggcgagagggccaccatcaactgcaagtccagccagtagttgttttattcggaccccacaataacaactacttagcttggtaccagcagaaagtagacagcctacctaaactcctgtactttacgtgggtacttccgtacccggggctacgttccggggttacctaacgnttacagttggacaggcgggtcgtgggaccgtatttcgactctaccacctatccgancacgtcctgcaggcgtagaagagtgtcggctagtttacttactcgtacacgtactaactattacttactttactttcgtacttacgtttcgggtacgggtacggtaaccgtagggtacggagtaacgttacgaaacggtaacgtggtacgtccgtaccgacctaccgtatccgttacgttacccttacgtaacc

SEQ ID NO: 65721 - DNA, 620 bp, Homo sapiens
  misc_feature: GYAE6OF02GGVAM.31.78.H01.1.454.CMB.1.raw
  modified_base (504)..(504): a, c, t, g, unknown or other
  misc_feature (504)..(504): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagtatttacgtggtccttcgaacccgggtctacgttcccggggttaccttaaaccgcttaccgacttggcctaggcgggttcgtcggggaccgtacgtttcttaaccgcttaccacctattccgaacgcctacgcctagcaggtctagaacgtagtggtcggtcgttaagtttacgtacgttgtaccagtactaaactnttactacgtttcgtttacgttcgtacgtttccgggacgtaacggtacgacgggtagagtacgtaccgaaacgtacgtggtacgacgtcgactacgtagtactcgttacctctaccg

SEQ ID NO: 65722 - DNA, 596 bp, Homo sapiens
  misc_feature: GYAE6OF02HCESS.31.78.H01.1.454.CMB.1.raw
  modified_base (447)..(447): a, c, t, g, unknown or other
  misc_feature (447)..(447): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactactagcttggtaccagcagaaagtaggacagcctacctaaactccctgtactttacgtcgggtcttccgtacccgggctaacgttcccggggtttacctaaccgtattccagtttggccaggcgggtcgtcggggaccctatttccgacttccgtcaccactcacgcacgcctgcaggcagagagtgngctagtttactactgtcagtcaactattaacttactttcgtttcgtacttcgtttcgggacgggtaacggaaccgtaggtaggacgtaagtaccgaaacgtacggtacgtggtcgtagacctaacctacttccgtcgttccttctaccg

SEQ ID NO: 65723 - DNA, 539 bp, Homo sapiens
  misc_feature: GYAE6OF02HEQ6P.31.78.H01.1.454.CMB.1.raw
  modified_base (421)..(421): a, c, t, g, unknown or other
  misc_feature (421)..(421): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggtcttctacccgggcacgttcccggggttcctaaccgattcattcggcaggcgggtctgggaccgtattcactctcaccatcagcagcctgcaggctagaagatgnggctagtttatactgtcagcaatattatactttcgttcgtcttacgttcggcggtacggaccgtaagggtggagacgtacgaaacggtactggtggctgaccacactctgtctctacg

SEQ ID NO: 65724 - DNA, 680 bp, Homo sapiens
  misc_feature: GYAE6OF02I3VA8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggcccacatcaacgtgacaagtccagccagtagttgttttacttcggaccccacaataacaactaatagcttggtaccagacaagaaagtaggacacgccttaccgtaaactccgtagtactttacgtcgggtacttccgtaacccgggctaacggttcccggggttaccctaaccgtatttaccagttcggccaagggcgggttaccgtaggggacccgtaagttttccaacgttccgtaccaacctatccgaagccacgtccctgaccgacggtcgtaggaagtacggttcggtaggttaccttaaggtttacttacgttcgttacaacggtacctaaacgtaacttaacttaacctttcgtttaccgttaccttacgtttaccgggacgggtacgggtaacgtaagggtgtagtactaacgaaacgtcgttacggtacgtacgtacgcaccgtatcgttacgttccttagtacc

SEQ ID NO: 65725 - DNA, 582 bp, Homo sapiens
  misc_feature: GYAE6OF02GHTCO.31.78.H01.1.454.CMB.1.raw
  modified_base (333)..(333): a, c, t, g, unknown or other
  misc_feature (333)..(333): n is a, c, g, or t
  modified_base (454)..(454): a, c, t, g, unknown or other
  misc_feature (454)..(454): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggaccccacaataaccaactactagcttggtacagcagaaagtaggacagccctactaaactcctgtacttactcggcttccgtacccgggntacgttcccggggttacctaaccgtattccattcggctaggcgggtactgggaccgtatttccacttctacacctatcagctagcctgcaggtctagaagatggtgactagttactacgtntcgatcaagtatttatactttcttcgtacttaccgtttcgggaccggtacggaacctaagggtcgagtacgtaaccgtaaacgtacttgggcgtcgagtaccacgtattcgtacgttaccttctaccg

SEQ ID NO: 65726 - DNA, 662 bp, Homo sapiens
  misc_feature: GYAE6OF02IAHWO.31.78.H01.1.454.CMB.1.raw
  modified_base (658)..(658): a, c, t, g, unknown or other
  misc_feature (658)..(658): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctctgggcgagacggccaccatcaactgacaagtccagccagtacgttgttttacttcggccccctaaccaaataaccaaccttaacttacgtacgttacggtaaccaggaccaaggaaaacggtagggaccacgtccctaccctaaaactccgttagtacttttaccgtggggtcctttaccgtacccgggtctacggttcccggggtttacctaaccgtactttcacgttggaccgtacggtcggggtcctacggggacccgtatttaccgaccttctacccacctacgtcgacgcacgacctcgacgaggtctagaacgatggtgcttagtttacttactgtcgacgtcaaactattacttacctttcctttgtcttacgtttaccgggcggtaacgggtacgtaagggtgacgacgtaacgaacggtaactggtcggcgtagacctaacgtcttcgtacgttaccttntacc

SEQ ID NO: 65727 - DNA, 628 bp, Homo sapiens
  misc_feature: GYAE6OF02GSPA7.31.78.H01.1.454.CMB.1.raw
  modified_base (554)..(554): a, c, t, g, unknown or other
  misc_feature (554)..(554): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaagtccagccagtagttgttttattcggccccaactaataacaacttacttagcttggtaccagcagaaagtagacagccctactaaactcctagtactttacgtggtaccttacgtaccccgggctacgttcccggggttacctaaccgtattcgagttcggacaggtcgggtctcggggacctattcactctacacatcagcagcctagcacggctagaagtagtacggtcgtactaagttttactactggtacaacgtactaaatacgtttacttaccttttcgtttccgtcttaccgtttcggggaccgggtaacgggtaacctaaggggnggtacacgtacgaaacgtacgttacggtcggaccttggacccttacgtcgttaccgttgttaccttcgtacccg

SEQ ID NO: 65728 - DNA, 767 bp, Homo sapiens
  misc_feature: GYAE6OF02HV0S8.31.78.H01.1.454.CMB.1.raw
  modified_base (523)..(523): a, c, t, g, unknown or other
  misc_feature (523)..(523): n is a, c, g, or t
  modified_base (552)..(552): a, c, t, g, unknown or other
  misc_feature (552)..(552): n is a, c, g, or t
tcagcagtagacgtcacgaccggtgctcgatttagtgtgagtagtttgggggtttgggggagctacaacaggcaggcaggggcagcaagatggtgttgcagacccaggtcttcatttctctgttgctctggatctctggtgccctacggggacatcgtgatgagcctagtttccaagctccctggctgtgtcctgtcgggcgtagacggcccaccatcaaactggacaacgtccaggccaagtagttgtttttaacttcggaccccctaactaaactaaacctaaaccttacctttaaggccgttacggttaacccagtacgaaaggtaaaaacggttacggaactacgacccttaacctaaaaacgttccctaagtacttttaaccgtgggtaccttccggtaacccggctaacggttcccgggtttaccaaaccgttatacgtaacgttggcctaaggtccggggtacgtcggggtaaccctaacgtttaccacgtttacaccgaacctaagtcaacgtcnccggtacctggacgacgcgtacgtaaagngtcgtaggacttagtttaaccgtttcgtcgacttacgaccaaattacttaagtttcccttttacttaccgtacgttaacgttttccgggacggtaaacgggtaaaccgtaacggtcgggaaacggttacttaaaccggaaaacccggttaaattgggtacgggttacccaggttacccaacgttcgtaaccgtttcggttaccctttaggtaccc

SEQ ID NO: 65729 - DNA, 642 bp, Homo sapiens
  misc_feature: GYAE6OF02F9IYO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccacatcaactgcaagtccagccagagttgttttattcggcccccacaataaccaactacttagcttggaccagcaagaaagtggacacgccctacctaaactcctagtatttacgtgggccttccgtacccgggctacgttcccgggttacctaaccggtctttacgagtttcggactacggtcgggtcgtacggggaccctattttccgaacttcctcctaccgattccgagtccagtccctggcgtaacggcttaggaacgtagtggtacgtacttaagttttactacgttagtccaagtacctaagtatttaactctttcgtttccgtactaccggtttcgggacggacggtacgtaagggtcgagtacgttacgaaacggtacgttcgtacggtctaccgacgtaccctagttccgtacgttccgtactaccg

SEQ ID NO: 65730 - DNA, 814 bp, Homo sapiens
  misc_feature: GYAE6OF02HHNFJ.31.78.H01.1.454.CMB.1.raw
  modified_base (194)..(194): a, c, t, g, unknown or other
  misc_feature (194)..(194): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaggggcatcgtgatgagccagtttccagcctcctggctgtgtctctggcagnggccacatcaatgacaagtccagccagtacgttgttttagtcgacccccaactaactaacaactactagtccttaggtaaccagacaagaaacgttaggaaccacgtcctacccgtaaacctcctagtaactttaccgcggtcctttaccgaaccccggggtctaccggttccccgggggtttaccctaaacccggtacttaccgtacgtttacgggcgtaacgggttccgggggttaccggttaccgggggtaacccgttaaccgtttttccgaacccgtttcccgtacccttaaccccgtaagtcccgacggtaccctaaccggtcccgttacggacccgtagggtacccgttaagtaaaggttcgttgggtacggttacgttaaggttttactttacgtcgttacgtaacggtactaaaccgttaatttacctttaaccttttccgtttttaccgttaccgtttaccgggtttccgggtaaccggggtacggttaaccgggtaaggggttacggaagttaaccgtaccgggtaaaaaccgtacggttacgggttacgtaccggtaccgtacccgtaccgttaccgttaccgtttcggtacccttttacgttacccgg

SEQ ID NO: 65731 - DNA, 558 bp, Homo sapiens
  misc_feature: GYAE6OF02FMYHU.31.78.H01.1.454.CMB.1.raw
  modified_base (354)..(354): a, c, t, g, unknown or other
  misc_feature (354)..(354): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
  modified_base (553)..(553): a, c, t, g, unknown or other
  misc_feature (553)..(553): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgttttattcggccccactaataacaactacttagcttggtaaccagacaagaaagtaggacagcctacctaaactcctgtatttactgggcttccgacccggcagtccggggttacctaaccgnttcagttcggacacggtcgggtctaggggaccgtatttcactctcaccatcagcacgctgcnggctgaagngtggtgactagtttactactgtcgagtcaactnttatcctttcgttctcttacgtttcggcgacggtacgtaggtgtagactacgaaaccggtagtggtcggcttaggacctacagttctacgttctnttacc

SEQ ID NO: 65732 - DNA, 699 bp, Homo sapiens
  misc_feature: GYAE6OF02F1VMG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaacgtccagccagtagttgttttattcggacccaccaataacaactactagcttgtaccagacagaaagtaggacagcctacctaaactcctagtactttacgtgggtcctttaccgtacccggggtctacggtttccccggggttaaccctaaccggtacttctagttcggactacgggtcggggtcgtacggggtacccgtacgtttaccactccttaccacctagtaccagcacggcctcggtacgacggctaaggaataggtggtacggacttagttttaacttacttcggtaactacgacgtaaaccttagtttaacttaccttttcgtttaccgtacttacggtttccggggacggtaaccgggaaccggtaagggtagggtacgtaacgttaacccggaaacggttacggttacgggtacggtaccttaggtaccctaaccgtacttcgtttaccggttacttccttacccgg

SEQ ID NO: 65733 - DNA, 640 bp, Homo sapiens
  misc_feature: GYAE6OF02HARFD.31.78.H01.1.454.CMB.1.raw
  modified_base (457)..(457): a, c, t, g, unknown or other
  misc_feature (457)..(457): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagccctacctaaactcctagtatttacgtgggtccttccgtacccgggctacgttcccggggtttacctaaccgtattccagtttcggacacgggtccgggtcgtacggggtaccctattttccacgttcctacaccatcgacgccacgtcctgccaggctagaagtntggtcgacttagtttatacgttgtacagtacaacttatttacttacctttctttccgttacttaccggtttccgggacgggtaacggtaaccggtaagggtcggaacgtaacgtaaccgtaaacggtacgttacgggtacgtaccgtagacccaccgtagttcgttacgttccttactacccg

SEQ ID NO: 65734 - DNA, 701 bp, Homo sapiens
  misc_feature: GYAE6OF02JEEXG.31.78.H01.1.454.CMB.1.raw
  modified_base (248)..(248): a, c, t, g, unknown or other
  misc_feature (248)..(248): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctagggacagtcgtgatgagcctagtttccagactccctggctgtgtctcgtgggcgagaggccacatcaactgcaagtccagccagagttgtttattcggccccaanaactaacaactactagcttaggtaccagcagaagtagacacgcctactaaactcctagtatttacgtggcttccgacccgggctaacgtcccgggttacctaaccgtattccgagtttcggcaggtccgggtacgtcgggaacctactttcgacctcttaccaaccctataccgacggcacgtcctcgacgtacggtcgtaggtaaagtacgttcgggtagggtaaccttaggttttaaaccgttacgttacggttccgtaaacgtacctaaacgttaatttaacttaaccttttccgtttaccgttaccgttaccgtttaccgggaacgggttaacgggtaacctaagggggtcgtaacgtacgtaaccgtaaaccgggtaacgttcggttaacgggtccttaacgggacctaacccttagttacccgtacggtttacccttacgttacccg

SEQ ID NO: 65735 - DNA, 616 bp, Homo sapiens
  misc_feature: GYAE6OF02JRITE.31.78.H01.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
  modified_base (340)..(340): a, c, t, g, unknown or other
  misc_feature (340)..(340): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (564)..(564): a, c, t, g, unknown or other
  misc_feature (564)..(564): n is a, c, g, or t
  modified_base (595)..(595): a, c, t, g, unknown or other
  misc_feature (595)..(595): n is a, c, g, or t
  modified_base (606)..(606): a, c, t, g, unknown or other
  misc_feature (606)..(606): n is a, c, g, or t
tcagcagtagacgtcacgaccggtgctcgatttagtgtgagtagtttgggtttgggggtaggcgtacaacaggcaggcaggggcagcaagatggtgttgcagacccaggtcttcatttctcttgttgctctggatctctggtgcctacggggacatcgtgatgacgccagtttccagactccctggctgtgtctcgtgggngagngggccaccatcaatcgcaaggtccagcccagattgttttattcggccccaacaataacaacgtactagcttggaccancagaaagttggacagtcccctaccgtaaacncctagtactttacgtgggaccctttnttaaccggcggacaacgttccccggggttacctaaacgtctttcagtttcgggaccaacggtcgggttctacggggaccctntttaccgaacctntcccgactatccgaagtcacgcctagcaacgcgtaggatacgtgtgactttgttaattcgtnacgtanacctaatcgtttaatcctttctttcgccctttagtacgggtccggaacggtagtaacgggngtacgactaacgtaacgtacgtgtacgcgtnaccggtcactntcgttcgtac

SEQ ID NO: 65736 - DNA, 835 bp, Homo sapiens
  misc_feature: GYAE6OF02H6NWC.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagacctcctggctgtgtctcgtgggcgaggacggcccacgactacaaacgtcgactaacgtccacgaccgaagtaggtttagtttttacgttccggacccccaaactaaactaactaaaccttacttacgtcgttacggtaccagacgaaagtaaaggtacggaactacggtacccttaaccctaaaacgttccgttagttaacgtttaaccggtcggttacctttaccggtaaccccgggtnttaaccgggttaccccggggttttaaccctaaaccggttagtttaccgtaagtttccggaccgttaacggggttccggggtacgttaccgggggaacctttaacgttttacctaccgttacctaacccgaccttacgtacgaacgtccgaacgtccgtcgacggtacgacgtaggaagttggtacggtgtacgttaacggtttacttacggtacgtacgtacgtaactaaacgtttattttaaaccgtttacctttcgttttaacccggacgtttttaccggtaacggggtacccgggtaaaccggtacggttaagggacgggtaataaccggtaaccggaaaccggttacggttacggccggttacgaccggtaccgtaacccgttcgttcggtttaccgttaccccgtatttaacccccgg

SEQ ID NO: 65737 - DNA, 758 bp, Homo sapiens
  misc_feature: GYAE6OF02HPY9E.31.78.H01.1.454.CMB.1.raw
  modified_base (229)..(229): a, c, t, g, unknown or other
  misc_feature (229)..(229): n is a, c, g, or t
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggaggccacatcaactgacaagtccagccagngttgtttattcggcccccaacaataaccaacttacttagtcttacggtaaccagtacaagaaagtggacacggtcctacctaaacgtctaggtaactttacgnggtacttaccgtacccgggctaacggttcccgggttaccctaaaccggtatttccgagttcggccgagggtccggggttctcggggtacctactttcgaacctcctacacccgtataccgacggacctagccctaggaccgtagggtacctaggtaaacgagttagggtacgtacgttaagttttactttaacccgtggttaacctaacggtccctaaaacgttactttaacgttttacccttttaccgtttaccgtttacttaaccgggtttccgggaaccgggttaaacggggtaacccgttaaagggggttacgggtacgtaaaccggttaacccgttaaaagggtaaccgtttagggtacccgggtacttaacggtaccctaaccggtacttacccggtacgttttaccctacggttaaccc

SEQ ID NO: 65738 - DNA, 690 bp, Homo sapiens
  misc_feature: GYAE6OF02HUO2Y.31.78.H01.1.454.CMB.1.raw
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagcctccctggctgtgtctcgtgggcgaggacgggcccaccatacaactgacaagtccagccagtagttgttttacgttcggaccccaactaaataacctaaaccttacttacgtcgttaggtaaccagtacaagaaagtacggacacgcctaacctaactcctagtacttacgtcggtccttccgtacccggntacggtcccgggttacctaaccgtattactagttcggcgtacggtcgggtcgtacgggtaccctatttccgactcctaccacctatcgacgccgacgccgtcgacgagtcgtagaacgtagtggtcggtacttaagttttacttacgtacgtaccgaacgactaaacttatttaacctttacctttccgtttaccgttacgttaccggtttacggggtaccgggtaacggtaacgtaagggtcgaacgttacgtaaccgaacgtaacgttcggtcggtacttacggacctactacgtttaccgtcgtttactaccgttacccg

SEQ ID NO: 65739 - DNA, 646 bp, Homo sapiens
  misc_feature: GYAE6OF02FRBFY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactactagcttgtaccagcagaaagtaggacagcctacctaaactcctgtatttactgggtcttaccgtacccgggctacgttcccggggttacctaaaccggtattccgatttcggactaggtccgggttcgtaggggacccgtattttaccaacttctaccaaccctatccgaagccacgtcctgccacggtactagtaaagagtggtcggacgtagtttacttactgtcagtactaacgtaatttacttactttctttcgttacctacgtttaccgggacggtacggtaaccgtaagggtacggagtaacgtacgtaaacggtaacgttacggtacggtacttacggacctaaccgtacgttccgtacggttaccttacgtacccg

SEQ ID NO: 65740 - DNA, 819 bp, Homo sapiens
  misc_feature: GYAE6OF02IBB1B.31.78.H01.1.454.CMB.1.raw
  modified_base (385)..(385): a, c, t, g, unknown or other
  misc_feature (385)..(385): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcccgtacggggacatcgtgatgagccagtttccagcctccctggctgtgtctcgtgggcgaggaggcccacatcaactgacaagtccagccaggtacgttgtttttacttcggacccccaacaaataacaaactattagcttaggaccagcaagaaagtaggacacgcctaccctaaactcctagtactttacgtcgggtcttaccgacccgggtactacgttccccggggttacctaaaccggtnttaccgtagttacggccgtagggtccgggtcgtacggggaacccgttatttaccgacttacctaccgtaaccctagtccgaagcccgtaacgtccgttcggaccgtaacgggtccttaagggaaacgtagttacgggtagggtactttaacggttttaacgtttaccgttgtaccgtaaacggtacctaaaacgttagtttttaaccgttaacctttttccgtttaaccgtttacccgttaacccgggtttttacgggggaacccggggttaaacgggggaaacccttaaacgggggttacgggtaacgttaaaaccgttaacccgggtaaaaaccggttaaccggttcgggtaacccgggttaccctacgggtaaccctaaacccggttacgtttacccggtttacgtttaccccggtttacttaacccccgg

SEQ ID NO: 65741 - DNA, 613 bp, Homo sapiens
  misc_feature: GYAE6OF02F5FPK.31.78.H01.1.454.CMB.1.raw
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
  modified_base (478)..(478): a, c, t, g, unknown or other
  misc_feature (478)..(478): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtggcgagaggccacatcaactgcaagccagccagtagttgttttattcggaccccacaaataaccaactactagcttggacngacaagaaagtaggacagcctaacctaaactcctagtactttacgtcggtccttacgtacccgggntaccgttcccggggttacctaaccgtattcagttcggactaggtccgggtcgtagggacctatttcactctccaacctatccgagtccacgtcctgcgaggctagaaagtgtggtcgtactaagtttatacgttgacanaacgtaactatttactactttcgtttacgcgttaccggttgggaccggaagggtaccgtaagggtcggagtaacgtacgtaaacgtaacgttcgtacggactacgacgaacctagtaccttgttacctatacccg

SEQ ID NO: 65742 - DNA, 708 bp, Homo sapiens
  misc_feature: GYAE6OF02HX1UB.31.78.H01.1.454.CMB.1.raw
  modified_base (318)..(318): a, c, t, g, unknown or other
  misc_feature (318)..(318): n is a, c, g, or t
  modified_base (342)..(342): a, c, t, g, unknown or other
  misc_feature (342)..(342): n is a, c, g, or t
  modified_base (678)..(678): a, c, t, g, unknown or other
  misc_feature (678)..(678): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtcagccagatgttttattgccccaacaataacaactacttagcttggtaccagcagtaaaagtggacagacctacctaaaactcctagtaatttaaccncgggtctttccgtaaccccgggtntaacgttccggttacgggggtttacccctaaaaccggtattttccgtaaacgtttcggggacctaacggggtccggggttaccgttacgggggtaaccccgtaaagtttttccaaacccgtttcgtacccgtaaccagttacccgaacggtccaacggtccctagggtaccaagggccttaacggaaaagtacgttgggtacggtacttaaggttttttaactaacgttcgtacgaagcctaaactactttaataccttttctttccgtacttaccgtttcgggacggaagggtaaccgaagggtggaacgtactaacgaaacggtctaggtcggntacgactaacccgattcgttactcttaccg

SEQ ID NO: 65743 - DNA, 657 bp, Homo sapiens
  misc_feature: GYAE6OF02FWBQ7.31.78.H01.1.454.CMB.1.raw
  modified_base (341)..(341): a, c, t, g, unknown or other
  misc_feature (341)..(341): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagtagttgttttattcggccccacaataacaactacttagcttggtaccagcaagaaagtaggacacgcctacctaaactcctgtactttacgtgggtcttcgtacccggggntacgttcccgggggttacctaaaccgtattcgaagttcggcctaggtccggggtctacggggacccgttatttccgaaccgttcgtaccaaccgtatcgacgtcacgtcccgtgacgacggtctaggaaagagttggtcggtacttaggttttactacgttcgtacgaagtccaaacttagtttaattaccttttacgtttaccgttacgttaccgtttacggggaccggtagggtaacccgtaaggggtcgtacgtagtaaccgaaacgtaccgtggtacggctcgaccaccgtattcgtcgttacttcgtaccc

SEQ ID NO: 65744 - DNA, 688 bp, Homo sapiens
  misc_feature: GYAE6OF02GX631.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataaccaactacttagcttggtaccagcaagaaagtaggacagcctacctaaactcctagactttacgtgggccttccgtacccggggctacgttcccggggttaccctaaccggtattcagtttcggcacgggtcgggtctggggacccgtattttccacgttcctaccaaccgattccgaagccacgccctgaccgaggtcctaggaaacgattacgggtcggaccgttaaggttttaactttacgttggtactaacggtacctaaactattttaacttaccttttcgtttttaccgtaccgttaccgttttaccggggtaccgggtaacgggaaacccgttaagggtcgggaagtacgtaaccggtaaaccggtaaccgttggtacggtaccgttaggaccctaccgtacgttccgttacggttccttactaccg

SEQ ID NO: 65745 - DNA, 810 bp, Homo sapiens
  misc_feature: GYAE6OF02HRBNQ.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaacgtccagccagtagttgttttattcggaccccaacaaataaccaactacttaagcttaggtaaccagcaagaaagtaggacacgcctacctaaacctcttaattacgtgggtacttccgacccgggntacgtcccggggttacctaaccggattcgtagttcggactacgggtccgggttacgtacgggggtacccttaatttcccgaaccgttcctaaccctaacccgtaagttacccgaagggtaccctaaccggtcccctaagggtacccgtacggggtaccgttaggtaaaacggtagttacgggtcgggtaaccgtttaaggtttttaaactttaccggttcgttaaccgaacggtaacctaaaactttaagtttaactttaaccgtttttcccttttacggttacccgttaaccggtttccgggggaacgggttaaaccggggtaaccgtaaaagggggttcgggaacgtaacgttaaacccggtaaaaacgggtaaccgttacgggttacgggtaccgttacgaacccgttaaccgtaaccgttaccttaccggtttaccttacgtaaccctttaccccgg

SEQ ID NO: 65746 - DNA, 661 bp, Homo sapiens
  misc_feature: GYAE6OF02GXS5G.31.78.H01.1.454.CMB.1.raw
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggaggccaccatcaactgacaagtccagccagtagttgttttacttcggcccccaactaataaccaacttacgtagcttggtaccagcaagaaagtaggacagcctacctaaactcctagtactttacgnggggtccttccgtacccggggctaacggttcccggggtttaccctaaaccggtattccgaacgtttggccgaggtccggggttctacggggtacccgtattttccgacttctccgaaccatccaggccacgcccgtgcgacggctacgaagtagttcggtacggtacttaaggtttactttacgttcgtacgacgtacctaacgttaatttaacttacctttcttttccgttaccgttacgttttcgggacgggtacggtaacctagggtaggacgtagtaccgaaacgtacgttgtcggtacgtacgacactagtcgttacgtcttactacg

SEQ ID NO: 65747 - DNA, 538 bp, Homo sapiens
  misc_feature: GYAE6OF02FR0YK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggctttctaccccgggcacgttcccggggttcctaaccgattcattggcagcgggtctgggaccgtatttcactctcaccatcagcagcctgcaggctgaagatgtgctagtttatactgtcagcaactattatactttctttcgtctacgtttcggcggaggtaccgtaagggtggagatacgaaacgtaacgtggtaggtctgacaccgtatctgttcctctac

SEQ ID NO: 65748 - DNA, 722 bp, Homo sapiens
  misc_feature: GYAE6OF02JCVDZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctccctggctgtgtctcgtgggcgaggacggccaccatcaactgcaacgtccagccagtagttacgtttttacgttccggacccccaactaaataacctaacttaacgttagcgttacggtaacccaggtacaaaggtaaagtacggactacgtaccctacctaaacgtcctagtactttacgcggtccttaccggtacccgggataccggttacccgggttaccctaaaccgtattaccgtaacgttcggaccgacgggtcggttcgtacgggtaccgttatttccgaccttctaccgaacctagtacgacgacgtacgtcctacgacgtacggtactaggaacgtgttacggtcgtacttaaggtttaactacgtcgtaccgaacgtacctaaacgtttacttaccgtttaacctttccgtttactacgttaccgggttcggaaacggtacgggtaacgtagggttacgtagaacctaaccggtaaacggtagtcggtcgtactaccgtaacaccgttacgtacttcgttacctacttaaccg

SEQ ID NO: 65749 - DNA, 681 bp, Homo sapiens
  misc_feature: GYAE6OF02GHUUZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagagttgttttattcggaccccaaccaaataaccaactacttagcttggtaccagcaagaaagtaggacacgcctacctaaactcctagtactttacgtgggtccttccgtacccgggctacgttcccggggttacctaaccgtacttcgacgttcggacaggtccgggtcgtacgggtaccgtagttttccacgttcctacaccataccagtcacgccgtgaccgtaggtcgtaagaagtagttggtcggtacgttagttttaactacgttcgtacgaacgtacctaactaactttaactttaccttttccgttttacgttaccttacggttttccgggaccgggtaacgggtaaccgttaacggggtaggtacgtacgttaaccgaaaccggttaacgttgggtacgtacgtcggacctaccgttattccgttcgttacttcttaacccg

SEQ ID NO: 65750 - DNA, 837 bp, Homo sapiens
  misc_feature: GYAE6OF02IJ907.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctgtgggcgaggacgggccaccatacaactgacaacgtccacgccgagtagtttgtttttacgttccggacccccctaacctaaaattaaacctaaaccttaactttaacggccgtttacggtaaccaggtacaaaggtaaaaggtaacggaccaacggtccctaacccttaaaacctccgttagtacttttaccggtgggtcctttcgtcggcccgggtactaccggttcccggggtttaccctaaccgtacttaccgtagtttcgggcgtacgggtccggggttccggtacggggtaccttacgtttaccgacctttcccgtaccgtaaccctagttcccgaacgtaccgtaccggtcccgttacggaccggaacggtccgttaaggaaacgttacggttgggtaccggttaactttaacggtttttaacttacgttacgttaccgtaacgtaacgttaaacttacgttttaactttaccgtttttccgttttaccgtaccgtttaaccggttttcggggaaccgggtaacgggtaaccggttaaggggtaccggtaacgtaaccgttaaaccgtaaaccggttcggtaggttaccggtaccttaccggacctaccgtttacgttccgtttacgttaccttaccg

SEQ ID NO: 65751 - DNA, 602 bp, Homo sapiens
  misc_feature: GYAE6OF02ILHW6.31.78.H01.1.454.CMB.1.raw
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggcccaccatcaactgcaagtccagccagagttgttttattcggccccacaataacaactacttagcttggtaccagcagaaagtaggacacgcctacctaaacttcctagtatttacgnggtccttacgtaacccgggctacgttcccggggttacctaaccgtattcgattggcaggtcggtctcgggactattcactctacaccatcagcacgcctgacgtaggctagtaagagtcggtggtacgtagtttattacgtgtacgagacctaaacttattacttactttcctttcgacttaccgttacggacgggtaacggtacctagggtagagtaactacgtaaagtaccgttggacgtccttacgacctacctacgttgttcttacttactacccg

SEQ ID NO: 65752 - DNA, 776 bp, Homo sapiens
  misc_feature: GYAE6OF02GN2T5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcgccccacaataacactacttaactggtaccagcaagaaagtaggacagcctacctaaactcctagtatttacgtgggctttcgaccccgggctacgttcccggggttacctaaccgtatttaccgagtttcggacctagggccggggttacgtacggggaacccgtatttccgacttcctaccgaaccctaacttcccgaacggtccacgtccctcggaccgtacgggtaccctaggaaaacggtagttacgggttacgggtaccgttaaggttttaacgtttaaccgttacgggttaccgtaacggtacctaaacgttaacgttttaacgtttaaccttttccgttttaccgttaccttaaccggtttttacccggggacgggttaaaccggggtacccgtaaaggggttacggtaacggtaacgttaacccgtaaaacggtaaccggtttacggggtacggtaccggttacgtacccgtaacccgttacgttcccgtttacgtttacccgttaccttaccgtttaccccccgg

SEQ ID NO: 65753 - DNA, 623 bp, Homo sapiens
  misc_feature: GYAE6OF02H5D2Y.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgttacggggacatcgtgatggagccagtttccagacctcctggctgtgtctcgtgggcgaggacgggccaccatcaactgcaagtccagccagacgttgttttattcggccccaactaataacaacctacttaagcttcggtaccagacagaaagtaggacagcctcctaaactcctagtattactgggtcttcgtaccggggctacgtccggggttacctaaccgacttcagtttggcacgtcgggtctgggaccgtctttacacttctacaccactcacgcacgcctgacacggctaggaagtagtcggtacggcttaagttttattacgttgtactagtaccaacgtattacttactttccgtttccgttccttaccgtttcgggacggtacgggtaaccagggtacggagtacgtaacgtaaacggtacgttagggtacgtcgtgaccttacgacttaccgttgttccgttactaccg

SEQ ID NO: 65754 - DNA, 678 bp, Homo sapiens
  misc_feature: GYAE6OF02HY1CR.31.78.H01.1.454.CMB.1.raw
  modified_base (329)..(329): a, c, t, g, unknown or other
  misc_feature (329)..(329): n is a, c, g, or t
  modified_base (380)..(380): a, c, t, g, unknown or other
  misc_feature (380)..(380): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggcccaccatcaactgcaagtccagccagagttgttttattcggacccccacaataacaactacttagcttacggtaccagacaagaaagtaggacacgccctacctaaactcctagtatttacgngggtaccttccgtacccgggctacggttcccggggttaccctaaaccggtnttaccgagtttcggctacggtccgggtcgtcggggaccctatttaccacctctaccaacctatcacgccacgcctgcgaggctagaagtatggtgtacttagtttattacgtgtacaagtaccaaacttattaacttacctttccgtttaccgttcttaccggtttcgggacgggtaacgggtaacccgtaaggggtacgtaacgtaacgtaaccgaaaacggtaccgttagggtaccggtaccgtacggtaccctaacccgtagttacccgttacgtttacccttaccgttaacccg

SEQ ID NO: 65755 - DNA, 564 bp, Homo sapiens
  misc_feature: GYAE6OF02FIMSA.31.78.H01.1.454.CMB.1.raw
  modified_base (534)..(534): a, c, t, g, unknown or other
  misc_feature (534)..(534): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggaccaccatcaactgcaagtccagccagagttgttttattcggccccacaataacaactacttagcttggaccagcaagaaagtaggacagcctacctaaactcctgatttacgtgggtctttccgtaccccgggcacgttcccggggttaccctaaccggtattcagttcggctaggccgggtcgtggggtaccctatttcacttctcaccatcacgcacgcctgcaggctagaagtatgtggctagtttatacgtgtcagcaatattatactttcgttctctacgtttcggcggtacggaccgtaggtgagacgtacgaaacgtagttcgnggtctggacctaccatcgtgtccttctacg

SEQ ID NO: 65756 - DNA, 781 bp, Homo sapiens
  misc_feature: GYAE6OF02HF8NH.31.78.H01.1.454.CMB.1.raw
  modified_base (437)..(437): a, c, t, g, unknown or other
  misc_feature (437)..(437): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaagtcccagccgagagttgttttattcggaccccaacaataacaactacttagcttacggtaccagacaagaaagtaggacagaccctacctaaactcctagtacgtttaacgtgggtcctttaccggacccgggtctaacggttcccggggttaccctaaaccgtacttcgaacgtttcggacgtacggtccgggttacacggggtaaacccgttntttcccaacttccgtaacgtaaccctaacgttccaacgtccgaacgtcctacggacagggtccttacggaaaggtagttacggtacggttaccgttaaggttttaaccgttttagtaccgttacgaacgtacctaaacgttaacttttaaaccgtttaccttttacggtttttacccgtaccgttttaaccggtttttaccggggaaccgggtaacgggaaacccgttaaggggtacggacggtaaacttaaccggaaaacggttaaccggttcggtaacggtacccgtacgtacccgtaaacccgtcgttttaccggtaccggtttctaacccgtttaacccg

SEQ ID NO: 65757 - DNA, 624 bp, Homo sapiens
  misc_feature: GYAE6OF02H0QPX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtgccgtacggggacatcgtgatgagccagtttccagacctccctggctgtgtctctgggcgagagggccaccatccaactgcaagtccagccagagttgttttattcggccccacaaataacaactacttagtccttggtaccagacaagaaagtaggacagccctacctaaactcctagtatttacgtcgggtacttcctacccggggctacgttccggggttacctaaccgtattcagttggctacggcgggtcgtcgggacgtattcgactctacacctatcacgcacgcctcgcgtacggctagaagactggtcggactagtttactactgtacacgacaactattacttactttacttcgtacttacgtttacggcggggtacggaaccggaagggttaggacgtacgtaacgaaaccggtacgtacggtaggtaccgtacggtccctaaccgtacttccgtacggtttcttacccttacg

SEQ ID NO: 65758 - DNA, 682 bp, Homo sapiens
  misc_feature: GYAE6OF02FZDYR.31.78.H01.1.454.CMB.1.raw
  modified_base (383)..(383): a, c, t, g, unknown or other
  misc_feature (383)..(383): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtggcgaggacgggccaccgatcaactgacaacgtccagccagtagttgttttattcggaccccaacaataacactactagcttacggaccagcgaagaaagtaggaccagaccctactaactcctagtactttacgcggtccttacgacccggtctacgttcccgggttacctaacgtcttcgagttcggcnggtcggttcgtacgggacctacgtttccacgtctaccaacctactcgacgactacgccctcggacgtaggcctaagaacgtacgtggtacggtactttaggttttaactacgtttaggacctagtaacctaacgttaacgtttacctttacgtttcccgtttacgttaccgttaacggttttccggggacgggttaccgggaacggtaagggtacgtaacgtaaccgtacgtaaaaccggtacttacggtccggtacgttacgacctacggtacttacgtaccgttacgtccttacccg

SEQ ID NO: 65759 - DNA, 699 bp, Homo sapiens
  misc_feature: GYAE6OF02GCU8B.31.78.H01.1.454.CMB.1.raw
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggccccacaataacactacttagcttggtaccagcaagaaagtaggacagcctaccgtaaactcctgtactttacgtgggtccttacgtacccgggctacgttcccggggttacctaaaccgtnttcagttcggacgtaggtcgggttcgtcggggtaccctattttaccacttcctaccaacctagtccgacgccaacgtccctacgtcgacgggtaccgtaaggaaagtacgttgggtacggtacttaaggtttttaacttacgttcggtaccgtaaacggtactaaacgtatttttaacgttaccttttccggttttaccgttccgttacggttttccggggaccgggtaacgggaaccggtaagggtacggtagaacgtaccgaaaacgtacggttgggtacggtccgttaggacctaccgtacgtttcgtaccggtttactacgttacccg

SEQ ID NO: 65760 - DNA, 600 bp, Homo sapiens
  misc_feature: GYAE6OF02IX6J9.31.78.H01.1.454.CMB.1.raw
  modified_base (462)..(462): a, c, t, g, unknown or other
  misc_feature (462)..(462): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgacaagtccagccagtagttgttttattcggaccccaacaataacaactacttagcttggtaccagacagaagtagacacgcctacctaaactcctagtatttacgtgggtccttaccgtacccgggctacggttcccggggttacctaacggacttacgattcggcgacggtcgggtctcgggtaaccgtatttccactcctaccaccactcagcacgcctgcgaggctagaagagtgtagtnttaagtttatactcgtcagtacaactattacttactttctttcgtacttacggttaccgggacggtacgggtaccgaagggtacgtagactaacgaaacggtactggtggtactgaccactcgtctcgttctacgtcc

SEQ ID NO: 65761 - DNA, 707 bp, Homo sapiens
  misc_feature: GYAE6OF02F1JQQ.31.78.H01.1.454.CMB.1.raw
  modified_base (445)..(445): a, c, t, g, unknown or other
  misc_feature (445)..(445): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggctgtgtctcgtgggcgaggacgggcccacatcaatgacaagtccagccagtagttgttttattcggacccacaataacaactacttagcttgaccagcaagaagtagacacgtcctacctaaactcctgtacttacgtcgggtcttaccgtacccgggactacggtttcccggggttacctaaccgttacttctagttggacctagggtccgggttcgtacgggggaccttagtttccacttcgtaccactactccganccgtagccgtcggtacgacggtcgtaggaagtcgtcggtggacttaagtttacgtacttggacacgtactaaacttatttacttacgttttactttacggtttaccgttaccggttttaccggggaaccgggtaacgggtaaccggttaagggtaacgggtacgttaaacgtaccggtaaaaccgtacggttaacgggtaccggtccgtaacgggtaccctaaccgtaccgttacctttacgtttaccgtcccttaacccgg

SEQ ID NO: 65762 - DNA, 829 bp, Homo sapiens
  misc_feature: GYAE6OF02HYPOP.31.78.H01.1.454.CMB.1.raw
tcagcagtagacgtcacgaccggtgctcgatttagtgtgagtagtttgggtttgggggagctacaacaaggcaggcaggggcagcgaagatggttgttgtagacccaggtacttcatttcgttctgttgctctggatctctcggtcgccgttacggggactagtcgtgatgagccagtttccagaccttccctaggtctgtgtctcgtagggcgagacggccaccatccaacgtcgcaagtccaagccagtagtgttttatcggacccactaataacaactactagacttcggacctagctaagaaacgtaggactacgcctacttaaaactccgttagtactttaccgtggggtaccctttccgtaccccggggtctaccggttccccggggtttacctaaccggtattccgagttcggtacgtagggtccgggttacgtggggtacctacttttccacccttaccgtacaaccgtacttaccgagtaccgtacggtacccgttagaccgtagggaacgttaggaaacggttcgttaggtacgggttaaccttaaggtttttaacttaccggtttcgttaaccgtacggtaaccttaaaccgtttaactttaaacctttaccgttttacccgtttaccggtttaccttaaccggtttttacccggggaaccggggtttaaccggggtaaacccgtaaaggggttaccgggtaaacgggttacgttaaccggtaaaacggtaaaccggtttacgggtaccggtacgttacggacccgttaccgaacgtttcccgttaacggtttccttttaccggtacctttaccccgg

SEQ ID NO: 65763 - DNA, 702 bp, Homo sapiens
  misc_feature: GYAE6OF02GXVV3.31.78.H01.1.454.CMB.1.raw
  modified_base (325)..(325): a, c, t, g, unknown or other
  misc_feature (325)..(325): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaagtccagccagtagttgttttattcggccccaacaataacaactactagcttgtaccagcaagaaagtaggacagccctacctaaactcctagtaactttacgngggtccttccgtacccgggctacggttcccggggttaccctaaccggtattccgtagtttcggacgtacgggtccgggttcgtacggggaccgtattttccgacttcctacctaacctatccaagtccacgtccgtcgaccgtaggtcgtaggaaagtcgttacggtcggtacttaaggttttacgttacgttacgtacgtaacgtaccgtaaacttagtttaacgttaccttttacgtttaccgttaccgttaaccgttttcgggaaccgggtaagggttaacccgaaggggttacggacgtaagtaaccggtaaaacgtacgttcgggtacggtacgtacgacctaccgtagttcgtacgttccgttactacccg

SEQ ID NO: 65764 - DNA, 688 bp, Homo sapiens
  misc_feature: GYAE6OF02H060S.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagcctagtttccagacctcctggctgtgtctcgtgggcgagacggccaccagtcaactgactaagtccagcagtagttgtttacgtccgacccaacgtaactaacctaacttacgttacgtcgttacggtaccagacgaaagtaagtacggacacgtacctaaccgtaactccgtagttactttacggtcggtaccttacccggtaccggtacgtacccggttaccgggttaacctaaccgtacttacgtacgtcggcgtacggtccgggtacgtacgggtaaccgttcttacgtacctccgtaccaccgtacgccgacgtaccgtacgtaccgtcggacggtacggtccgtaaggaacgtaggttacggtcgttacgttaagttttacgtacgtcgttaacacgtactaaagttacttaacctttactttccgttcgtacgtaccggttcggaacggtacgacggtagcagtaccgtaacgaacgtcgtggtacgtctacgactacgtacgttcgtactccgtatcccg

SEQ ID NO: 65765 - DNA, 711 bp, Homo sapiens
  misc_feature: GYAE6OF02GG8FG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaacgtccagccagtagttgttttacttcggaccccaccaataacaactacttagcttggtaccagcaagaaagtagacagccctacctaactcctgtatttacgtgggtcttaccgtacccgggactacggttcccggggttacctaaccgtacttctacgttggcacggtcggggtctacggggaccctactttcactcctaccaaccatcagaccacgccgtgccgtaggccgtagaacgtagttcgggtacggtacttaacggttttaacttacgtacgttacgaaccgtactaaacttagtttaacctttaccgttttaccttttacccgttaccgttaccggtttaccggggtaccgggtaaacgggtaacccgtaagggtacggttaacgaacttaaccggtaaaaacggtacgtttacgggtaccggtaccgttcggtacccgtaaccgtacctttacgttaccgtttccttacccgttacccg

SEQ ID NO: 65766 - DNA, 741 bp, Homo sapiens
  misc_feature: GYAE6OF02ICULO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagtagttgttttattcggaccccactaataacaacttacttagcttacggtaccagacaagaaagtaggacacgtcctaccctaaaccttcctagtaatttacgtgggtcttccgtacccgggctacgtccccggggtttacctaaccgtattccgaagtttcggaccgtaggtccggggtcgtacggggacccgtatttccgaacttcctccaaccctatccgtacgactacggtcctacgccgagggtacctaggaaacgtagttggtacgggtacctaagttttaacgtaccgttagtaccgtaagacctaaaacttagtttaactttaaccgttttcgttttaccgttaccttaaccgggtttcgggtaaccgggtaacgggtaaacccgtaagggggttacggtaacggtaacgttaaccggaaaaccggttaaacgttcgggtaacggttactaccggtacctaaccgtagttacccgttacggttttacccgttccgttaacccg

SEQ ID NO: 65767 - DNA, 574 bp, Homo sapiens
  misc_feature: GYAE6OF02GHRAY.31.78.H01.1.454.CMB.1.raw
  modified_base (452)..(452): a, c, t, g, unknown or other
  misc_feature (452)..(452): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggccccacaataacaactacttagcttggtaccagcagaaagtaggacagcctacctaaactcctgatttacgtgggcttcgtacccgggcacgttcccggggttacctaaccgtattcattggcaggcgggtcgtgggaccgtatttcactctcaccatcagcagcctgcaggctagaagtagtgtggctagtttacttaccgtgtanacgactaactatttactactttcgttcctcttcgttcggacgggtacggaacgtaggtacggactacgtaaccgaaacgtacgtggtcgacgtcgacctacgtattccgtacttctactccg

SEQ ID NO: 65768 - DNA, 781 bp, Homo sapiens
  misc_feature: GYAE6OF02GSBP1.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtcttcatttctctgttgctctggattctctggtgcctacggggactatcgtgatgagcctagttccagactccctggctgtgtctcgtgggcgaggcgggccaccatcaacgtcggccaagtccacgccagagttgtttttacgttcggaccccctaacctaattaaaccgtaacttaacgttaagtccgttacgggtaacccaacgtactaaggaaacggtaagggacctacggtacccttacctaaacctccgttagtaagttttaaccggtgggtaccttaccggtaccccggggtcgtaccggttacccggggttacccttaaacccggttacttaccgtacggtttacgggaccgtaacgggtccgggttaccgtacggggtacccgttacgtttacccgaccgttccgtacccgtaccctacgtaccgaacgacctaccgtcccgtaggaccgggtacggtccgtaaggaaacgttaacgtcggttaggtaccttagtttaacgttaccgtgtaccacgacctaattacgtttactacctttcgtttaccgtacctccggtttaccgggacgggtacggtaacggttaagggtcgagtacgtaaccgaaagtacgtaggtacggtccgtacggacccgtcgttacgtcgtacgttccgtacgttcccg

SEQ ID NO: 65769 - DNA, 857 bp, Homo sapiens
  misc_feature: GYAE6OF02FKZ7R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgtttattcggccccacaaataaccaactacttagcttgaccagcagaaagtaggacacgcctacctaaactcctagtatttactggggtctttccgtacccgggctacgttacccgggggttaccccttaaaccggtacttaccgtacgtttcggaccgtaacggtccgggggttaccgttcgggggtaaaccccggtacgtttttacccgaaccgtttcccgttaacccaaacccttaaccgttacccgaacgtacccgtaacccgtaccccgttggaccccgtaacgggtacccgttaagggtaaaacggttaacgtttagggttccgggtaaccgtttaacggtttttaaacgttttacccgtttcggttaacccgtaaagttaccctaaaaccgtttaaactttttaaccgtttaaaccttttttacccgtttttaccggttaacccttaccgggttttttacccggggtacccggggtaaaccgggttaacccggttaaaggggttacggtacggtaacgttaaccggtaaaaacccggttaggttaccgggtaacggtaccgtaccggtaccgtaacccgttaaccgtttcggtaccgtttaccttaccgttacccg

SEQ ID NO: 65770 - DNA, 681 bp, Homo sapiens
  misc_feature: GYAE6OF02F0B96.31.78.H01.1.454.CMB.1.raw
  modified_base (373)..(373): a, c, t, g, unknown or other
  misc_feature (373)..(373): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacgggcccacatcaactgacaacgtccagccagtagttgttttattccggaccccaacaataaccaactacttagcttggaccagcaagaagtagacagcctaccgtaaactcctgactttacgcggtcttccgtacccgggctacggttcccgggttacctaaccgtnttccgagttcggcgtacggccgggtacgtacggggaccgtactttccactctaccaccctatacgacgacacgccctacgcgtacggactaggaagtacgtgtacggtacttaagtttacgttaactcgtacaacgtacgtaaacttatttaacttacgttttccgtttacttaccgtttacgttccggggaccgggtaacgggttaaccgtaagggtcggtacgtactaaaccggtaacggttaaccgtagggtccgtacgttagtacccgaacgtacgttcccgttcgttaccttaccgtaccccg

SEQ ID NO: 65771 - DNA, 637 bp, Homo sapiens
  misc_feature: GYAE6OF02H1GFK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaacgtccagccagagttgttttattcggcccccacaaataacaacttacttagcttggtaccagacaagaaaagtaggacagcctacctaaacctcctagtattacgtgggccttcgtaccgggcacgtccgggttacctaaccgattcagttcggcacggtcgggtccgtgggaccgtatttccactcctaccaccatccaacgcctagcccgtgacgtaggactaggaaagtacgtaggtacggtactaggttttaacttacgttacgtaccagaccaaacttacgtttaacttaacctttctttaccgttacgtaccgttttaccgggacggggtaacggtaaccgaagggttagaacgtaactaacgaaacgtatggtggtactgaccactacttctacgttactttactcccg

SEQ ID NO: 65772 - DNA, 627 bp, Homo sapiens
  misc_feature: GYAE6OF02GAL3A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcccagtttccagactccctggctgtgtctcgtgggcgaggagggccaccatcaactgcaagtccagccagagttgttttattcggaccccacaataacaactacttagcttgtaccagcagaagtaggacagcctactaaactcctgtatttacgcgggtcttccgtacccgggctacgtcccggggttacctaaccgtattcattcggcacggtcgggtcgtcgggaccgtactttccgacttctccaccatcacgcacgccctgcgacggctaggaagtatggtcggcttagttttactcgttgtacagtcaacttagttacttaccgtttctttcgttaccttaccggtttacggggccgggtaaacggtaccgtaagggtacggagtaacgtaaccgtaaaacggtacggttcggtcgtacgtacgaccctaaccgtacttcgtaccgttctacctacccg

SEQ ID NO: 65773 - DNA, 616 bp, Homo sapiens
  misc_feature: GYAE6OF02JDFPV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgccagtttccagactccctggctgtgtctcgtgggcgagagggccaccatcaactgcaacgtccagccagagttgttttattcggccccaacaataacaactacttagcttggtaaccagacaagaaagtaggacagcctacctaaactcctagtatttacgtcggtcttccgtacccgggctacgttcccggggttacctaaccgtacttcagttggcaggtcgggtctcgggaccgtatttcactctacacctatcacgcgacgcctgacgcggctagaagtagtcggtggacttagtttactacgtgtacacgtactaatattacttactttcgtttcgacttacgtttcgggacggtacggtaccgtagggtcggtagtacgtacgtaaaccggtacgttaggtacggtcgtacgactacccgtagttccgttcgttaccttacgttaccg

SEQ ID NO: 65774 - DNA, 904 bp, Homo sapiens
  misc_feature: GYAE6OF02HL59E.31.78.H01.1.454.CMB.1.raw
  modified_base (231)..(231): a, c, t, g, unknown or other
  misc_feature (231)..(231): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagngttgttttattcggccccacaataacaactacttagcttggtaccagcagaaagtaggacagcctacctaaactcctagatttacgtgggcttccgtacccgggcaacgtcccggggttacctaaacccgtatttaccgtaagtttcggactacggtccggggttccgttacgggggaaccccgttaagtttttcccgaaccgtttcccgttaccccaaacccgttaacgttacccgtaacgggaccctaaccgggtcccccgtttagggtaaccccggaacggggtacccgtttaaggggaaaaacgggtaacgtttacggggttaccggggtaccgttaaacgggtttttttaaacttttaaacccggttcgggtttaaccgtaaaccggtaacccgttaaaaacccgttaatttttaaaccgtttaaacccgttttttcccgtttttaacccggtttaccgtttaacccgggttttttacccgggggaaccggggttaaaccgggggtaaacccgtaaaggggggtttacggggaaacggttaaccggtttaaacccggtaaaaaaccgggttaaaccggttcgggttaaaccggggttaccgttacgggtaccctaacccggttaacgtttacccggttacggttttacccttttaccgttaaccccgg

SEQ ID NO: 65775 - DNA, 576 bp, Homo sapiens
  misc_feature: GYAE6OF02F9INV.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagtgttttattcggccccacaataacaactactagcttggtaccagcagaagtagacagcctaccaaactcctagatttacgngggtcttcgtacccgggcagttcccggggtctaaccgattcattggcagcggtctagggaccgtatttcacgtctcgaccagtcagccagcctgcagctagaagtatgtcgcgtagtttatactgtcagacaactattatactttcgtttcgtctacgtttcggcggtacggaaccgtaaggtggagtacgtaacgaaacggtaactaggtacggtacgtacggtacctaccgtaagttcgttacggttaccgttacgtaccg

SEQ ID NO: 65776 - DNA, 741 bp, Homo sapiens
  misc_feature: GYAE6OF02FHRQ7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccacatcaactgcaagtccagccagagttgttttattcggccccacaataaccaactacttagcttggaccagcaagaaagtaggacacgccttacctaaacttcctagtaatttacgtgggtcctttccgtaccccgggctaacggttcccggggttaccctaaaccggtattccgtagtttcgggacctacgggtccgggttaccgttagggggaaccccgttaattttccgaccttccgtaccaaccctattccaacggtaccgacgtcccgtagtcgaacgggtcgtaggaaacgtgttcggtcggtacgttaaggttttagtaccgttaggtaccgaagtacctaaacgttacttttaacgttaccgttttaccgttttaccgtaccgttaaccggttttccggggacgggtaaacgggtacccgtaaaggggttcgggtaactacggtaaccgtaaaaccggtacgttacgggtacggtaccgttacggaccctaccgttaacgttcggttaccgttacttaccgtacccg

SEQ ID NO: 65777 - DNA, 637 bp, Homo sapiens
  misc_feature: GYAE6OF02J1XUE.31.78.H01.1.454.CMB.1.raw
  modified_base (631)..(631): a, c, t, g, unknown or other
  misc_feature (631)..(631): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggcctgtgtctcgtgggcgaggcggccaccatcaactgcaagtccagccagtagttgttttattccggaccccaacaataacaactacttagcttaggtaccagcaaggaaatacggacaacgcctacctaacgtcctatactttacgcggtccttacgtacccgggctacgtcccggggttcctaacggcttctaagtcggactacggtcgggtccgtagggacccgttagttccacgtcgtacccaccgtatcgacgccgtacgtccgcgacgtacggtcgtaagacgtagttcggtgtactacgttttacttacgtagtccacgtactaactacgttaacttctttccgtttacgaccttcggtttaacggcggtaacggaaccgtaaggtacgagacgtaacgaacgtactggtacgactcgactacccgtattaccgtagtccttntacccg

SEQ ID NO: 65778 - DNA, 661 bp, Homo sapiens
  misc_feature: GYAE6OF02HG6HH.31.78.H01.1.454.CMB.1.raw
  modified_base (417)..(417): a, c, t, g, unknown or other
  misc_feature (417)..(417): n is a, c, g, or t
  modified_base (639)..(639): a, c, t, g, unknown or other
  misc_feature (639)..(639): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggccccacaataacaactacttagcttggtaccagcagaaagtaggacagccctacctaaactcctagtactttacgtgggtccttaccgtaccgggtcacggttcccgggttacctaaccgtattactagtggcgacgggtcgggtacgtcggaccgtatttccactctacacntcacgcagcctgccgagtcgtagaagtgtcggtacgtacttagtttaactacgtgtactacggtactaacgttatttaacgttaccttttacctttacggtcctttaccgggtttaccgggacggggttaaacgggaacccgggttaagggttacgggaacgttacgtaaccggtaaaccggtacgtgggttaccgaccgttacggaccctaagtcccgttnttaccgttccttacgttacccg

SEQ ID NO: 65779 - DNA, 860 bp, Homo sapiens
  misc_feature: GYAE6OF02IB3B1.31.78.H01.1.454.CMB.1.raw
  modified_base (126)..(126): a, c, t, g, unknown or other
  misc_feature (126)..(126): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctntggatctctggtgcccgtacggggacatcgtgatgagctagtttccagacctcccgtggcttgtgtctcgtgggcgaggacgggaccaccgatacaactgacaacgtccagaccgaagtcgttagtttttacgttcggaccccctaactaaataacctaaacctacgttagtcgtttacggtaacccagacgtaaaggtaaacggtacgggaactacgtaccctaacctaaacttccgtagtaactttaacgtggtaccttaccgtaccccggggtctaaccgggtttcccgggttaacccaaaccggttacttacgtaacgttcgggacctacggggtcccgggttcgtacggggtacccttacgtttccaccgttaccgtacccaaccgtagttaccgacggtacctacggtcccttacgggaaccgacgggtccgtaagaaacgggttactgggttaccggtacgtttaacggttttactttaaccgcggtttaccaagttacctaaacgtttaacgttttaaccttaaccgtttttccgtttacccgttaccgtttaaccggttttaccggggaccggggtaaacggtaaacccggttaaagggggtagggtaacccgttaaaccggttaccgtaaaaaccgggttacggttacggttccgggtaacccttcgggaaccccttaacgttaccggtttacggtaaccgtttttcccgtaacgttacccccg

SEQ ID NO: 65780 - DNA, 629 bp, Homo sapiens
  misc_feature: GYAE6OF02JUF4Y.31.78.H01.1.454.CMB.1.raw
  modified_base (177)..(177): a, c, t, g, unknown or other
  misc_feature (177)..(177): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaggggacatcgtgatgagcagtttccagcctcccnggctgtgtctcgtgggcagagggccacatcaactgcaagtccagccagagttgttttattcggacccacgaataacaacttactagcttggtaccagcaagaaagtaggacagccctacctaaactcctagtactttacgtgggacctttcgacccgggctagttcccggggttacctaaccggtaattcgatttcggcacggtcggtcttgggaccgtatttcacttcgtcaacctgtcgactcgacgtcctgacgacgggcttaagacgtatcggtacggtactagttttacttactcgttacgagtcctaaatatttacgttaactttcgtttaacgtcttaaccgtttcggacgggtaggtacctaaagggtcgagtacttaccgaaaggtaccgttggtaaccggttcacggtacctaaccggtattccggtagtttaccctatccg

SEQ ID NO: 65781 - DNA, 794 bp, Homo sapiens
  misc_feature: GYAE6OF02G23I9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccctagtttccagacctcccgtggctgtgtctcgtgggcgaggacggccaaccataccaactcgacaacgtccgacgccgagtagtttgttttacgttccggacccccaactaaataacctaacttaactacgtcttacggtaaccaagcgaaagtaaagtaggacctacgccctaacctaaactccgtagtaactttacggacgggtcctttaccggtacccgggtctaccggtttccccggggttacctaaaccggtacttacgtacgttcgggcgtacgggtccgggtcgtacgggtaccgttacgtttaccacgttcctactaccgacgttccgaaccgtcgaaccgtcccgtcgaccggtacgggtaccgttaacggaaagtacggttcggtacggtaccgtttaagttttaaccgttacgttacgtaccgtaacgtaacctaaagttaacttttaccgtttaacctttccggttttacttacccggttaccgtttacgggggtaaccgggtaaccggtaacggtaagggtacggacgtaacgttaaaccggtaaaccggtacgttacggtcggtaaccgtgtaaccctaccgtagtttacccgtcgttaccgttaccgttaccccg

SEQ ID NO: 65782 - DNA, 591 bp, Homo sapiens
  misc_feature: GYAE6OF02IZJ7D.31.78.H01.1.454.CMB.1.raw
  modified_base (237)..(237): a, c, t, g, unknown or other
  misc_feature (237)..(237): n is a, c, g, or t
  modified_base (376)..(376): a, c, t, g, unknown or other
  misc_feature (376)..(376): n is a, c, g, or t
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggacgggcccaccatccaactgacaacgtccagccagngttgttttattcggcccccaactaataacaactacttagcttggtaccagacagaaagtaggacagtccctactaaactcctagtatttacgtcgggcttccgtacccgggctacggttcccggggttacctaaccgtnttccagttggctaggcgggtctagggaccctattcactctcaccntcagcacgctgcagctaganagtgagctagttntactgtcanacaatattacttacttcgtttcgtacctacgttacggacggtacggtacaagggtacggacaacgtacgaaacggtacgtacggtacggacctacgacccacgttatccgttgttaccttctaacccg

SEQ ID NO: 65783 - DNA, 690 bp, Homo sapiens
  misc_feature: GYAE6OF02HU3BM.31.78.H01.1.454.CMB.1.raw
  modified_base (409)..(409): a, c, t, g, unknown or other
  misc_feature (409)..(409): n is a, c, g, or t
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtagatgacgcctagtttccagacctccctggctgtgtctcgtgggcgaggacggccacctatacaacgtgacgacgtccagccagtagtttagttttacgttccgaccccaacaaactaacctaacttacttagtccttacggtaccagacaagaaagtacggacacgtccctaccttaaacctcgttacgtacgtttacgtcggtccttaccggacccgggtctaccggttcccgggttaccctaaccggtnttaccgtagttcggcgtacggtcggccgtacgggtacctacgttcacctcgacaccnctcgacgcacgtctacgcgtagngtacgagtcgtggtcgtattacgtttattacgacgtcgtaagtactaacgttagtttaaccttccgtttacgtttccgttacccttagggttaccgggtaacggggaaacggttaccgagggtacgtacgtacgttaaaccgaaacgtcggtggtaaccggactccgaccgtacgtacttccggtttactcttacctaccg

SEQ ID NO: 65784 - DNA, 601 bp, Homo sapiens
  misc_feature: GYAE6OF02GG9LJ.31.78.H01.1.454.CMB.1.raw
  modified_base (231)..(231): a, c, t, g, unknown or other
  misc_feature (231)..(231): n is a, c, g, or t
  modified_base (337)..(337): a, c, t, g, unknown or other
  misc_feature (337)..(337): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagngttgttttattcggccccaacaataacaactacttagcttaggtaccagcaagaaagtaggacagcctacctaaactcctgtatttacgtgggcttcgtacccggnacgttccgggttacctaacgtattcattcggcaggtcgggtctagggaccgtattcactcctcacctatcagcacgcctgcagctagaagatgtgactagtttactagtcgtacagtacaacttattattaccgtttctttctacgttacgtttccgggacggtacgggaaccgtaagggttggacgtacgtaaccgtaaacgtaaccgttcggtacggtcctaggacctacgtaccgttacgttcgttacccttacgttaccg

SEQ ID NO: 65785 - DNA, 593 bp, Homo sapiens
  misc_feature: GYAE6OF02G1O3S.31.78.H01.1.454.CMB.1.raw
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagacagaaagtaggacacgccctacctaaactcctagtaatttctcggggccttccgtacccggggctacgttcccggggttaccctaaaccggattcaagttcggctaggcgggttctcggggacctatttcacttcctcaccattcacgcacgtcctggcaggctaggaagngtggngacgtagtttattacgtgtcagaccaactattaacttactttctttcgtcttacgtttcgggacggtacggtaccgaagggtgagactaacgaaacgaccgttggtacgctgaccgtactagtcgtcgttccttactaccg

SEQ ID NO: 65786 - DNA, 746 bp, Homo sapiens
  misc_feature: GYAE6OF02HQC6K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgaggacgggccaccatcaactgacaagtccagccagtagttgttttattcggacccccaacaataacaactacttagcttggtaccagacaagaaagtaggacagccctacctaaactcctagtactttacgtggtccttaccgtacccgggtctaccggttcccggggttaccctaacccgtattctagtttcggaccgtagggtccgggttacgtcggggtaacccgttactttcctacttcctaccaacctataccgtacgcctacgtcccgtacggaccgtacgggtcgttaaggaaaggttagttgggtacggtacgttaaggttttaacttacgttcgttaccaacgtaactaaaccttaatttaaccttaaccttttccgttttacgtaccgttaccggttttaccgggggaaccgggtaaacggtaaccgggtaagggtacgggtaacgtaacgtaacccggaaaacggtaaccgttgggttacggtacccgttacggaaccctacccgtacgtttccgtaccggtttaccttacctaacccg

SEQ ID NO: 65787 - DNA, 751 bp, Homo sapiens
  misc_feature: GYAE6OF02IQI8N.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagagggccaccatcaactgcaagtccagccagtagttgttttattcggcccccaacaataacaactacttagcttggtaccagacaagaaagtaggacacgcctacctaaactcctagtatttacgtgggtccttaccgtacccgggctacggttcccggggttaccctaaaccgtattacgatttcggactaggtccgggtcgtacggggacccgtatttccgacttcctccaaccgtatccgaagtccgtaacggtcccctaggccgtaacgggtccttaagggaaacgtagttcgggtacggtaccgtttaaggttttaacttaccggttacggttaccgaacgggtaaccctaaaacgttacgttttaaaccttaccgtttttaccttttaccggttacctttaaccgggttttcccggggaccgggggtaaaccggtaaacccggtaaggggttacggaacggttaacttaaccggaaaacggttaaccgttagggttaccggacgttacggaccctacgttactacgttcgtttacccttacttacccg

SEQ ID NO: 65788 - DNA, 760 bp, Homo sapiens
  misc_feature: GYAE6OF02JYFRX.31.78.H01.1.454.CMB.1.raw
  modified_base (439)..(439): a, c, t, g, unknown or other
  misc_feature (439)..(439): n is a, c, g, or t
  modified_base (684)..(684): a, c, t, g, unknown or other
  misc_feature (684)..(684): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgacccgtaggggacatcggttgactgacgcctagtttccagccttcccgtggacctgtcgtcgtcgtagggcgaggacgggtcccaacctagttaccgaaacgttgaccgtaaacggttcccgaagcccaaggttacgttttacgggtttttaagttcccgggaaccccccctaaaacgttaaataacccggtaaacctttaccgttaacggtcgtttaaccgggtaaccagtaaccgtaaggtaaaaacgttcggacctaacggtcccttaacctaaacgtcctagtaacttttaccggnggtccttaccggtacccgggatacgggttcccgggttacaaccgtattcgtaagtcggacagggtccggtcgtacgggtacctaatttccgaacgttccaccacgtacggtcaacgccgtagtcccgtagacggtacgtacgtacgtaagtacgtggtccgtagtaacgtttataccgttagcctacgtacgtaacttagttcgtactttcgtacgtactaccgtttcggacgtacgggtaaacngggttacagtacgtaccgtaaggtaccttcgacggtactagtaccgttaacgtagttccgtacgttcgtactaccg

SEQ ID NO: 65789 - DNA, 735 bp, Homo sapiens
  misc_feature: GYAE6OF02I616V.31.78.H01.1.454.CMB.1.raw
tcagcagtagacgtcacgaccggtgctcgatttagtgtgagtagtttgggtttgggggagctacgaacaggcaggcaggggcagcgaagatggtgttgcagacccaggtcttcatttctcctgttgctctggatctctggtgcctacggggacatcgtgatgagccagtttccagacctccctggctgtgtctcgtgggcgagacgggccacatcaactgcaacgtccagccagtagttgttttagttccggaccccactaaactaacaacttaacttagtcgttacggtaccagtacaaggaaagtacggaccacgcccgttactaaacctcctagtactttacggtggtccttaccgtacccgggactaaccggttcccggggttaccctaaccggtactttcgtacgttcggacgtagggtccgggttcgtacggggtaccgtagttttccgactccgtaccaacctagtccgtacgaccgtacggtcccgtggaccgtacgggtcctaaggaacggtagtgggtacggaccttaaggtttacttaacgtcgtacgtacgtacctaacgttactttaaccttaccgttttacctttacgttaccgttaccggtttacggggtacgggttaccggtaacggtaacgggttacgggagtacgtaaccgtaacggtaaccgttcggtacggcgttacgaccgtaccgtagttccgtcgttaccttaccgttcccg

SEQ ID NO: 65790 - DNA, 774 bp, Homo sapiens
  misc_feature: GYAE6OF02HTBJG.31.78.H01.1.454.CMB.1.raw
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagtagttgttttattcggccccactaataacaactacttagcttaggtaccagcaagaaagtaggacagcctacctaaactcctagtatttacgnggtctacgtaccccggntacgttcccgggttacctaaccgtacgtttcagttcggactacgggtcggggtaccgttacggggaacccttagttttacccgaccgttccttacccgaacccttacgtaccgacggaccgtacggtcccgtacggaccggtaagggtaccttaagggaaaaccgttaggttacgggttacgggtactttaaacgggtttttaacgtttaaccgtagttacccgaaacgtacgtaaaacctttaagtttaacccttactttttaccgttttccgaacctttaaccgggttttccgggaacccggggtaaagggtaacccgttaaagggggtggtaacggtaaccgtaaaccgtaaaacgggtaaccgtacggttaacgggacccgtacgggtacctaaccgtaaggttccctttcggttaccttacgttaaccc

SEQ ID NO: 65791 - DNA, 599 bp, Homo sapiens
  misc_feature: GYAE6OF02H2AN7.31.78.H01.1.454.CMB.1.raw
  modified_base (392)..(392): a, c, t, g, unknown or other
  misc_feature (392)..(392): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactattagcttggtaccagacaggaaagtaggacacgtcctacctaaactcctgatttacctgggtcttccgtacccgggctacgtcccggggttcctaaccgtacttcagttggcagtcggggtctgggaccgtnttccactctcaccatcagcagcctgcgaggctagaagatggtcggctatttacgtacgttcgtctagaccaatattacttactttccgtttcgtaccttacgtttcgggccgggaagggtaaccgtaagggttaggacgtataccgtaaaacgtaccgttggtacgcgttcgaactacccgtattccgttacgttccttactacccg

SEQ ID NO: 65792 - DNA, 538 bp, Homo sapiens
  misc_feature: GYAE6OF02FSLLS.31.78.H01.1.454.CMB.1.raw
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactccngtatttacnggcttctacccgggcatccggggttcctaaccgattcattggcagcgggtctgggaccatttcactctcaccatcagcagcctgcagctgaagatgtggctagtttatactgtcagccaatattagttacctttcgtttcgtctacgtttcgggacggtaaggaccaagggtgagtactacgaaacgtaacgtgtcggcgtagccaccagttcctgttccttactac

SEQ ID NO: 65793 - DNA, 723 bp, Homo sapiens
  misc_feature: GYAE6OF02IMS9T.31.78.H01.1.454.CMB.1.raw
  modified_base (299)..(299): a, c, t, g, unknown or other
  misc_feature (299)..(299): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccgatccaactacaacgtccagaccagtagttgttttattcggccccaccaataacaactacttagcttgtaccagacaagaaagtaggacncgcctacctaaactcctagtacttacgtcggtcttaccgtacccgggctacgtccggggttacctaaccggtacttcagttcggacgtacggtccgggttccgtacggggtacccttatttccgacttcctaccgtaacctacgttaccgaaggtccgaacgtccgtcggaccgtacgggtcctaagggaacgtagttggtacggtaccgtttaagttttacttaaccgtcggttacaggtacctaaattacgttttaactaccgttttcctttaccggtaccgttaaccggttttacgggaccggggttaaacggggtaacccgtaaaggggttgggtaacgtacgtaaccggtaaacgtacgtagggtcggtactcggaacctaccgtagttcgttccgttaccttacgtacctttaccccg

SEQ ID NO: 65794 - DNA, 694 bp, Homo sapiens
  misc_feature: GYAE6OF02IINPS.31.78.H01.1.454.CMB.1.raw
  modified_base (194)..(194): a, c, t, g, unknown or other
  misc_feature (194)..(194): n is a, c, g, or t
  modified_base (422)..(422): a, c, t, g, unknown or other
  misc_feature (422)..(422): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagacctccctggctgtgtctcgngggcgagacgggccaccatcaactgcaagtccagccagagtgtttattcggaccccaacaataaccaactacttagcttggtaccagcagaaagtagacagcctacctaactcctagatttactgggctctacccgggatactcccggggttacctaaccgtacttacagttggcacggtacgggtctacggggacccgttatttaccgacttacctaccaaccctanacctaacgcaacgccctggaccaggacgtacggaaagtacgtggttacggacgttaaggtttaattaacccttggtaccaaccgggtactaaactaactttaacttaaaccgttttccttttaccgttacggttaccgttttacggggaccggtaaacggggtaacccgaaagggttaggtagtaacgtaaccgaaaaccggttaacgtcggtacggggaccttacggaccctaaccttacggtacccgtacgttccgttaccgttaacccg

SEQ ID NO: 65795 - DNA, 533 bp, Homo sapiens
  misc_feature: GYAE6OF02HUNXP.31.78.H01.1.454.CMB.1.raw
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctcctaaactcctgatttactgggcttcacccgggnacttccgggtacctaaccgnttcattggcaggcggtntgggaccattcactctcaccatcagcagcctgcaggctagaaagtatggtggctagttttaattactgtcagcaactattatacttctttacgtctactttcggcggaaggaccgtaagggtgagtataccgaaacgtaactggtacggctgaccacattcgtgtcttcac

SEQ ID NO: 65796 - DNA, 695 bp, Homo sapiens
  misc_feature: GYAE6OF02HNIUN.31.78.H01.1.454.CMB.1.raw
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcccgtggctgtgtctcgtgggcgaggacgggccaccatacaactgacaacgtccaagcctaagagttgttttacttcgaccccaacaaactaaacaactacttagcttaggtaccagacaagaaagtaggacacgcctacctaaactctagtacttacgnggtcttcgtacccgggntacggttcccgggttacctaacgtattctagttcggacagggtccgggtcgtacggggtaaccctatttccgactcgtaccaacctatacaagacctacgtccgtagacgagactaggtaaagagtcggtggtacgttaagtttaacttacgtacgtaccgaagtaccaaacttaactttaacgtttaaccttttccgtttaaccgtaccgtttaccggtttaccggggaacgggtaaacgggtaaccgtaaggggttacggaataaccgttaacgaaaacggttaacgttggtaacggtcccaggtaacctacgtacttcgttcggttaccttcgtaaccg

SEQ ID NO: 65797 - DNA, 825 bp, Homo sapiens
  misc_feature: GYAE6OF02GXKBG.31.78.H01.1.454.CMB.1.raw
  modified_base (340)..(340): a, c, t, g, unknown or other
  misc_feature (340)..(340): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaacgtccagccagagttgttttattcggccccacaataacaactactagcttaggtaccaacagaaagtaggacagcctactaaactcctagtactttacgtggtccttaccgtaccccgggnaacggttcccggggtttacctaaccggtactttacagttcggactacgggcgggttcgtgggggtaacccgtattttccacgttccttccaacccgtactaccgtaacggttaccgtacccgttggaccgtacgggtacttaagggaaacggttgttagggttccggggaactttaaacgggtttttttaaactttaacccggtttggttaccgtaaacgggttaccctaaaaccctttagttttaaacctttaccgtttttaccgttttttacccggttacccgttttaaccgggttttccgggggtaccggggttaaaccgggggttaacccggttaaagggggttaacgggggaagtaaccggtttaaccgtaaaaaccgggtaacggtttcggttacggggtacctaacggaccgtaaaccccgttggtttaccttcgggttttaccccttaccgtttaccgttccccgtttaacccccgg

SEQ ID NO: 65798 - DNA, 773 bp, Homo sapiens
  misc_feature: GYAE6OF02JATFV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagtttccagacctccctggctgtgtctcgtgggcgaggacggccaaccagtccaacgtgacaagtcccaggaccagtagttcgttttattccggaccccaacgaaataactaacttacttagacgttacggtaacccagccaaaggtaaaaggtaggaaccacgtaccccttaaccgtaaactcccgttagtaactttaccgtcgggcctttccgtaacccggggctaacggttcccggggttacctaaccgtacttcgaagttcggacaacgggtccgggtccttacgggggaactcttttaccgaacttcctaccgaccgaacgttcaaccggtcaaccgcccgtaggacgaacggcctaggtaaacgtagtacggtacggacttaagtttaacgttacgttacgtaccgtaacgacctaaacttacttaagttacctttacgttaccgtttaccgtaacggttttacccgggaacgggtaaaccgggttaaccgtaaggggttacgtacgggtaaactaaccgggtaaaccggaaccttcgggtaaccggtacgtcccggtaaccaaccgttaacgttaccgccgttttacccgtcttaacccg

SEQ ID NO: 65799 - DNA, 616 bp, Homo sapiens
  misc_feature: GYAE6OF02GPTF3.31.78.H01.1.454.CMB.1.raw
  modified_base (315)..(315): a, c, t, g, unknown or other
  misc_feature (315)..(315): n is a, c, g, or t
  modified_base (612)..(612): a, c, t, g, unknown or other
  misc_feature (612)..(612): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggccccacaataacaactacttagcttggaccagcaagaaagtaggacagcctacctaaactcctgaatttacgngggtacttccgtacccgggctaacggttcccgggggttaccctaaaccggtatttcgaagtttcggactagggtccgggtctgggggtaaccctattttaccgactccgtacaacctagttaccagccacgccgtcgacgaggtctaggaagagttggtacggacttaagtttattacgttgtacagtactaatattaacttacttccttttcgtctacgtttcggacggtacggaaccgtaagggtgagacgtacgaaacggtactaggtcgactgaccactagtctcgttacttntacc

SEQ ID NO: 65800 - DNA, 829 bp, Homo sapiens
  misc_feature: GYAE6OF02HJQJL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctagatctctggtgcctacggggacatcgtgatgagccagtttccagactccctggctgtgtctcgtgggcgaggacgggccaccatcaaactgcaagtccagccagagttgttttattcggcccccaacgaataaaccaaacttacgttacgtcttaggtaaccagacaaggaaaagtaggaaccacggtaccctaccttaaaacctccgttagtaacttttaacgtcgggtcctttaccgtaaccccggggctaacggttcccgggggtttaccctaaacccggtattcctagttacggacgtaacggtccgggggttaccttacgggggaacccgttacttttaccctaaccgttccttacccgaaccctacgtaccgtaagtcccgtaacgtccccgttaggcccgtaacggggtcccttaaagggaaacgtaacggttcgggtacgggtacctttaacggttttaaacttttaccgtacggttaccgaacgtaaccaaaccgtttaagtttaacctttacgttttacccgtttttacggtacctttaacccggttttccggggaaccggggtaaacggaaccgttaacggggttagacggttaacgtaccgaaaacggttaaccgttgggtaccgggtaccgttacggtacccgtaaccgttagttaccccggtttgttttacccgttattaaccccgg

SEQ ID NO: 65801 - DNA, 711 bp, Homo sapiens
  misc_feature: GYAE6OF02HF80Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttacttcggcccccaacaataacaactacttagcttggtaccagacaaggaagtaggacacgccctacctaaactcctagtactttacgtcgggtcctttaccgtaccccggggactacggttcccggggttaccctaaccggtattacctagttcggactacgggtccgggtcgtacgggtaccgtatttccgaccttctacccacctactcgtacgccgtacgtcctcggaccgtacggcgttaggaaagtcgttcgggtcggtacgttagttttaacgttacgtcggtacaacgtacctaattaactttatttacccttttcgtttaccgttaccgttaccgtttaccggggacgggaaccgggttaaccgtaaggggtacggtacgttaactaaccggtaaaacggtaccgttacggtacggtccgtacggaccctaccgtacgttaccgttcgttaccttacgtacccg

SEQ ID NO: 65802 - DNA, 530 bp, Homo sapiens
  misc_feature: GYAE6OF02JD587.31.78.H01.1.454.CMB.1.raw
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagttgttttattcggccccacaataacaactacttagcttggtaccagcagaaagtaggacagccctacctaaactcctgatttacgnggacttcgacccggnacgtccgggttacctaacgattcattggcagcggtctggacattcactctcacatcagcancctgcaggctagaagntgcgntagttactatgtcagacaatagttatacgttcttcgtactcgtttcgcgggagtaccgtaggtgagtatacgaaacgtaactggtacgacgtgacacctattcgtacgtcttctaccg

SEQ ID NO: 65803 - DNA, 754 bp, Homo sapiens
  misc_feature: GYAE6OF02HZUBT.31.78.H01.1.454.CMB.1.raw
  modified_base (228)..(228): a, c, t, g, unknown or other
  misc_feature (228)..(228): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagngtgttttattggccccacaataacaactacttagcttggtaccagcagaaagtagacagcctactaaactcctgtattacgtgggcttccgtaccccggggctacgttcccgggggtttaccctaaaccggtattttaccgaagttttcggacctaacgggtccggggttccgttagggggtaaccccgtaacgttttttccaaccgtttccgttacctaacccaatttcccaaacggtacccgacggtaccccttcgggtacccaaggggtacccttaggaaacggtaacgttcgggttacgggtaccgttaaaggtttttactttaacgttcggtaaccgtaacggtaccctaaacgttaacttttaacgttaaccttttaccgtttttaccggttacctaacccggtttttcgggaccgggttaagggaacccgtaaggggttcggaaggtaacttacggaaaacgttaccgtggttacggacttcggacctaaccgtacttacgtcgttacctacgttaccg

SEQ ID NO: 65804 - DNA, 590 bp, Homo sapiens
  misc_feature: GYAE6OF02GCB56.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctacctaaactcctagtactttactgggcttccgtacccggggcacgttccggggttcctaaaccgattcagttggcacggtcgggtctcggggacctatttcacgtctcaccatcagcagccctgcaggctgaagtactgtcggctagtttatactgtacagctaaactatttactactttctttccgtacttaccgttttcggaccgggacggtaaccgtaagggtggacgtaacgtacgaaaaccggtacttgggtacgacttgacctaccgtaacgttctacgttccttcttacc

SEQ ID NO: 65805 - DNA, 691 bp, Homo sapiens
  misc_feature: GYAE6OF02FW2N5.31.78.H01.1.454.CMB.1.raw
  modified_base (329)..(329): a, c, t, g, unknown or other
  misc_feature (329)..(329): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccgatcaactgacaagtccagccagtagttgttttacttcggaccccaacaataaccaactacttagtcttaggaccagacaagaagtagactagcctacctaactcctagtactttacgnggtcttccgtacccggctacgttccgggttacctaaccgtattcagtttcggacaggtcgggtcgtacgggtaccgtactttaccaccttcgtaccaaccgtataccgaacgtaccgaccgtcccgttagaccgtacggtacgtaggaaacggtacgttagggtacggtacgtttaaggttttacttacgttgtaccgtagtacctaaacgttagtttaacgttaccgttttacgtttaccgttacttacggtttaccgggacggtaacgggtaaccgtaagggtacggagtaacgtaacgtaaacggtacgtggtacgtccgtagacctaacgtaccgttcgttacgttactccttacccg

SEQ ID NO: 65806 - DNA, 600 bp, Homo sapiens
  misc_feature: GYAE6OF02JB0QZ.31.78.H01.1.454.CMB.1.raw
  modified_base (230)..(230): a, c, t, g, unknown or other
  misc_feature (230)..(230): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagngttgttttattcggccccaacaataacaactactagcttagtaccagcagaaagtagacagcctacctaaactcctgtattacgtgggtcttaccgtacccgggcacgttcccggggttacctaaccggtattactagttcggacaggcgggtcgtacgggacccgtatttcactctcacctatcagcagcctgcaggtctagagngtgcgtctagtttatactgtcagacaacgtattattactttcgtttacgtaccttacgttcgggacggtacgggaaccgtagggtacgagtacgtaaccgtaaacggtaacgtaggtacgtaccgttacgaccgtaccgtacgttcgtacgttcttacgttacc

SEQ ID NO: 65807 - DNA, 624 bp, Homo sapiens
  misc_feature: GYAE6OF02HQ935.31.78.H01.1.454.CMB.1.raw
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (443)..(443): a, c, t, g, unknown or other
  misc_feature (443)..(443): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctcctggctgtcgtctcgtgggcgaggagggccaccatcaactgacaagtcagccagagttgttttatcggccccaacaataacaactacgttacgcgttacggtaaccagacagaaagtaggacncgcctaacctaaactctcgtatttacgnggtccttaccgaccgganacgttcccggggtacctaacgtactcgactggcaggtcgggtctcggggtaacctattaccgctcctaccaacgtacaccagcgacgctgacgcgngtacgatgtcggtggactagtttaactcgtagtactagactaaacttatactttacttccgtttcncgttaccgttcggtacggggacgaacggtaacggtggaacgtactaacgaaacggttaccgtaaggtgtaaccgttgggaacctacgaccttacgttcgtacctttacggtaccc

SEQ ID NO: 65808 - DNA, 662 bp, Homo sapiens
  misc_feature: GYAE6OF02G0YTW.31.78.H01.1.454.CMB.1.raw
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (616)..(616): a, c, t, g, unknown or other
  misc_feature (616)..(616): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtcttcgtgggcgaggagggcccaccatacaactgcaacgtccagccagtagttgttttacgtttccggaccccctaactaaaactaaacctaaaccttactttaacgtccgtttacggtaaccagaccgtaaagaaaaggtacggacacgtaccctaccttaaacctccctagtactttacgtcggtcttaccgtacccggactaccggttccgggttaccctaaccgtattcagtttggcgacggtcgggttacgtgggtacctatttccacttccnctacntacngcacgtcngcgagcgtagaagtgtagtcgtcgttaagtttattaccgtgctaacgtcaaacttacttacgttactttcgtttacgtcttacggttcgggacgggtacggaaccgtaggtaggactaacgtaccgtaaacgngttcggcgtactacggaccacctagttccgttcgttacctctaccg

SEQ ID NO: 65809 - DNA, 739 bp, Homo sapiens
  misc_feature: GYAE6OF02IM9Z0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaacgtccagccagagttgttttatcgccccacaataacactacttagcttggtaccagacaagaagtaggacagtccctacctaaactcctagtactttacgtgggtccttaccgtacccgggtactacgttaccggggttaccctaaccggattccagtttcggcgacggtcgggtccgtacggggtaccgtatttccaacgttcctacctaacccataccgtacgaccgacgtcccgtagccgaagggtccgtaaggtaaacgtaggtacggttcgggtaccgttaacgttttaacgtttaccgtacggttaccgtaagtaaccctaaagtacgtttaactttacgttttaccgttttaccgttaccgtttaacccggtttccggggaccggggttaaacgggaacccgttaaaggggtacggtacgaaacgtaccggtaaaaccggttaacgtgggttaccggacgtaccggtaccgtaacccgtaacgttcgtaccgtttacttaccgttaacccg

SEQ ID NO: 65810 - DNA, 737 bp, Homo sapiens
  misc_feature: GYAE6OF02IR3DV.31.78.H01.1.454.CMB.1.raw
  modified_base (231)..(231): a, c, t, g, unknown or other
  misc_feature (231)..(231): n is a, c, g, or t
  modified_base (324)..(324): a, c, t, g, unknown or other
  misc_feature (324)..(324): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagcctccctggctgtgtctcgtggcgaggacggccaccatcaactgcaagtccagccagngttgttttactggccccaactaataacaactattagcttaggtaccagacaagaaagtacgacacgccctacctaaactcctagtacttacgnggtcttaccgacccgggcacgttcccgggttacctaaccggtattcgagttggaccgtaggtccgggttacgcggggtaacccttattttaccgaaccttccgtacccaaccgtaattccgaacgtccgaacgtcccgttagaccgtacggtaccgtagaacgtagtcgggttaggaccttaaggttttaactaccgttacggtacctaacggtaccaaactttaacgtttaactttaccgtttacgttttaccgttacgttaccggtttaccgggaaccggggtaacggttaaccgaaggggttaccggacgtaaccgttaacccgaaaacggtaccggttacggtaccgggttaccgtacggtacccaacccggttagtttcccgttaacggtttcccctacgttacccgg

SEQ ID NO: 65811 - DNA, 768 bp, Homo sapiens
  misc_feature: GYAE6OF02GFFIG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccacatcaactgcaacgtccagccagagttgttttacttcggcccacaataacaactactagcttcggtaccagcagaaacgtagacagcctaccgtaaactcctagtatttaccgtgggtcttccgtacccgggtccgtaacgtttcccgggggttacccttaaacccggtatttaccaagtttcggacgacgggtccggggttaccgttggggacccgtacgtttaccaaccttccttacccaaccctattaccgaaccgtaccggaaccgtcccgtttacgggccgtaacgggtaccctaagggaaacggtaacgttcgggtgggtaccgttaacggtttttaactttaccgttacgttaccgtaagtacccaaaccgtttaatttaaccgtttacccttttaccgttttaccgtttaccgttaacgttttacccggggaacgggttaaaccggggtaacgtaaacggggtcggtacgtaaccgtaacgtaaaaccgtaacgttcggtacgggtaccgttagacccgtacctaccgttcttcggtttaccttccgttaacccg

SEQ ID NO: 65812 - DNA, 805 bp, Homo sapiens
  misc_feature: GYAE6OF02JJ0C3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtggcgagacgggccaccatcaactgacacgtccagccagtagttgttttacgttcggacccccaacctaaataaacctaaaccttaacgttagcctttacggtaaccagacaaaggaaaagtaggacacgtaccctaccctaaacctcctagtaactttacgtcgggtccttaccggtacccgggctacgttcccgggttacctaaccgtacttacacgttcggacacgggtcggtcgtacggggtaccgtactttaccgacgttcctacctaaccctaatccgtacgtaccgtaacggtccctcggaccgtaacgggtaccgttaagtaaacggacgttcggggttacggtaaccgtttagttttaacctttacggtacgttaaccgtacgtaaaccttaaacgttaacttttaacgttttacccttttaccggttttaccgttaccggttttaacccgttttccgggggtaacggggtaacccgggttaaaccgtaacggggttaggtacgtaaccgtaaacggtaaaccggtaaacggttgggtaaccggtacgttaccggtacccgtaacctaccggttacgtttaccgtttcccgtacttaacccgg

SEQ ID NO: 65813 - DNA, 732 bp, Homo sapiens
  misc_feature: GYAE6OF02GRY39.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccgatcaactgacaagtccagccagagttgttttattcggccccacaataacaactacttagcttggtaccagcaagaaagtaggacagtccctacctaaacctcctagtaatttacgtggtccttccgtaccccggggctaacggttccccgggggtttaccaaacccggtattacgtaagtttcggacccgaggtccggggttccgtagggggaacccgtagttttccaccttctacccacctatccaagtccgacgtaccctcgacgacggtcgtaaggtaagtattgggttacggaccgttagttttaacgtttacgttcggttactaggtacctaaaccgtagtttaacgttaccttttaccgttttacgttaccgttaccggtttttacgggaccggggtacgggaaaccgtaagggttacgggacgttacgtaaccgaaaaccggttaacggttacgggtacgggtacgttacggtaccctaacccgtacgtttcgtcgttacccgttacgttaccccg

SEQ ID NO: 65814 - DNA, 607 bp, Homo sapiens
  misc_feature: GYAE6OF02H3GEE.31.78.H01.1.454.CMB.1.raw
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (372)..(372): a, c, t, g, unknown or other
  misc_feature (372)..(372): n is a, c, g, or t
  modified_base (602)..(602): a, c, t, g, unknown or other
  misc_feature (602)..(602): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacagtcgtgatgagcctagtttccagacctccctggctgtgtctcgtgggcgaggagggccaccatacaatnacaacgtcagccagtacgttnttttacgttcggaccccaacaataacaaccttacttaagcttggtaccagacaagaaagtaggacacgcctacctaaactctagtacttacgtggtacttcgtaccggctacgtccgggttaccaacggtnttctagtcgcacggtcggtacgtcgggactcttcactctacctacatcacgacacgcctagcgagtcgtacgaagcgtggtgtacgttattacttacgtcgtacacgactaactatttactactttcgtttcgttaccttaccgtttcgggacgggtaacggtaacggtaggttgagtaactcgaaaacgtcgtacggtcgtactacgctaccgtattccgtgtaccttntaccg

SEQ ID NO: 65815 - DNA, 675 bp, Homo sapiens
  misc_feature: GYAE6OF02I7ANP.31.78.H01.1.454.CMB.1.raw
  modified_base (367)..(367): a, c, t, g, unknown or other
  misc_feature (367)..(367): n is a, c, g, or t
  modified_base (430)..(430): a, c, t, g, unknown or other
  misc_feature (430)..(430): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgtgcctacggggacatcgtgatgagccagtttccagactccctggctgtgtctctgggcaggaggccaccatcaactgacaagtccagccagacgttgttttaattcggccccaactaataacgaactacttagcttggtacctagtccaagtaaagtaggacagacctactaaactccttagatttacgtgggtacttctacccgggctacgtccggggttacctaaccgnttccattcggacaacggtcgggtactcgggggtactatttacgaccttctccaaccattcganccgacgtcctgcgtacggctagacgattggtcgggtccttaagttttactaacgttgtcctaacgttactaacctagttaaccttactttacccgtttcgttaccgttacctttccggggtaccgggtacggttaacccggtaagggttaccgggactacgtacgtaaaaccgggtacttacgggtacgttaccgcggtaacctaccgtactttaccgaccggtttaccgttaccgtttaacccg

SEQ ID NO: 65816 - DNA, 958 bp, Homo sapiens
  misc_feature: GYAE6OF02GE6XW.31.78.H01.1.454.CMB.1.raw
tcagcagtagacgtcacgaccggtgctcgatttagtgtgagtagtttgggtttgggggagctaacaacaggcaggcagggcagcaaacgatggtgttgcagaccaggtcttcatttcgtctgttgcgtcgtggacttctctggtgccgtacgggacagtcgtgatgacgacctagtttccgagacctccgtggtcttgtcgtcgttcgtggggcgtaggacgggccaaccgagtaccaacgtaggcctaaacgtccgagaccgtagtacgtttcgttttattccggacccctaacgtaaagttaaactaaccttaacctttacgtccgtttacggtaacccgtaagaccgtaaaaggtaaacggttaacggaccgaacggtaccccgttaacccgttaaaccttacccggttaacgttaacgttttaccggtcggggaccttttaccggtacccgggtacgtaacggtttcccggggtttaaccctaaaaccggtactttaccgtaggtttacggaccgtaacgggtcggttaccgtacgggtacccgtacttttccgaccgttaccgtactacccgtaacgttaccaacggaccgtaaccggacctttaccggaccgtaacgggtaacgttaaacggaaacgtacggttacggtacggtaaccgtttaacggttttaacgtttaccggttacgttacgtaaccgtaaaccgttaacttaacgttttacgtttaaccgttttacccgttttaaccgttacccgtttaaacccggtttttccgggtaaacgggttaaaccgggttaaaaccggttacgggttaacggtaaccgtttaaccgtaaaacccggtaaaaccggttaacggtttcgggtaaccggttacccggttaacggaccccgttaaccggttaacccggtttctttacccggttttaccggtttaccttaacccccggg

SEQ ID NO: 65817 - DNA, 791 bp, Homo sapiens
  misc_feature: GYAE6OF02IC3IF.31.78.H01.1.454.CMB.1.raw
  modified_base (188)..(188): a, c, t, g, unknown or other
  misc_feature (188)..(188): n is a, c, g, or t
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcctacggggacatcgtgatgagtccagtttccagactccgtggctgtntctcgtgggcgaggacggccacatccaacgtgacaagtccagccagagtttgttttacttcggacccctaacaacttaaccaaaccttactagtaccttacggacctaggacaaggtaaaaggtacggacacgtacctacccgtaaacgttcccgtatacgtttaccgngggtccttaccggtaccccgggtntaaccggttcccggggtttaccaaaccggttattacgtacgttacgggccagggtccggggttccgtcgggaaccgttacttaccgtacgttcctacgtacccgtaatccgaacgtaccacgtcccgtaaggtccggtaacggactaaggtaacgtacggttacggtacgggtaccttaaacggttttaactttacgacgttaaccaaacgtactaaaacgttcgtttaaacctttaccggttttacctttaccggttacccgttaccgggttttaccgggaccgggtaaacgggtaccgttaaagggggtcgtaagtaacgttaaccgaaaacggtagttcggggtaccgtaccgtagtaaccccgtaacgttacccgttacgttttacggtacccgtttagtaccccg

SEQ ID NO: 65818 - DNA, 724 bp, Homo sapiens
  misc_feature: GYAE6OF02G1OYC.31.78.H01.1.454.CMB.1.raw
  modified_base (231)..(231): a, c, t, g, unknown or other
  misc_feature (231)..(231): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagagggccaccatcaactgcaagtccagccagngttgttttattcggccccaacaataacaactacttagcttgacagcaagaagtaggacagccctacctaaactcctagtatttacgtcgggtccttccgtacccgggctacggttcccggggttacctaaccgtattcgtagttcggacgacggtcgggtacgtcggggacccttatttccgactcctaccaacctatccgaagccgacgtccgtcgaccggtacggtccgtaaggaaacgtagttcgggtacggtaccgtttaaggttttaacgtttaccgttacggtacctacgtaaccaacttactttaactttaccttttacgttttccgttacgttacccggttttacgggacggggtaaaccggtaacgtaaggggtcgggtaacgtaacgttaaacggtaaaaccggtacgttacgggtacgggtaccgttacggaacccgttaacctaccgtttacccgtaccgttttaccttaccgttaacccg

SEQ ID NO: 65819 - DNA, 537 bp, Homo sapiens
  misc_feature: GYAE6OF02FKI7V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccaggctccctggctgtgtctctgggcgagagggccaccatcaactgcaagtccagccagagtgttttattggccccaccaataacaactacttagcttggtaccagcagaaagtaggacagcctacctaaactcctagtatttactgggcttcgtacccgggcatccggggtcctaaccgattcattggcagcgggtctgggaccgtatttcactctcacctatcagcagcctgcaggctgaagatgtgactgtttatacttgtcagcaactattatacttctttcgtctacgtttcgggacggtacgggacctaagggtcggagatacgtaaaacgacgtgtggactcgacaccatctgtcttctac

SEQ ID NO: 65820 - DNA, 686 bp, Homo sapiens
  misc_feature: GYAE6OF02IIFNQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagctccctggctgtgtctcgtgggcgagacgggcccaccatcaactgacaagtccagccagagttgttttattcggacccccaacaaataacaacttactagtcttggaccagcaaggaaagtaggacacgtcctacctaaacctcctagtaatttacgtgggtaccttcgtacccgggtctaacggttcccggggtttaccctaaaccggtatttacgaacgttcggctacgggtccgggtcctacgggggacccttatttaccaccgttcctaccgaacctactaccgaagacctacggtccctcgaccgacgggtacgtaggaaagtacgtggtgacttagtttacttacgtgtacagacaactattacttactttccgtttacgtccgttacgtttcgggaccggggtacgtaaccgtaagggttcggacgtaacgttacccgaaacggtaaccgttgggtacggtacgtacgtaccaaccttacgttcgttacgtcccgtttactacccg

SEQ ID NO: 65821 - DNA, 663 bp, Homo sapiens
  misc_feature: GYAE6OF02GUT2T.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagaggccaccatcaactgacaagtccagccagtagttgttttacgttcggaccccaccaataacaactacttagcttggtaccagcaagaaagtaggacagccctacctaaactcctagtactttacgtcgggtacctttaccgtaccccggggctacggttcccggggttaccctaaccgtattcagttcggcgtaggccgggtactcggggacctattttccgactcctcacctagtccagtccaacgtccctgacgacggtctagaacgtagtggtacggtacttaggttttaacttacgtgtaccgagaaccaaaccttagtttaacttaccgtttttcctttccgtacgttaaccgttttccgggaacgggtacggaacccgtaagggtacggagtactaaccggaaacggtactggtcggactcgacctacgtaccttcgtcgttacctacgttacccg

SEQ ID NO: 65822 - DNA, 632 bp, Homo sapiens
  misc_feature: GYAE6OF02HTO8W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcgccccacaataacaactacttagcttggtaccagcaagaaagtaggacacgccttacctaaactcctagtactttacgtcgggtcttccgtacccgggctacgttcccggggttacctaaccggtattacgatttcggcgaggtcgggtcgtcggggtaaccgtactttcacgtcctacacctacgtcagcacgccctgcgtaggctaggaagtataggtcggtacttaggtttacttacgtcgtacaagctaaactatttacttactttcgtttacgtcttaccggttcgggacgggtacggtaaccgtaagggtaggacgtacgtaacgaaaccggtaacgtgggtcgtacgtgaccgtaccgtacttcgtacgttccgttctaaccg

SEQ ID NO: 65823 - DNA, 699 bp, Homo sapiens
  misc_feature: GYAE6OF02F4QGD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgacaagtccagccagagttgttttattccggccccacaataacaactacttagcttgaccagcaagaaagtaggacacgccctacctaaacctcctagtacttacgtcggtaccttccgtacccgggctacgttcccggggttacctaaccggtattcctagttcggacgtacggtcgggtacctacggggacccgttagttacaccgttcctaccgaaccctacttaccgacgtaccgacgtccctggaccgtacggtctaagggaagtattcgggtcggtacgttaggtttaacttacgtgttaccgacgtactaaacgttagtttaacttaccgttttctttaccgtacttaccggtttcgggacggaacggtaaccgtaagggtcggtaacgtactaaccggaaaaccggttacgttacgggtcggtaccttacgggaccttaaccgtagttttaccaccgtttacctaccttacccgg

SEQ ID NO: 65824 - DNA, 670 bp, Homo sapiens
  misc_feature: GYAE6OF02FGROD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgttttattcggccccacaataacaactacttagcttggtaccagcaagaaagtaggacagcctacctaaactcctgtatttactgggactttccgtaccccgggctacgttcccgggggtttacctaaccggtattcctagtttcggactacgggccgggtcgttacggggaccccgtagttttccaccgttctacccaaccctattccaagtccacggtccctgccgaagggtctaggaaaggtagttggtcggacttaggtttaacttcgtgttacagtctaaacgttactttactacttttccgtttcgttacgttaccttttaccgggtcggtaaacgggtaacctacggggttaggtacgtaatacccggtaaaacgtacgttcgggtacgtcgtaggacctaccgtacttcgttaccgttctttaccgtaccg

SEQ ID NO: 65825 - DNA, 766 bp, Homo sapiens
  misc_feature: GYAE6OF02IASY4.31.78.H01.1.454.CMB.1.raw
  modified_base (193)..(193): a, c, t, g, unknown or other
  misc_feature (193)..(193): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcccgtacggggacatcgtgatgagcctagtttccagtacctccctggacctgtntctacgtgggcgaggagggcccaccatcaactgacaagtccagccagtagttgttttactcggacccccaacaaactacaaacttacttacgcttacggtacagacaagaaacgtgacacgacctaccgtaaactccttagtacttacgtcggtaccttacgtacccgggactacggtaccccgggtttactaacccgtagttcacgttacggccgtagggttacccggggtctacgggggtaacccttaagttttacccgacgttaccttaccgaaacccgtataccggtaacgtcgtaccgtacccgttcgaaccggtagggtcctaaaggtaagtacgttacgggacggtactttaagtttaaccgttattacggttaccgaaagtacctaaaccttacgttttaacgtaaccgttttccctacgggttaccttacgggtttaccgggaaccgggtaaacgggtaccggtaagggttcggtaacgtaacgttaaccggaaacggttaaccggtcggtaaccggttactacggtaccctaacgtacgttactcgttacccttacgtacccg

SEQ ID NO: 65826 - DNA, 672 bp, Homo sapiens
  misc_feature: GYAE6OF02IN72D.31.78.H01.1.454.CMB.1.raw
  modified_base (238)..(238): a, c, t, g, unknown or other
  misc_feature (238)..(238): n is a, c, g, or t
  modified_base (411)..(411): a, c, t, g, unknown or other
  misc_feature (411)..(411): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (651)..(651): a, c, t, g, unknown or other
  misc_feature (651)..(651): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagtagtttntttacgtccgacccctaactaaataacctaacttacgttacgtacgttaccggtaaccacgtacgaaaggtaaacggtacggaacgacggtaccctaacctaaacctccgttagtacttacggtcggtccttacccggtaccggctaccgggttcccggttaacctaacggtnttacgtagttcggacgtcgggtcggttcggacgggtaccttactcactccactacctacncgtacncgtacgtcctagacgtacgtcgtagaagtgtggtcggtaactttagtttattcgtgtacacgaactaacgttacttattaccttttcgttactaccgttacgttcgggacggtaacgacgtaagggtcacgtaagtaacgaacggtacgttcggtgtactaccgactaccgttnttacgtcttcgttaccttacg

SEQ ID NO: 65827 - DNA, 606 bp, Homo sapiens
  misc_feature: GYAE6OF02HA9OD.31.78.H01.1.454.CMB.1.raw
  modified_base (323)..(323): a, c, t, g, unknown or other
  misc_feature (323)..(323): n is a, c, g, or t
  modified_base (455)..(455): a, c, t, g, unknown or other
  misc_feature (455)..(455): n is a, c, g, or t
  modified_base (578)..(578): a, c, t, g, unknown or other
  misc_feature (578)..(578): n is a, c, g, or t
tcagcagtagacgtcacgaccggtgctcgatttagtgtgagtagtttgggtttgggggagctacaacagacaggcaggggcagcaagatggtgttgcagacccaggtcttcatttctctgttgctctggatctctggtgcctacggggacatcgtgatgagccagtttccagactccctggctgtgtctctgggcgagagggccaccatccaactgcaagtccagccagagttgttttattcggccccaacaataaccaacttacttagcttggtaaccagacaagaaagtaggacagcctacctaaactcctagatttacgngggtccttccgacccgggctacggttcccgggttacctaaccgtatttcagttcggctaggcgggttcgtacgggtacctactttccgactcgtcaccatccagccagtccgtcgacacggcttagaaagtntaggtgacttaaggtttacttcgttgtacagactaacgtattactactttctttcgtactacgtttacggacggtacggaccgtaaggtcgagtactacggaaacgtagttaggtgtacgtanaccgacctagtcgttacttccttatacc

SEQ ID NO: 65828 - DNA, 832 bp, Homo sapiens
  misc_feature: GYAE6OF02FUMKK.31.78.H01.1.454.CMB.1.raw
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggtaggctacaacaggcaggcaggggcagcaagatggtgttgcagacccaggtcttcatttctctgttgctctggatctctggtgcctacggggacatcgtgatgagccagtttccagactccctggctgtgtctctgagcgagagggccaccgatccaactgcaagtccagccagagtgttttattggccccaacaactaacaaacctagttacgtctcgggttaaccaggacctaaggaaaaacgttggggaaccaggtacccttaccccttaaaaactcccgttaggtaacttttaccgaggggtccttttcccgaaccccgggggtcaacgttccccgggggggttttacccctaaaaccggtacttttccctagtttacgggccgaacggtccgggggggtttcccaggggggaaccccgtattttccccgaactttcccttccaaaccccttanccaaacgtaccgaacggtcccttgggaccgtaacgggtacccgttaggaaagtaactcgggtacgggtccgttaagttttacgttttaaaccgttcgtaccgtaacgtaccgaaaaccttaatttaactttaacctttttaccgtttttccggttaaccttaaccgttttccgggaaccggggtaacggggtaaccccgaaagggggtttggaaaccggtacggttaaacccgaaaccgggtaaacccgtttagggtccgggtaaccgttcggaacccttaaccccgttagttacccttcggtttaacccttttcg

SEQ ID NO: 65829 - DNA, 736 bp, Homo sapiens
  misc_feature: GYAE6OF02J14G9.31.78.H01.1.454.CMB.1.raw
  modified_base (185)..(185): a, c, t, g, unknown or other
  misc_feature (185)..(185): n is a, c, g, or t
  modified_base (289)..(289): a, c, t, g, unknown or other
  misc_feature (289)..(289): n is a, c, g, or t
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagcctagtttccagctccctggctgtntctcgtgggcgagacgggccaaccatacgaactgacgaagtcccagccaaggtgttgttttagtccggcccccaacctaataacaactacttagcttggtaccngacgaagtaaagtacggactacgtaccctaactaaacctccgttagtactttacgtcggtctttccgaacccgggtctaacggttcccggggttccctaaacggtcttacgtaagttccggcaacggtccggggttacnccgggaaccgttacttttaccgaaccttcctaccgtaaccgtacgttacgcggacctaccggtccgtcggtacgcgggtacctaggtaactcgttgtacggtcgttaaaggtttcttaaccggtcgtaccgtaagtcgtaaaccgttagtttaaacgtttcctttaccgttttacgtaccgttaccggtttaccgggcgggtaaacgggtaaccgttaggggtacgtacgaaacgtttacccgaaaggttaaccgtggccggttactccgtactaacccgtcttacggtttctcccgtttacggaacc

SEQ ID NO: 65830 - DNA, 793 bp, Homo sapiens
  misc_feature: GYAE6OF02HD7XF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagcgggccaccataccaactgacaacgtccagccagtagttgttttacgttccggacccccaactaaactaaacctaaccttacttagtccttacggtaaccaagacaaggtaaagtacggaaccacgtacccttaacctaaaccttccgtagtaacgtttacgtcgggtaccttaccgtacccgggtactacggttcccggggttacctaaccgtattaccgtagttcggacgtacgggtccgggtcgtacgggtaccttacgtttaccaccttctacccaacctactaccgaacgtacctacgtccgtacggacgtacggtctaaggaacgtacgtgggttacgtacgtttaacgttttcgttacgttcgtaccgaacgtaaccgtaactttaactttaccgtttaccttttccggtttaccgtaccgtttaacccggttaccggggaccgggtaaaccggtaaccgttaaggggttacggtaccggttaaccgttaacccggaaaaccggttaggttacgggtaaccggtaccgttaaccggacctaaccggttacgttaccgtttacgttaccccttaccttaccccgg

SEQ ID NO: 65831 - DNA, 786 bp, Homo sapiens
  misc_feature: GYAE6OF02GIM34.31.78.H01.1.454.CMB.1.raw
  modified_base (446)..(446): a, c, t, g, unknown or other
  misc_feature (446)..(446): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
tcagcagtagacgtcacgaccggtgctcgatttagtgtgagtagtttgggtttgggggaggctacaacaggcaggcaggggcaggcaagatggtgttggccaggacccaggtcttcatttcctctgttgctctggatctcgtggtcgccggtacggggacactcggtgatcggacgcctagtttccacgtcctcccgtggtcttgtcgtctcgtgggacgaggacggccacctatcctaacgtgacaacgtccacgacctaggtagtttgttttacgtccggaccctaactaaataaacctacttacgttagtaccttacggaaccagaacgaaggaaacgtacgacctaccgtaccttaacctaaccttcgttagtaacggtttaccggccggttaccctcccggtacccggtccgttacccggttccgggttaaccctaacgtnttacgcgttcggacgtcgggtcggtcgtacggtcttctcactacnctaccngaccagcctacggcctggacgcggtaacgtaggtactggggtcgttaacgttacggttaattttacgtcccttacggacgttaaccgtaaacttttaccgtttactttaccggttttacccgtttcgttacggttaaccggtttccggggtaacggggaaccggtaacgggtaaacgttagggggtaaccgtagtaacccgtaaacgggtacgttaacggtccggttaccgacttaacccggacgttacgtttaccgtttcccgtcgttacccgttcctttaacccccg

SEQ ID NO: 65832 - DNA, 650 bp, Homo sapiens
  misc_feature: GYAE6OF02GWBTT.31.78.H01.1.454.CMB.1.raw
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagcgggccaccatcaactgcaacgtccagccagagttgttttacttcggcccccaacaataaccaactactagcttcggtaccagcaagaaagtaggaacagtccctacctaaaccgtcctagtactttacgngggtacttccggtacccggctacggttcccgggtttacctaaccgtattctagttggacgacggtcgggttcgtacggggtacccgtactttacactctaccacctatccagtcacgtcctcgacacggtcgtagaagtagtggtcggtacgttagtttaacgttactacgtatacgacctaacttaattacttacctttcgtttaccttacgtacgtttcgggtacggtaacggaacgtaaggtggtacgtaagtacgaaacggtacgtaggtcggtacgtacgaccgtacctcttacgtacgttccttactacccg

SEQ ID NO: 65833 - DNA, 811 bp, Homo sapiens
  misc_feature: GYAE6OF02H89U3.31.78.H01.1.454.CMB.1.raw
  modified_base (627)..(627): a, c, t, g, unknown or other
  misc_feature (627)..(627): n is a, c, g, or t
  modified_base (650)..(650): a, c, t, g, unknown or other
  misc_feature (650)..(650): n is a, c, g, or t
  modified_base (656)..(656): a, c, t, g, unknown or other
  misc_feature (656)..(656): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcggtgatgacgcctagtttccagacctccctggctgtcgttctcgtgggcgaggacgggtccaccgataccaactcgaccaaacggtccaacgccccgtaaggtacggttttacgtttttacgttacccggacccctaaaccctaaaaggttaaacctaaaccgtttaacttaacggtacttaccgggtaaaccaacgtaccgaaaaggtaaacggtaacgggaccaaccgtacccttaaaccccgttaaaaccttccgtaccgtttaagtttttaaccggccggggttaccgttttaccgtaacccccggggtaacgtaccggttaccccgggggttttaaccttaaaaccgtaatttccggtatttcggaacccggtaagggccgggtttccgggttaccgggaaccgtttatttaacaccttcgtaccgaacctacgtcgaagtccaggtcctagcgtacggcagaaacgtntggttacggttaaacgtttacgnttacgntaacgcttaaacctagtttactacgtttacttcgtccgttaacgtcgggaagtacgggaaccgttaggtaagacctaactaaccggtaaacgtcgttaggtacgtaccgtacgtacctaaacgccgtttacgttcgttacccgttagtaaccccg

SEQ ID NO: 65834 - DNA, 808 bp, Homo sapiens
  misc_feature: GYAE6OF02JQKUL.31.78.H01.1.454.CMB.1.raw
  modified_base (276)..(276): a, c, t, g, unknown or other
  misc_feature (276)..(276): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtagatgagcctagtttccagtacctccctggctgtcgtctcgtgggcgtaggacggccaccatccaacgtgacaacgtccagtccgaagtacgtttagtttttagttccggacccccctaanaaacttaaacctaaccttacgttacgtccgttacggtaacccaagaccgaaaggtaaacgtacgggaactacggtaccctacctaaaaccgttcctagtaacttttaaccggcgggtacctttacccggtaaccccgggctaaccgggtttaccccgggggttaaccccttaaaccgtaagtttccgtaacgtttccggaccgttaggggcccgggttccgtaacgggggtaaccccttagttttacccaccggttactacccctaccgttaatcccgaaggtcccgaccgtacccgtggtaaccgtacggtaaccgtacggtaaacgtacgttacgggttaggtaaccgttagttttaacgttacgttcgttaacgaacgtaacctaaacgtttagtttaacttcccgtttaccgtttacgtacccgtttacggtcggttacggaaaccggtacgtacgggacgtataacgtaacgtaaagtccgtagtacggtactacgtccgtacgatccgttacgttcttaccgtacg

SEQ ID NO: 65835 - DNA, 594 bp, Homo sapiens
  misc_feature: GYAE6OF02FU0EX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtaggacagcctacctaaactcctagatttactgggcttcgtacccgggcacgtcccggggttacctaaccgtattcattggcaggcgggtctgggaccgtatttccactctcacctatccagcacgtcctgcgaggctagaagagtgtggactagtttactacttcgtacgagtactaacgtatttactactttcgtttacgtccttacgtttcgggacggtacgggtaccgtaagggtacggacgtactaccgaaacgtacgttggtacggtactcgacctaccgtacttccgtcgttccttactaccg

SEQ ID NO: 65836 - DNA, 877 bp, Homo sapiens
  misc_feature: GYAE6OF02FIF6R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacggccaccatcaactgacaagtcccagccagtacgtttgttttacgttccggacccccaactaaattaaaccaacttaacgttagtccgttacggtaacctagacaaggaaaaggttacgggaacctacgacccttaccctaaacttcctagtaacttttacgtacgggtcctttaccggtaccccgggactacggttccccggggttaccctaaaccggtacgtttacgtacgtttacgggacctacggggtccgggttaccggtacggggtaaccccgttatttttacccgaccgtttaccctacccgaaaccctacgttaccgaacggtaccgtaacggtcccgttacgggaccgttaacggggaccttaaagggaaacgtaggttacgggtacgtaccgtttaaaggtttttaacgtaacgtttacgtaccggtaacgtaaccgtaaaactttactttaaacgtttacctttttacccggttttacgttaacccggttaaccgggttttacccgggggaaacgggttaaaccgggggtaaccggtaaaggggttaccggtaacgtaaccgttaacccggaaaacggggttaaccgttcgggttaaccgggtaccgttacgacccgtaaaccggttattcccggtttaccgttaccgtttccttaacccgg

SEQ ID NO: 65837 - DNA, 667 bp, Homo sapiens
  misc_feature: GYAE6OF02FXV42.31.78.H01.1.454.CMB.1.raw
  modified_base (379)..(379): a, c, t, g, unknown or other
  misc_feature (379)..(379): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagacgggccaccatcaactgacaacgtccagccagtagttgttttattcggacccccaactaataaccaactacttagcttggaccagacgaagaaaggtacgacacgtacctacctaaactcctagtatttaccgtcggtcttccgacccgggtctacgttcccgggttacctaacgtnttcagttcggcgacggtcggtcgtacgggtaccttagttccactcctccaccatcgacgtcgaccgtccgtgacgacggctaggaacgtgtcgtacggtcttagtttactcgtgtacgactacaatttacttacttactttcgttaccgttccttacggttccgggcgtaacgggaaccgttaggggtaccgtagtacgtaaccggtaaccgtacggttcgaaccgggtacgtacggtaaccccttaccggttacgttaccggtttccttaccgttacccgttcccgg

SEQ ID NO: 65838 - DNA, 549 bp, Homo sapiens
  misc_feature: GYAE6OF02FZJXY.31.78.H01.1.454.CMB.1.raw
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (423)..(423): a, c, t, g, unknown or other
  misc_feature (423)..(423): n is a, c, g, or t
  modified_base (544)..(544): a, c, t, g, unknown or other
  misc_feature (544)..(544): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagtagttgttttattcggccccaacaataacaactacttagcttggaccagcagaaagtaggacagcctacctaaactcctgtatttacgnggcttacgtacccgggntacgtcccgggttcctaaccgtattcagttggacagcgggtctgggaccgtatttcactctacaccatccagcacgtcctgcagctgaanagtgtgactagtttattactgtcatacaatattatacttctttcgtctacgtttcgacggtaggaacgtaggtgagactaacgaaacgtatggtcgactacgacgactagtctcgtacctntaccg

SEQ ID NO: 65839 - DNA, 573 bp, Homo sapiens
  misc_feature: GYAE6OF02GPLCQ.31.78.H01.1.454.CMB.1.raw
  modified_base (233)..(233): a, c, t, g, unknown or other
  misc_feature (233)..(233): n is a, c, g, or t
  modified_base (332)..(332): a, c, t, g, unknown or other
  misc_feature (332)..(332): n is a, c, g, or t
  modified_base (424)..(424): a, c, t, g, unknown or other
  misc_feature (424)..(424): n is a, c, g, or t
  modified_base (568)..(568): a, c, t, g, unknown or other
  misc_feature (568)..(568): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttnttttattcggccccacaataacaactactagcttggtaccagcagaaagtaggacagcctacctaaactcctgactttactgggccttcgtacccgggntacgtccggggttcctaaccgtattcagttggctaggtcgggtctggggacctattcactctcaccatcagcacgcctgcaggctagaacgngtgtggctagtttactacgtgtacgagtactaactattaacttctttccgtttcgtaccttacgtttccggacgggacggtaccgaggtgagtacacgtaaacgtactggtacgacgtacgcaacgtagtccgttagttccttntaccg

SEQ ID NO: 65840 - DNA, 704 bp, Homo sapiens
  misc_feature: GYAE6OF02H9ZQE.31.78.H01.1.454.CMB.1.raw
  modified_base (291)..(291): a, c, t, g, unknown or other
  misc_feature (291)..(291): n is a, c, g, or t
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
  modified_base (418)..(418): a, c, t, g, unknown or other
  misc_feature (418)..(418): n is a, c, g, or t
  modified_base (471)..(471): a, c, t, g, unknown or other
  misc_feature (471)..(471): n is a, c, g, or t
tcagcagtagacgtcacgaccggtgctcgatttagtgtgagtagttgggtttgggggagctacaacaggcaggcaggggcagcaagatggtgttgcagacccaggtcttcatttctctgttgctctggatctctggtcgccgtacggggacagtcgtgtagtgagcctagtttcccaagtcctcccgtggctgtcgtcctcgtgggcgaggacgggcccaccgtataccaacgtggaccaaacggtccgaacgccgagtaacgtttgtttttacgttcggacccccctaanaaacttaaaccaacttacgtacgctttacggacacgactaaggaaacgtcggacgactccgaccttaaactcctagtacttacgnggtccttacgtacccgggntacggtcccggtacctaaccggnttctagtcgactgtccgggtatcgggacctatttccgactctacaccgtctancgactacgcgtacgacgtcgtacgtacgaaagtcgtaggtcgtacgtagtttagtaccgtgtagtccgaacaaccttaagtttaaccctacgttttaccgtacccgttgtaccgtttacggcggggttaacgaaaccgtacgggtacggtaacgtaccgtaaagtaaaccggtagtacggtacggtccgttcgaaccgtacgttaacttccgttacgtttacctacgttaccg

SEQ ID NO: 65841 - DNA, 773 bp, Homo sapiens
  misc_feature: GYAE6OF02JZKL7.31.78.H01.1.454.CMB.1.raw
  modified_base (235)..(235): a, c, t, g, unknown or other
  misc_feature (235)..(235): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
tcagcagtagacgtcacgaccggtgctcgatttagtgtgagtagtttgggtttgggggaggcgtacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgcaagtccagccagngttgtttatcgcccaacaataacactatagcttggaccagcaagaaagtaggacagccctacctaaactctagactttacgnggtccttccgacccgggntacgttcccggggttaccctaaaccggtattccgtaagttcggacctaacggggtccggggttaccgttacggggaacccccttaagttttcccaacgtttccctacctaaaccccgtattacccgaacggcccgtaacggtcccgtacggtaccgtacggtaccctaagggtaaaccggtaagttcgggttacgggtaaccgttaggttttaacgtttaaccggttacgttaccgaacggtaacctaaacctttaagttttaacctttaacccgttttcgttttaccggtaaccttaaccggttttaccgggaaccgggttacggaaaccggtaagggttaccgggtaagtaaccgtaaccggtaaaccggtaacgttggtaaccggtacgtcggtaacctaaccgtagttacccgtaggtttaccttacctaaccg

SEQ ID NO: 65842 - DNA, 634 bp, Homo sapiens
  misc_feature: GYAE6OF02H67ZY.31.78.H01.1.454.CMB.1.raw
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaatgcaacgtccagccagtgttgttttattcggacccccacaataacaactacttagcttggtaccagcaagaaagtaggacacgtcctaccctaaactcctgtactttacgtggtccttcgtacccggctaccgtcccggggttacctaaccgtnttctagttgctaggcgggtntcgggaccgtagtttcacttctacaacactcacgcgacgcctgccgtacggcgtagaagtatggtagaccgttaagtttacttacgtgtacgaagtacctaaactatttaacctttactttccttttacgtccgttaacgtttccgggacggtaacgggtaaccgtaagggtacggaacgtacgtaacgtaaacgtaacgttggtacgtcgtacgtaccgtaccgtaatcgttacgttccttataccg

SEQ ID NO: 65843 - DNA, 647 bp, Homo sapiens
  misc_feature: GYAE6OF02IK0F0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaagtccagccagtagttgtttttattcggcccccaccaaataaccaactacttagcttaggtaccagcaagaaagtaggacagcctacctaaacctcctagacttttacgtgggtcctttccgtacccgggctacgtcccggggtttacctaaaccggtactttccaagttcggccgaaggccggggttcctggggaacccgtatttaccaccttacctccaaccatacctagccaagcctagcaggcttagaagatgtggtctaagtttacttactgtacagaccaaatattaactacttttctttaccgtcttacgtttccggacgggtacggaacccgtaagggtaggagtaactacgtaaaacggtaacttcgggtaacggccgttagaccgtaaccctacgttaccttgttacccttctaacg

SEQ ID NO: 65844 - DNA, 639 bp, Homo sapiens
  misc_feature: GYAE6OF02GOGID.31.78.H01.1.454.CMB.1.raw
  modified_base (232)..(232): a, c, t, g, unknown or other
  misc_feature (232)..(232): n is a, c, g, or t
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgcctacggggacatcgtgatgagccagtttccagactccctggctgtgtctctgggcagacgggccaccatcaacgtgcaagtccagccagagtnttttattcggcccacaataacactacttagcttggaccagcaagaagtggaacagccctcctaaactcctgatttacngggcttcgaccggcagtccgggttaccaacgtnttcnttgcaggcggtctgggaccatttcgactcgtaccacgactcgacncacgtccctgcctagggcctaggagtacgtggttacgacgttacggtttacttacgtacgttacacgtactaaaccgttattacttaaccgttttacttttccggtaaccttccgttttacgggccggtacggtaacccgtaagggggttcaggtaacttaaccggtaaaccggtaaccgtttaggacggttaccttacggacctaacccgttagtaccgtttacggttacctttaccggtaacccc

SEQ ID NO: 65845 - DNA, 667 bp, Homo sapiens
  misc_feature: GYAE6OF02G260B.31.78.H01.1.454.CMB.1.raw
  modified_base (433)..(433): a, c, t, g, unknown or other
  misc_feature (433)..(433): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagagttgttttattcggccccacaataacaactacttagcttggtaccagacaaggaaagtaggacacgccctacctaaacgtcctagtactttacgtcgggtcctttaccggtacccggggctaacggttccccggggttaccctaaaccggtatttcgaacggtttcggaccgtaggtccggggttctagggggtaaccctnttttaccgacctcctaccaccctagtccaggcacgccctagaccggaggtcgtagaagtagtcggtaggtacttaagtttacgtacttgtactacgactaactatttattacctttcgtttactaccgtacgtttcgggacggtacggtaaccgtaagggtcgacgtataaccgtaacggtaacttgggtacgtacgtactaccgtaacgtctacgttacgttactacgttacc

SEQ ID NO: 65846 - DNA, 699 bp, Homo sapiens
  misc_feature: GYAE6OF02FR364.31.78.H01.1.454.CMB.1.raw
  modified_base (338)..(338): a, c, t, g, unknown or other
  misc_feature (338)..(338): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgttttattcggccccacaataacaactactagcttggaccagcagaaagtaggacagcctacctaaactccgtgtactttacgtcgggcttccgtaccccgggntaacggttcccggggttaccctaaccggtactttccgagttcggaccgtacgggtccggggtcgttacgggggacccttagttttccaaccttccgtaccaaccctatccgaagccgtacgcccgtgccgaacggtcgtacgaaaggtattgggtacggtacgttaaggttttaacgttacgttcggtacctaacgacctaaacttactttaaccttacttttaccgttttccgtaccgttaccgtttcggggacggtaccgggtaaccgtaagggtcggtagtaacgtaaccgaaaaccggtacgtcggtacggtacgtaccggtaccaccgttacgttcgtacgttccttacggtaccc

SEQ ID NO: 65847 - DNA, 531 bp, Homo sapiens
  misc_feature: GYAE6OF02F3EE4.31.78.H01.1.454.CMB.1.raw
  modified_base (494)..(494): a, c, t, g, unknown or other
  misc_feature (494)..(494): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcatgatttactgggtcttctacccgggcacgtccggggttacctaaccgattccattggcagcgggtctgggaccgtatttcactctcaccatcagcagcctgcaggctgaagagtgtggctagtttattactgtcagtcaactattatactttctttcgtctacttcgggcggtacgggaccaaggtcgganagtacaaacgtactggtggctcgcaccatctgtcctc

SEQ ID NO: 65848 - DNA, 765 bp, Homo sapiens
  misc_feature: GYAE6OF02GF2HG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtcgtctcgtgggcgaggacggccaccatcaactggacaacgtccagccagacgtttgttttacttccggacccctaacaaacttaaaccaactacttacgcttacggtaaccagacaaggtaaacgtaggaccacgtacccttacctaaaacgttccgtacgtaacgttttaccgtggggtacctttaccggacccgggtaccgtaacgggtttacccccgggggtttaacctaaaacccggttactttaccgtaaggttcggaccgtaagggtccgggttacgtacggggtacccgtatttccgaaccttctacccgacctaagtccaacgggacctaccggcccgtgacccggtacggtacgttaggaaacgttacgtgggttacgtaacgtttagtttactttaccgtgtacgtacgaactaacgttaactttaacgtttcctttacgtttaccgttccgttaaccggtttcgggaaccggtaaacggtaacgtacgggtaggtactaacgtaaccgaacgtaacggtacggtacgtacgtcgtaccacgttactagttcttaccggtcttaacccg

SEQ ID NO: 65849 - DNA, 792 bp, Homo sapiens
  misc_feature: GYAE6OF02JDP2K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaacgtccagccagagttgttttattcggccccaactaataaccaactacttagcttggtaccagcagaaagtggacagccctacctaaactcctagtactttaccgtcgggctttccgtaccccggggtctaagttccccgggggtttcctaaacccggtatttccgaacgtttgggaccgtaacgggtccggggttaccgtcggggggtaaccccgtaacggttttttcccaaccgtttcccgtacctaacccgtacgttccgtaagcccaacgtccccgtttacggccgtaaacgggccttaacgggtaaaggtaccgttggtacgggtaccgtttaggtttttaacttaaccgttggttacaacggtactaaaccgttaatttaactttaccgttttaaccgtttccgttaccgttacgttttaacccggggtaccggggtaaacggggttaacccgtaggggttaaccggtcgaacgttacggaaaaccgttaacggttcggttaaccgggaccgttacggtaccctaacccgtaagttcccggttacgtttacccgttccgttaacccg

SEQ ID NO: 65850 - DNA, 540 bp, Homo sapiens
  misc_feature: GYAE6OF02GH1TY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaaactgcaagtccagccagagtgttttattggccccacaataacaactacttagcttgtaccagcagaaagtaggacagcctcctaaactcctgattactgggcttctacccgggctagtccggggttacctaaccgattcattggcagcgggtctgggaccgatttcactctcaccatcagcagcctgcaggctagaagatgtggactagtttatactgtcagcaactattatactttctttcgttactacgtttcggcggacggaaccgaaggtgagtacgtacgaaacgtaactggtacgctgacctacatcgtacgttcttctacg

SEQ ID NO: 65851 - DNA, 726 bp, Homo sapiens
  misc_feature: GYAE6OF02JXA8F.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgccaagtccagccagtgtgttttattcggccccacaataacaactactagcttggtaccagcaagtaaagtaggacagccctacctaaactcctagtattactgggcttcgtaacccgggtcgtacgttcccggggttaccctaaccggattcgtaagttcggcgtaacggtcggggttctacggggtacccgtatttccgaaccgttcctacctaacccacgttcgaacgccgacgcccgttcgacgtacggtacgtgtaaacgtagtacggtacggtacgtaaggtttaactttacgtcgtacacgaccgtaaacttacgtttattaaccgttttcgtttaccgtacgttaccgttttaccggggtccgggtaaacgggtaacccggaagggttacgggaacgtaacggttaaccgaaaaccgggtttaaccgttagggttacgggtaccgttacgtaccgttaacccgtaacgtttccgttaacggtttaccctttaccgttaacccg

SEQ ID NO: 65852 - DNA, 839 bp, Homo sapiens
  misc_feature: GYAE6OF02G6KNZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggctgtgtctcgtggcgaggacggccaaccatacaactgacaacgtccagccagtagttgttttacgttccggacccccaacaaactaaactaacttacttagcttacggtaccagacaagaaagtaggacacgtacctacctaaactccgtagtactttacgtcggtaccttaccggtacccgggtctacggttcccggggtttaccctaaaccgtcttccgtaagttcggacgtacggtccggggtacgttaccgggggtacccttaatttcccgtaccgttaccctacccgaaccctaagtcccgtaaacgccgtaaccggtcccgttacggaccgtaacgggtaccgttaacgggaaacgttacggttacgggttacgggtaccgttttaaaggttttaaccgttttacgtacggttaccgtaaaccgtaaccgttaaacgtttaagtttttaacccgtttaacccgtttttccgtttacccgttaacccgtttaccgggttttaccggggaaccggggtaaacggtaacccgggttaaggggttacggtacgtaaaccgttaaccggtaaaaccggttacgttcgggtaaccgtccgttaacgacccgtaaccgttagtttcccgtaccggttttacctacccgtttacccg

SEQ ID NO: 65853 - DNA, 1037 bp, Homo sapiens
  misc_feature: GYAE6OF02J3OMR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgaccgtacgggacagtcgtgatgacgctacgttccacgtcctccgtgtctgttcgtctcggcgggacgacggaccggaccaccgtactacctaacgtacgacctaacggtaccgaacggtaccgtaaggttacggttttaaccgttttttaacgttcccccgggaaccccctaaaccgttaaaaaccgttaaaacccgttaacctttaaccggttaaccgttaccggttaacggttaacccgaacggttaaccgaaaacggggtaaaaccggttaacccggaacctaccgttacccctttaaaccctaaacccgtttcggtaaaccgttttaaccgtttacggtacccggtttaccccgtttaacccccggggtaaaccccgggttaccctttaaccgggggttaacccccgggtttaaacccgttaaaccggttacccgtttaaacggttccggtaaccggtacccgggtaccgggggtaccgttacccgggtaccgggttaaacctttccggtttaaccctaaacccggtcccctttaacccgaacgttaaccccgttacgggtaaacccgcccggttacccggaacccgttaacgggtccggttaaccggtaaccgggtaaagttaaaccgggtttcgggttaccggttaaacggtcgtttttaacgtttaaaccgttccgtaaacccggtactaacccggtaaacctttaactttaacggtttaaccttttcccggtttaacggttacccgtttaacccggtttaccggggtaacgggaccggtaaaccggttaacgggttagtaactaccgtaacgttaaacggaaccgtcgtacggttcccgaacgtccggtcccttaagtcctttccggtactttacccgcctttaacgg

SEQ ID NO: 65854 - DNA, 659 bp, Homo sapiens
  misc_feature: GYAE6OF02I4AX7.31.78.H01.1.454.CMB.1.raw
  modified_base (472)..(472): a, c, t, g, unknown or other
  misc_feature (472)..(472): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcggtgatgacgcctagtttccagactccctggctgtcgtctcgtgggcgaggacgggccaccgatcaactgacaagtccagccagtagttcgtttttattcggaccccaacaataacaactacttagcttcggtaccagcaagaaagtaggacagtacctacctaaactccttgtactttacgtgggtcctttccgacccgggtctacggttcccggggttacctaaccggtacttcgagttcggactacgacgggttcgtcgggactactttcgaccttctcccgaactataccgagtaccagtccgtagacgacggntagtaagacgttggtacggtcttaacggtttacttacgttacgtcgaataccgaaattacttaacttctttactttcgccttagttccgggacgggtaacgacggtacgtagggactactaaccggaaaacgtacttaggtacgtcgtgaccgtactacgttcgtacgtttaccttacgtttacccg

SEQ ID NO: 65855 - DNA, 707 bp, Homo sapiens
  misc_feature: GYAE6OF02I4UFF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttcagacctcctggctgtgtctcgtgggcgagacgggccaccatcaacgtgacaacgtcacgccagagttgttttattcggaccccacaataacaactatacgtctcggtaccagacaagaagtaggacacgtcctaccgttaaactcctagtacgtttacgtcggtccttaccgtacccggataccggttaccggggttacctaaccgtattcgaagttcggacgtacggacgggtccgtacggggtaccctagtttaccgaccttcctaccgtaacctagtacctacggactacgcccgtagcgtacggacctaggtaaatacgtggtacgtagttactttaacttcgtacgtacacgtacctaaattacgtttactaccgttttacgttacttaccgtaccgtttacgggaccgggtaacggtaacccgaagggtttaggaccgttaacgtaacgtaaaccggtacgttaaggggtaccgccgttaacgacccgttaaccgttacgttaaccggtcgtttaccccgtagttaacccc

SEQ ID NO: 65856 - DNA, 671 bp, Homo sapiens
  misc_feature: GYAE6OF02JU2RD.31.78.H01.1.454.CMB.1.raw
  modified_base (370)..(370): a, c, t, g, unknown or other
  misc_feature (370)..(370): n is a, c, g, or t
  modified_base (459)..(459): a, c, t, g, unknown or other
  misc_feature (459)..(459): n is a, c, g, or t
  modified_base (644)..(644): a, c, t, g, unknown or other
  misc_feature (644)..(644): n is a, c, g, or t
tcagcagtagacgtcacgaccggtgctcgatttagtgtgagtagtttgggtttgggggtaggctacaacaggcaggcaggggcgagcaagatggtgttgcagacccaggtcttcatttctctgttgctctggatctctggtgcctacggggacatcgtgatgagccagttccagacctcctggctgtgtctctgggcagagggccaccatccaatgacaagtccaagccagacgtgtttttaacttcggccccctaaccgaaataacctaacctacttaacgtccttggtaaccacggtacaagtaaaaggtggaacagccctacctaaaacgtcctgtaactttacgagggtccttcgtaccccggggntaacgtcccggggttaccctaacccggattcgaacgtttggccgaacgtccggggaacttcgggggaaaccctagtttccaaccgttcncgtaacccatcccgaagtccacgtacctcggtaccaagggtccctaaggaaactacggtcgttacgggacttaggtttaactttgcgttaacacgtaccaaactgtttaactacctttctttaacgcttaacgttcgggtacggaacgtaaccgagtcgagtactacggaaacgtagttgtacgnttcacgtctactcgttagtccttcgac

SEQ ID NO: 65857 - DNA, 730 bp, Homo sapiens
  misc_feature: GYAE6OF02H9E2X.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccacatcaactgcaagtccagccagagtgttttattcggccccacaataacaacttacttagcttcggtaccagcagaaagtggacagcctacctaaactcttagtatttacgnggtccttaccgtacccgggctagtccgttacggggttaccctaaccgtatttccaagtttcggcgacgggcgggttcgtcgggaccctattttccacttcctctaccatcacgcacgtacctcggacacggtacgtagaacgtagtacggtggtaccgttaagtttttagttaaccgtttggtaccgtacggtaacctaacttaacgttttaacctttacccgtttttccgttttaccgtttacccgttaaccgtttttaccggggaccgggtaaaccggggtaacccgtaaggggttacggaacggttaaccgttaacggtaaaacccggttaacggttacgggtttacgggacccgtttacggaacccttaccggtaacgtttacccggtttaccggttacccttttcccg

SEQ ID NO: 65858 - DNA, 752 bp, Homo sapiens
  misc_feature: GYAE6OF02ISX83.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacgggccaccatccaacgtgacaacgtccagccagagttgtttatcggcccaacaataacaactactagcgttaggtaccagacaagaagtagacacgccctactaaactctagtactttacgcggtaccttaccgtacccgggactacggttcccggggttaccctaaaccggtacttaccgagttcggaccgacggtaccgggttcgtaccggggtaaccttaacgtttcctaaccttacctccaacccgtattaccgacgaccgtacggtcctacggacgacggtcgtaggaaacgtagttcggtacggtacttaaggttttaacgttacgttcggtaacacgtaacctaaacgttaactttaccgtttaaccttttccgtttaccgttacgttaacccggtttacggggaaccgggtaaacggtaacccgttaaggggtacggtacgttaaccgtaaaccggtaaaccgttaaacggtcgggttaacggcccgttacggtacctaccggttaacttaccgtttcggttacccgtttactacccg

SEQ ID NO: 65859 - DNA, 652 bp, Homo sapiens
  misc_feature: GYAE6OF02JXWOF.31.78.H01.1.454.CMB.1.raw
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctctgggcgagacgggccaccatcaactgacaacgtccagccagagttgttttattcggccccactaataacaactactagcttcggtaccagcaagaagtaggacacgaccgtacctaacctcctagtacttacgtggtcttccgtacccgggcgtacgttccgggttccgtaaccgtacttactacgttcggcgtagcggtcggtcggtaccgtacgttnaccccccccgttntccactactcacgtctacgccgtcgcgtacgcgtagtaagtagtgtgtacgttacgttacttacgttcgtacgtacgtactacttaattacgtttactttaccgtttccgttacgttaccgtttcggtaccgggtacggtaaccgtaacgggtacggagtactacgtaaacgtaacgttcggtacggtacgtacgtaccgtaccgtacttaccgtacgtcttactaccg

SEQ ID NO: 65860 - DNA, 762 bp, Homo sapiens
  misc_feature: GYAE6OF02GV0JC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatccaactgcaagtccagccagtagttgtttttacttcggcccccaactaactaaaccaacttaccttagctttggtaccagacagaaaaggtaggacacgtcctacctaaactcctagtaactttacgtcgggtcctttccgtacccgggctacggttcccggggttacccttaaccgtactttacagtttcgggacctagggtcggggttccgtacggggtaacccgttacttttaccgaccgttcctaccctacccgtactacctaacgccgtaacgtccccgttaggacccgaagggtaccttagggtaaacgtaggttcggtacgggtctttaaggtttttaacgttaccgttggtaccagtaacctaaacttaacgttttactttaccttttccggttttaccgttaccgttaccggttttaccgggacggggtaaccggtaaaccgaacggggttacggtagttaacgtaaccggaaacggtaacgttagggtcggtacgttcggaccttaaccgtaggttccctttacgggtttaccttcgtaacccg

SEQ ID NO: 65861 - DNA, 785 bp, Homo sapiens
  misc_feature: GYAE6OF02H1I72.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcctggctgtgtctcgtgggcgaggagggcccaccatcaacgtgcaagtccagccaagtagttgtttttacgttcggacccccaacctaaataaacctaacttaccttaagcttacggtaccagcaaggaaagtacggaacacgtccctacctaaacttccgtagtactttacgtcggtcttccgtacccgggtctacggttccggggttaccctaaccgtattacgacgtttcggcgtaagggttccggtacgtacggggaacccgttacttttcgacccttactacccaacttacgtacttaccgaacgtaccgtaccggtacccgtcggaaccggtacggtacgtaacgggtaaacgtacggttaggttaccggttaacgttacgttttaacgtttaccgttcgttaaccgtacgtaaccttaaacgttaactttaaccgttaccgtttttccgtttaacccgttaccgttaccgggttttaccgggaacgggtaaacggtaccgggtaaggttacgggaagtaaacgtaaccgtaaacgttaacgggttacggtacggtaccgtacggtaacccaccgttacgtacgtttaccggtcttacccgg

SEQ ID NO: 65862 - DNA, 597 bp, Homo sapiens
  misc_feature: GYAE6OF02IIGKE.31.78.H01.1.454.CMB.1.raw
  modified_base (407)..(407): a, c, t, g, unknown or other
  misc_feature (407)..(407): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggcccaccatcaactgcaagtccagccagagtgttttattcggccccaccaataaccaactacttagcttggaccagcaagaaagtaggacagtcctacctaaacctcctagtactttacgtggtccttcgtacccgggctacgtccgggttacctaaccggattcattcggcaggtccgggtcgtacgggaccgtatttcactcnccaccatcagcacgcctgcgaggctagaagatgtggtctagtttattactcgtacagactaatacttactaccgtttctttacgttaccttaccgttcggaccgggtaacgggtaaccgtaagggtaggacgtaacgtaaccgaaacgtaacgtggtacgacgtcgaccacgtatcgtcgtccttatacc

SEQ ID NO: 65863 - DNA, 649 bp, Homo sapiens
  misc_feature: GYAE6OF02F87PI.31.78.H01.1.454.CMB.1.raw
  modified_base (332)..(332): a, c, t, g, unknown or other
  misc_feature (332)..(332): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
tcagcagtagacgtcacgaccggtgctcgatttagtgtgagtagtttgggtttgggggagctacaacaggcaggcaggggcagcaagatggtgttgcagacccaggtcttcatctctctgttgctctggatctctggtgcctacggggacatcgtgatgagccagtttccagacctccctggctgtgtctcgtgggcgaggacgggcccaccatccaactgcaagtccagccagagttgtttttacttcggcccccacaataaccaactacttagcttggtacccagcaagaaagtaggacagccctacctaaactcctagtacttttacgngggtcctttccgacccgggctacgttcccgggggtttaccctaaccgtattccagttggcgaggccgggtctcggggacctattccgacttcctcgaccactcacgcacgcctgcgagcagacgagtggngcgttagtttnttacgtggtcgactactaacgtatttacttctttactttcccgtacgtttaccgttcgggaccgggtaagggtaacccgtaagggtcgggtaacgtacgtaaccggaaaccgttacggtcggtacggaccgttcgtacccgtacccgttagtttcccgttacgtttcttaaccccg

SEQ ID NO: 65864 - DNA, 628 bp, Homo sapiens
  misc_feature: GYAE6OF02I1BZW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagacagaaagtaggacagcctacctaaactcctagtatttacgtgggtccttccgtacccgggcacgttcccggggttacctaaccgattcattggcaggcgggtctgggacgtatttcactctacaccatcagcacgcctgcacggctaggaagtagtaggtacggacttagtttaactacgttagtcacgacctaaactagttaacttactttcctttacgttaccttaccgtttaccggggacgggtaccgggtaaccgtaagggtacggacgtaacgtaaccgaaacggttaacgttagggtacggaccgtacgacctaccgtagttcgtacgttaccttacgtaccc

SEQ ID NO: 65865 - DNA, 714 bp, Homo sapiens
  misc_feature: GYAE6OF02HVWBW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggcccaccatcaactgacaagtccagccaagtagttgttttagttcggacccccaacaaataacctaaactacttagcttacggtaaccagaccaaggaaaagtacggaacacgtacccttacctaaaaccttcctagtaacttttaccgtgggtcctttccggtaccccggggctaacggttcccggggttaccctaaaccggtattccgagtttcggccgtacgggtccggggttccgtacggggtaacccgttattttccgaacttcctaccgaaccctattccgacgtccgacgtcccgtggccgtagggcctaggaaagtgtgggtacggtacttaaggtttacttacgtacggtcaagtaactaactaatttacttactttccgtttacgttccgttacggtttccgggaccgggtaacggaacgtaagggtggagtacgtaacgaaacggtaacgtggtcggtacgtacggacctaccgtattccgtacttccttctacccg

SEQ ID NO: 65866 - DNA, 634 bp, Homo sapiens
  misc_feature: GYAE6OF02GIP6F.31.78.H01.1.454.CMB.1.raw
  modified_base (456)..(456): a, c, t, g, unknown or other
  misc_feature (456)..(456): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaacgtccagccagtagttgttttattcggaccccaacaataaccaactacttagcttggtaccagcaagaaagtaggacacgcctacctaaactcctagtatttacgtgggccttaccgtacccgggctacggttcccggggttaccctaaccgtattctagttcggcgaggtcgggtctacgggacctagttaccactctacacctatcacgcacgcctgcgacggctagaagtntcggtacgcgtagtttactacgtcgtacagactaacgttattacttactttcgtttacgtcgttaccgtttaccgggacgggtacgggtaacgtaggggtacgtacgtacgtaaccgtaaacggtacggtggtacggcttacgaccgtaccgtacgttcgttcgttaccttatacccg

SEQ ID NO: 65867 - DNA, 798 bp, Homo sapiens
  misc_feature: GYAE6OF02HDK9F.31.78.H01.1.454.CMB.1.raw
  modified_base (380)..(380): a, c, t, g, unknown or other
  misc_feature (380)..(380): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctcgtgggcgagacggccaccatcaactgacaacgtccagccaggtagttgttttacttacggcccccaacaaactaaaccaacttacttagtccttacggtaaccagactaaggtaaaagtggaaccacgtaccctaacccttaaaacgtccctaggtaacttttaaccgcgggtacctttccgaacccgggntaaccggttcccggggtttaacccaaccggtacttcggtaacttcggactaacgggcggggtaccgttacgggaaccgtacgttttaccgccttacgaaccctacgaccgttaccgaagccgtaacgtcccgtacgtaccggacggtacgtacggtaacggtaacgttcgggtacgtacgtttaacgtttaagtttacccgttaggtaccgtaccggtactaaaccttaacgtttaactttaccgtttaccgtttaccgtttacgttaacccgttttaccgggaccggtaacgggaacccgggttaacggacggggtaacgtaacgttaacgtaaaaccggtaacgtttagggtaaccgggttacgacgtacccggtaacttaaccgttaccggttacgtttaccgttacgttacccg

SEQ ID NO: 65868 - DNA, 676 bp, Homo sapiens
  misc_feature: GYAE6OF02FR4WN.31.78.H01.1.454.CMB.1.raw
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagtactccctggctgtgtctcgtcgggcgaggacggccaccatcaactgacaagtccagccagtagttgttttattaccggcccaactaaataacaactacttagcttaggaccagcaagaagtagacacgcctacctaactctagtaactttacgnggtccttacgcccggataccgttccgggtacctaacgtnttacgagttggcacgggtcggtcgtcgggaccttattccactcgtacacctagtcaacgcgacgccgtacgacgacggctaggaagtagtcgtacggtacttaagtttacttacgtacgtcgactacgtaaactagtttaacttacctttcgtttaccttacgttaccggttttaccgggacgggtaaacgggtaaccggtaacgggtacggtaacgtaccgtaaacggtaaaccggtaacgtcgggttaaccggtacgtaccgtacacccgttaacgttacccgttacggttccttaaccgttacccg

SEQ ID NO: 65869 - DNA, 676 bp, Homo sapiens
  misc_feature: GYAE6OF02HYOYR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactcctggctgtgtctgtgggcgaggagggccaccatcaactgcaagtccagccagagttgttttattcggcccccaaccaataacaaactacttagcttggtaccagacaagaaagtagacacgcctactaactcctagtatttacgtggtccttaccgtacccgggctacgtccgggttaccctaaccgtacttactagttcggacacgggtccgggttcgtcggggtaaccctagttttaccaccttctaccacctactcgaacgtaccaacgtccctaggaccgtacggcttaggaaaggtattagggtacggtacttaaggttttattaccgtggttacctaagaccaaacttagtttaacttacctttcctttacgtccttaccggtttcgggacgggaacggtaaccgtaagggtacgtaagactaaccggaaaccgttaagtggtaacgggttactacggaccctaaccgtgttaccccgtgtttcctacctacg

SEQ ID NO: 65870 - DNA, 634 bp, Homo sapiens
  misc_feature: GYAE6OF02GF3IJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgttttattcggccccaacaataacaactacttagcttaggtaccagcagaaagtaggacagcctactaactcctgatttactgggcttcgacccggcacgttcccgggttcctaaccgattcagttggcaggcgggtctagggaccgtatttccactcctcacctatccagcacgtcctgcaggtcctaggaacgtagtcggtacggacgttaagtttacttacgttcgtactacgactaaacgttactttaacgttaccttttccgtttaccgttacgttaccgttttacgggacgggtaacggtaaccgtaagggtggaacgtacgtaacgaaacggtaaccgttggtaacggtcgtacgtaccgtaacctagttccgtacggttacttacctacccg

SEQ ID NO: 65871 - DNA, 746 bp, Homo sapiens
  misc_feature: GYAE6OF02H1MA4.31.78.H01.1.454.CMB.1.raw
  modified_base (387)..(387): a, c, t, g, unknown or other
  misc_feature (387)..(387): n is a, c, g, or t
  modified_base (739)..(739): a, c, t, g, unknown or other
  misc_feature (739)..(739): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtcctcgtgggcgaggacgggccaccatccaactgacaacgtccagccaagtagttagttttagttcgccccaacaataacaactactagcttaggtaccagacaagaaagtggactacgaccctaccttaactcctagtactttacgcgggtccttccgtaacccgggtctaccggttacccggggttaccctaaccgtnttaccagtttcggactcggggtccgggttcgtacggggtaacccgttagtttacccacgttccctaccaacccgtagtcccaacggcccgtacggtaccccgttcggaaccgtaacgggtccgtaaggtaaacgtacggttcgggtacgggtaacctttaagttttacccgttacgttacgtcgtaaacgtaacctaaacttacttttaaactttaccttttacccgttttccgtaccgtttaccgttttacggggacggggtaaccggtaaccggtaagggttacggagttacgtaaccgaaacggttacgtcggtaggtactcgacctaccgtacgttcgtcgtaccttntaacccg

SEQ ID NO: 65872 - DNA, 813 bp, Homo sapiens
  misc_feature: GYAE6OF02JZTFK.31.78.H01.1.454.CMB.1.raw
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtcgtctcgtgggcgagacggggcccaaccgattccaacgtcggaccaaggtccacgccgtagtaggttcgtttttaacttcggacccccaacctaattaaaccaacttacttagtccttggtaaccagacaagaaagtacggacaacgtccctaccgtaaactccttaggaactttaaccgnggtacctttaccggaaccccggggtctaaccggttcccggggttttaacccaaccgttagtttccgtaaacgtttcgggactaacggggtccgggtacggttacggggtaaacccgtacgtttttccaaccgttccgttacccgtaaaccctagtttacccggaacgtccgtaacggtcccgttacggaccgtacgggtacgtacgtaaacggtagtcggtacggtacgttaacgtttaacgtttaccgtaggtacctaacgtacctaaacgttaacgtttacgttaaccttttccgtttacgttaaccgttacgttttaccggggacgtacgggtaacgtaagggtacgacggttaactaaccggtaaacgtaacggttacgggtaacgttccggtacgtaacccgttaccggtaacttacggttacgttaccttaccgtttccg

SEQ ID NO: 65873 - DNA, 677 bp, Homo sapiens
  misc_feature: GYAE6OF02F9W3S.31.78.H01.1.454.CMB.1.raw
  modified_base (236)..(236): a, c, t, g, unknown or other
  misc_feature (236)..(236): n is a, c, g, or t
  modified_base (371)..(371): a, c, t, g, unknown or other
  misc_feature (371)..(371): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatacaactgcaagtccagccagtagttnttttattcggaccccaacaataacaactacttagtcttaggtaccagacaagaaagtaggacagccctacctaactcctagtacttacgtggtccttaccgtacccggctacggttcccgggttacctaaccgtnttcgtaagttcggacagggtccgggtacgtcgggtaacctatttccgaccttcctaccacctataccgaagccgtacgccgtaggccgtaacgggtccgtaggtaaacgtacgttggtacgggtacttaaggtttaacttacgtcgtactaacggactaaacgttacgtttaacttaccgttttaccgttttcgttaccttaccggtttccggggaccgggtaacgggaaccgtaagggtacggactaacgacgtaaacgtacggtcggtaggactcgtacaccgtattcgtcgttactctacccg

SEQ ID NO: 65874 - DNA, 599 bp, Homo sapiens
  misc_feature: GYAE6OF02HD973.31.78.H01.1.454.CMB.1.raw
  modified_base (315)..(315): a, c, t, g, unknown or other
  misc_feature (315)..(315): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttattcggccccacaataacaactacttagcttggtaccagcagaaagtaggacagcctactaaactcctgatttacnggtctcgtacccgggctacgtccggggttacctaaccggtattcacgttcggactaggtcggggtactcggggaaccgtatttctactctcctaccatcagcacgtcctgcgaggtctggaaagtactggtacggtctaggttttataccgttgtactagactaatactttattacctttctttacgtctaacgtttccgggaggacggactaagggtcgagacgtacgaaacggttacttggtacgtccgtgacccgtacgtacttcttcgttactgtaaccc

SEQ ID NO: 65875 - DNA, 594 bp, Homo sapiens
  misc_feature: GYAE6OF02F5JT6.31.78.H01.1.454.CMB.1.raw
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaacgtccagccagagtgttttattcggcccaacaaataacaactacttagcttggaccagcaagaaagtagacagcctactaaactcctagtattacgtggcttccgacccggcacgttccgggttcctaacggattcagtcggcaggcggtcngggactntttcacgtcncacatcagcacgctgcagctagagntgtgntagtttatacgtgtacagataattaattacgttactttcgtttacgtacttacgtttacgggacgggtacggtaaccgtaagggtacggagtaacgtaaccgtaaaaacggtacgtaggtacggtacctacggtacctaaccggtattaccgttcggttacccttaccgtaacccg

SEQ ID NO: 65876 - DNA, 670 bp, Homo sapiens
  misc_feature: GYAE6OF02JMZ2Z.31.78.H01.1.454.CMB.1.raw
  modified_base (323)..(323): a, c, t, g, unknown or other
  misc_feature (323)..(323): n is a, c, g, or t
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggcccaccatcaactgcaagtccagccagagttgtttattcgaccccacaataacactacttagcttaggtaccagcaagaaagtaggacacgcctacctaaactcctagacttttacgngggtccttaccgacccgggtcacgttccccggggttacctaaccgtnttactagttcggatacggtcgggtactacggggactactttcgacctctacaccgtatcgacgcacgcctaggctacgctaggaagtatggtcgtactaggtttactacgtgtacagactaaactgtttactacctttctttccgttacgtaacgtttccgggacgggtaaacggtaacccggtaagggttcgggaacgttacgttaaccggaaaaccgggttaattcgggttacggaccgtttaaccggccgtaaccgttaacgttacccggtttaggtttacccttacgttaaccccg

SEQ ID NO: 65877 - DNA, 720 bp, Homo sapiens
  misc_feature: GYAE6OF02I9EBA.31.78.H01.1.454.CMB.1.raw
  modified_base (571)..(571): a, c, t, g, unknown or other
  misc_feature (571)..(571): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagcctagtttccagactccctggctgtgtctcgtgggcgaggagggcccaccatcaactgccaagtccagccagtagttgttttattcggacccctaacaaataaacctaactacttagtactttcggtaaccagtaccgaaggtaaaacggtacggacaacgtccccttaaccctaaacctccttaggtaacttttaccgtacggggtacccttttacccggtacccgggtcgtaaccgtttcccgggggttaccctaaacccggtatttccgtaagttcgggacaacgggtccggggttacgtacggggtacccgtatttaccgaccttccgtacccaacctacgttccgagcctacgcctggaccgacggctaggtaagacgtagtaggacttagtttactacgtgtacnacaactattacttactttccgttacggtacttcgtttacgggacgggtaacggtaaccgtaagggttcgagtaacgttaaccgaaacggtagttcgggtaggtacctacgaccgtacctacgttccgtacgtttaccgtttccgtcccc

SEQ ID NO: 65878 - DNA, 565 bp, Homo sapiens
  misc_feature: GYAE6OF02HQ8QV.31.78.H01.1.454.CMB.1.raw
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
  modified_base (559)..(559): a, c, t, g, unknown or other
  misc_feature (559)..(559): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatcggccccaacaataacaactacttagcttggtaccagcagaaagtaggacacgcctacctaaactcctagatttactgggcttacgccggcactccggggttacctaaccgattcattggcagcgggtcngggacgactttcactacgtacacgatnacgcagccctgcgaggtctacgaagagtgtggactaggtttaattacgtcgtacagacaacatttaactactttactttcgtactacgtttcggcgggtaggaaccgaaggtggagtacgtaaccgaaacgtaactagtcggactgacccacattctagttctnttaccg

SEQ ID NO: 65879 - DNA, 623 bp, Homo sapiens
  misc_feature: GYAE6OF02GCYJW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaaccaataacaactacttagcttggtaccagcaagaaagtaggacagccctacctaaacctcctagtactttacgtgggtccttccgtacccgggctacgttcccggggttacctaaccgtattcattcggacaggcgggtacgtcgggaccgtatttcacttctccaccatcagcacgcctgcaggctagaagatggtgcttagtttacttactgtacagactaactattacttactttcctttcgtaccttacgtttcgggacggtaacgggaccgtaagggtcgggaagtacgtaaccgaaacggtacgttacgggtacggtaccgtacggtaccctaacccgtacgttaccgttacgttccttacgttaccc

SEQ ID NO: 65880 - DNA, 659 bp, Homo sapiens
  misc_feature: GYAE6OF02G497P.31.78.H01.1.454.CMB.1.raw
tcagcagtagacgtcacgaccggtgctcgatttagtgtgagtagtttggggtttgggggagctacaacaggcaggcaggggcagcaagatgggtgttgcagacccaggtcttcatttctctgttgctctggatctctggtgcctacggggacatcgtgatgagccagtttccagcctcccgtggctgtgtctcgtgggcgaggacggccaccatcaactgacaacgtccagccagtagttgttttattccggccccaacaataacaacttacttagcttacggtaccagacaaggaaagtaggacacgacccttacctaactcctagtactttacgtcgggtcctttccggtaccccggggtctaccggttcccggggttaccctaaccgtacttcgtagttcggcagggtccgggttacgtaggggacccttagtttccacttccgtccaacctatccagtcacgccgtgcaggctagaagtgtgtgtacgttagtttactacgtgtacacgtactaacttattacttactttcgtttacgtacgttacgtttcgggacgggtacggaccggtaagggtacggagtaataaccggaaacggtaacgttggtacggcgttacgacctacgtacgttaccgttcgttaccttactacccg

SEQ ID NO: 65881 - DNA, 586 bp, Homo sapiens
  misc_feature: GYAE6OF02HOP92.31.78.H01.1.454.CMB.1.raw
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
  modified_base (414)..(414): a, c, t, g, unknown or other
  misc_feature (414)..(414): n is a, c, g, or t
  modified_base (453)..(453): a, c, t, g, unknown or other
  misc_feature (453)..(453): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggaccccacaataaccaactacttagcttggtaccagcaagaaagtggacagcctacctaaactcctgactttacgngggtccttccgtacccgggcacgttcccggggttacctaaccgtnttccattcggcaggtcgggtctgggacctatttcactctcaccatcagcngcctgcaggctagaagtagtgtcgctagtttactacgtntcagtacaattattacttactttctttcgtactacgtttccggcggtacggaccgtaggtgacgtactaccgaaacgtacgttcggtacgtccgtacgcctaccgtacgttccgttacgttccttactacccg

SEQ ID NO: 65882 - DNA, 688 bp, Homo sapiens
  misc_feature: GYAE6OF02IPQWR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtctccatttcctctgttgctctggatctctggtgccgtacgggacatcgtgatgagcctagtttccagacctccctggtctgttgtctcgtgggcgagacggccaccatcaatgacaacgtccagccagtagttagttttacttcggaccccaccaataacaactacttagcttgtaccagacagaaagtagacagcctacctaactcctgtagttactcgggtacttccgtaccggcacgttccgggttacctaaccgtattacacgttcggcacggtacggtcgtacgggtacctattttccgacttctcaaccgtatcgaagccgtacgtccctagcgacggtcgtagaaagattgggtacgtactaagttttaccgtatccgttacgaactaccgaaacgttactttaacgttaccttttacgtttccgttaaccgtttaccgtttacggggttaacccggtaacggaaccgttagggtaccgggtagtaaccgtacgtaaaaccggtaacgttcggggtaccgacggttacgaacgttaacccgttccgttacgtttaccgtaccgttacctacccg

SEQ ID NO: 65883 - DNA, 804 bp, Homo sapiens
  misc_feature: GYAE6OF02IL50E.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctcgtgggcaggacgggccaccgatcaactgcaagtccagccagacgtgttttattcggccccacaataacaactacttagcttgtaccagcagaaagtggacagcctacctaaactcctgtactttacgtcggcttaccgtacccgggctacgttacccggggttaccctaaaccgtactttcgaatttcggaccaggtccggggtctcggggtacctattttccaccttccgtacacccgtaatccgaacgctaacggccccttacggaccgtaacggggtcccttaagggaaacgttaacgttgggtacgggtaccgtttaaaggtttttaactttaaccggtttagttacccgtaaaggtaaccctaaacggttaactttttaaacgttacccgttttttctttttacccgggttaacctttaaccggttttttaaccccgggggaccggggtaaacccgggggtttaaacccgtaaagggggttttacgggaaacggtaaccgtttaaaaacccggtaaaaccgggttaaaaccttccggggttaacggtaccccgttaggtaaccccgaaccgttaccttacgtttaccggtttacctttcccgtaaacccg

SEQ ID NO: 65884 - DNA, 552 bp, Homo sapiens
  misc_feature: GYAE6OF02GVKQN.31.78.H01.1.454.CMB.1.raw
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttaggtaccagcaagaaagtagacagcctactaaactctgtactttacngggtcttcgtacccgggntacgtccgggttaccaaccgattcattggcaggcgggtctgggaccgtattcactctcaccntcagcagcctcgcnggctagagatggngctagtttatactgcagacatattacttacttcttcgtactcgtttacgggcggtacggaacctagggtagacgactacgaaacgacgttggtacgtctggaccaccgtaattcgtcgttcttactaccg

SEQ ID NO: 65885 - DNA, 683 bp, Homo sapiens
  misc_feature: GYAE6OF02HPLQ3.31.78.H01.1.454.CMB.1.raw
  modified_base (385)..(385): a, c, t, g, unknown or other
  misc_feature (385)..(385): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaagtccagccagagttgttttacttcggcccccacaataaccaacttacttagcttcggaccagacaagaaagtaggacacgccctacctaaactcctagtactttacgtggtcctttaccgacccgggtctaacggttcccgggggtttaccctaaacccggtntttaccgtaacgtttcgggcctaacggggtccgggtaccggttaccggggaaccgttacttttccgaaccgttcctacctaccacgtacgacgtaccgacgtcccgtgaccgaagggtcctaggaagtagtcggtggtacttaacgtttaacgttacttgtaccagtactaactattaacttctttcttaccgtcttacggtttccggacgggtacggaaccgtagggtacgtacgtactaaccgaaacggtacttaggacgtactacgacaccgttacttcgtcgttctactacccg

SEQ ID NO: 65886 - DNA, 800 bp, Homo sapiens
  misc_feature: GYAE6OF02GLCL0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggctgtgtctcgtgggcgagacgggccaccatccaactgaccaagtccagaccagtagtttgttttacttcggaccccctaacaaataacctaacttacttagccttaggtaccagacgaagaaaggtacggactacgccctaacctaaactcctagtactttacgtgggtccttaccgtcccgggactacggttccccggggttaccctaaaccggtgtttacctagtttcggaccgtaggtccggggttaccgtacggggtaccccgttacttttacctacccgttctacccaacccgtattcccgaacgtaccgtacgtacccggtaggaccgacgggtaccgtaggaaacgtacgttggtacgggtacttagggtttaactttaccgttagttaccgaacgtacctaaacttaagtttacctttaaccgttttccctttttacggttaccttttaaccgggttttaccgggggaccgggttaaacgggtaaccggttaaaggggtaggtacgtaaccgttaacggtaaaaaccgggttaggtttccggtagggtaccgttaccggaccctaccgttaacgtttccgttacggtttacccttacgtttaccccgg

SEQ ID NO: 65887 - DNA, 624 bp, Homo sapiens
  misc_feature: GYAE6OF02HXZ2Q.31.78.H01.1.454.CMB.1.raw
  modified_base (286)..(286): a, c, t, g, unknown or other
  misc_feature (286)..(286): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgacaacgtccagccagagttgttttacttcggaccccacaataacaaccttattagcttcggtaccgnaagaaagtaggacagccctactaaactcctgtatttacgtcggtcttccgacccgggctacgttcccgggttacctaaccgtnttacagttcggacnggtcgggtctgggacctattcactctaccaccgactcgagccacgtcctgacgacggtcgtagtaagtagtggtacggtacttaagttttacttacgttgtacacgtacaacttattacttccttactttcgtactacggttcgggacgggtaacgggtaccgtaagggtcgtaagtactaacgaaacgtacgtgtacggtctacgacgtacctacgttcgtacgttacttactactcccg

SEQ ID NO: 65888 - DNA, 889 bp, Homo sapiens
  misc_feature: GYAE6OF02F563M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagacgggccaccatcaactgcaagtccagccagagttgttttattcggccccacaataacaactacttagcttggtaccagacaagaaagtaggacacgccctaccctaaactccttagtactttacgtcggggtcctttaccgtaccccggggctaacggttccccgggggtttacctaaacccggtatttaccgtaacgtttgggaccgtacgggtccggggttaccgtacgggggtaacccgttaacgtttttaccaacccgtttccgttaaccctaaccccgtaacgttacccgtaacggacccgaaccggtccccgttagggaccccgtaaacggggtacccgtttaacgggaaaacgggttaacggttcggggttacggggtaacccgttaacgggttttttaaactttaacccgtttacggttaccgtaaacggtaccctaaaaccgttaacttttaaacgtttacccgtttttacccgtttttacccggtttaccgtttaacccgggtttttaccgggggaccgggttaaacgggggtaaacccgttaaaggggggttacgggtaacgggttaacgttaacccggtaaaaacggtaaacccgttaggggttaccggtacccgttaccgggtaccctaacccgttaaccgttaccgtttacggttacccgtttaccttaaccccg

SEQ ID NO: 65889 - DNA, 815 bp, Homo sapiens
  misc_feature: GYAE6OF02IBZPD.31.78.H01.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtggcgagnggccaccatcaactgacaacgtccagccagacgttnttttagttcggacccctaacaataaccaactacttagcttgtaccagtcagaaagtaggacagtaccctacctaaacgtcctagtatttacgtgggtcctttccgtaacccgggntaaccgttcccgggggtttacctaaaccgtnttaccacgtttcggacgacggtccggggttacgttcggggaacccgttacttttccgtaaccttaccgttacaaccctacgttccgaacggtcaacggtcccttacgaccggaacgggtacctttaagggaaaggttagttcgggtttagggaccgtttaaggttttaacttttaccggttaggtacctaacgggaaccttaaaccttaaacttttacgtttaaccctttttaccggtttttacgttacccggttacccgttttttacggggggaacccggtaacggggggttaaacccttaagggggttacgggtaacggtaaaccgtttaaccggtaaaaccgggtaaaccgtttcgggtacggggttacctttaccggggaccttaacccggtacgtttacgtacccgggtttcctttaacgttaccccgg

SEQ ID NO: 65890 - DNA, 767 bp, Homo sapiens
  misc_feature: GYAE6OF02F9CHB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggccaccatcaactgcaagtccagccagtagttgttttattcggaccccaacaataacaactacttagcttgtaccagcaagaaagtagacacgtcctacctaaactcctgtatttacgtgggtccttaccgtacccgggctacggttcccggggtttaccctaaaccggtatttaccgtagttcggaccgtacgggtccggggttaccgtacgggggaacccgttacgttttccaaccgttcctacccaacccgtacttccgaacgtacctaacggtccctcggaccgaacgggtccgtaaggaaacgtagttacgggtacgggtaccgtttaagggtttttaactttacgttcggttaaccgaacggtaaccctaaaacttaacgttttaactttaaccgtttttccgtttttacccgttaccgttacccggttttaccggggaccgggtaaacggggtaacccgtaaggggtacggtaacggtaacgtaaccgtaaaacggtacgttacgggtacggtcgttacgacctacctacgttcctcggtttacctactacccg

SEQ ID NO: 65891 - DNA, 608 bp, Homo sapiens
  misc_feature: GYAE6OF02GHXVL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataaacaactactagcttggtaccagcagaaagtaggacagcctacctaaactcctagactttactcgggtcttaccgtacccgggctaacgttcccgggggttaccctaaccggtacttcaagttcggctacggcgggtctacggggtacccgtattttaccacgttctaccaacctatccacgcacgtcctgacgaggtactaggaaacgagttggtggacgtaagtttatacttgtacagacaaactattattacttctttacgtactacgtttcgggacggtacggaaccgtaagggtggagatacgaaacgtaacgtggtacggatacgactaccgagtctattcctctac

SEQ ID NO: 65892 - DNA, 769 bp, Homo sapiens
  misc_feature: GYAE6OF02HLQ7L.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagtttccagacctccctggctgtgtctcgtgggcgaggacgggccaccataccaactgacaagtccgagaccgagtacgttgttttacgttcggacccccaactaaactaacctaacttacgttagtcttacggtaaccacgtacaagaaaacggtagaccacgaccctaccctaaactcctagtagttaccgtcggtccttaccggtacccgggtacacggttcccgggttaccgtaaccgtattactaagttcggacgaggtcgggtacgtacggggtacccttacttaccgtaccgtctacccacgtacgcctacgtaccgacggtcccgtagacgtacggtaccgtaggtaaacgtgttcgggcggtactttaaacggttttatttacccgtagttaccgaacgtaccaaaccgttaattttaccggtaacccttttccgtttacccgggtaccttaacccgggttttaccggggaacggggtacgggtaaccgttaagggtaggggtacctaaacgtaccgaaaaccggtagtacggtccggtaacgtacccgaacctaccgtaccgtttacgtttacttcccggttatacccccgg

SEQ ID NO: 65893 - DNA, 727 bp, Homo sapiens
  misc_feature: GYAE6OF02JJHXF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagtgttttattcggccccacaataacaactacttagcttaggtaccagcaagaaagtaggacagcctacctaaactcctgactttacgtgggtccttaccgtacccgggactacgttcccgggggttaccctaaacccggtattacgacgtttcggccgtaacgggtccggggttccgttacgggggtacccgtaacgttttaccgaccgttaccgtaccgtaaccctactaccgtaacgccaacgtcccgttacggccgtaagggtcgtaaggtaaagtacgttggtacggtacgttaaggttttaacttaccgttggttaccgacgtaccaactaagtttacctttaacgtttcttttaccgtaccttaccggtttcgggaccgggtaacgggtaaccgtaagggttacggagtaactaaccggtaaaacggtaacgttagggtcggtacgttccgaccttacccgtactttccggtactttccgttacttacccg

SEQ ID NO: 65894 - DNA, 776 bp, Homo sapiens
  misc_feature: GYAE6OF02J22OR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgcagtttccagtacctccctggctgtgtctcgtgggcgaggacggccaccatcaactgcaacgtccagccagagttgttttacgttcggaccccaactaactaacaactacttacgcgttggtaccacgacaacgaagtaggacgacgaccttacctaaactcctacgtacttaacgtcgggtccttaccgtacccgggtcgtacgtccggggttaccttaaccgtacgttactcgttaaaaacggtccggaacggtccggggtacgttacggggtaacccgttacgttttaccgtaccgttaccgtacccgtaacctaccgttaccggaaacgtcccgtaaccgtcccgtcggtaccgaccgggtacgttacggtaaacgtaacgttacgggttacggtacgttaacggttttaactttaaccgttacggtaccgtacgtaaccgtaaccttaactttaaccgttaccgttttaccgttttacgttaccgttaccgggtttacgggtaaccgggggtaccgtaaagggtacgggacgtacgtaactaacggtaaacgtcggtagtcgtacgtacgtaccgtactccgttacgtacttaccgttacgttccccgg

SEQ ID NO: 65895 - DNA, 705 bp, Homo sapiens
  misc_feature: GYAE6OF02FJVZY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacggccaccatcaactgcaagtccagccagagttgttttattcggaccccaaccaataaccaactactagtcgttggtaccagcaagaaagtaggacagccctacctaaactcctagtatttacgtgggtccttccgtacccgggctacgttcccggggttaccctaaccggtattcctagtttcggacgtacggcgggttcgtcggggtaaccgtacgttttaccacgttacctccaacccgtattccgacggcctacgcctaggccgtaggtcgtaggtaagtagtacggtcggtacgttaacgttttacgttacgtagtacgacgtactaacgttaacgtttactacccgttttcgtttaccgtaccgtttaccggtttacgggaccgggtaacgggtaacccgtaagggtacgggaacgtaacgttaaccgtaaaaccggtacgttacggtcggtaccgtacgacccgtaaccgtagttaccttcgttaccgttcgtaacccg

SEQ ID NO: 65896 - DNA, 739 bp, Homo sapiens
  misc_feature: GYAE6OF02GRJHA.31.78.H01.1.454.CMB.1.raw
  modified_base (486)..(486): a, c, t, g, unknown or other
  misc_feature (486)..(486): n is a, c, g, or t
tcagcagtagacgtcacgaccggtgctcgatttagtgtgagtagtttgggtttgggggagctacaacaggcaggcaggggcagccaagatggtgttgcagacccaggtcttcatttctctgttgctctggatctcgtggtgcctacggggacattcggtgatgagtccagtttccagactccctggctgtgtctcgtgggcagagggccacatcaacgtgcaaggtccagccaggattgtttatcggccccaactaataacaactacttagtcttaggtaccagactagaaacggtaggacacgtcctaccgtaaacgtcctagtacttaacggtgggtacctttaccggtaccccgggtctaacgttccccggggggttacccttaaaccggtacttcgtaacgttcggaccgtagggtacccggggttcgtacgggggtaaccttacgttttccaaccgttctaccggacctaacgtcggaacnccgtacggtcctcgacgtaggcctaggtaaacgtaggttacggtggtacttagggttttaacttacgttaggtacaacggtactaaacttacgtttaacgtttaccgtttactttaccgttacgttaccgttttcggggaaccgggttaaccgggtaaaccgtaacggggttggaacgtaggtaaccgtaaacggtacgttacggtcggtactacgtccggtaacctattcggttcctttacgttacgtaccg

SEQ ID NO: 65897 - DNA, 617 bp, Homo sapiens
  misc_feature: GYAE6OF02II2ZW.31.78.H01.1.454.CMB.1.raw
  modified_base (603)..(603): a, c, t, g, unknown or other
  misc_feature (603)..(603): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagtagtgttttattggccccacaatacaactacttagcttggtaccagcagaaagtaggacagcctacctaaactcctagtactttacgtgggtccttccgtacccgggcacgttcccggggttacctaaaccggatttcgaagtttcggacctaggtcggggtctacggggtacccgtatttcctacttctacacctactccacgcacgcctgcaggctagaagagtggtggacttagtttacttactcgtacacgactaaactatttactacctttctttcgtacttacgtttcgggacggtaacggaccgaagggtaggagacgtaaccgaaacggtaacgtggtcggtctacggaccctacgtataccgttnttaccttactaccg

SEQ ID NO: 65898 - DNA, 670 bp, Homo sapiens
  misc_feature: GYAE6OF02F9MQK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccacaataacaactactagcttgtaccagcaagaagtaggacacgcctacctaaacctcctagtatttacgtgggtaccttcgtaccccgggctacgttcccggggttacctaaccgtattacgagttcggacgtaggcgggtacgtcggggaaccgtactttccacttccgtcctaacctataccgacgccacgccctagcgaggctagaaagtagtggtcggtacgtaagtttacttagttacgtacgagtacctaaacttagtttaacttaacgttttccgtttaccgttaccgttaccgtttccgggacggtacgggtaaccgtaagggtacggaggtataaccggaaaacggttaccgtacggtacggacgttaccggtaccaaccgttacgttaccttacggtttacctaccgttacccg

SEQ ID NO: 65899 - DNA, 711 bp, Homo sapiens
  misc_feature: GYAE6OF02ICUMF.31.78.H01.1.454.CMB.1.raw
tcagcagtagacgtcacgaccggtgctcgatttagtgtgagtagtttgggtttgggggagctacaacaggcaggcaggggcagcagatggtgttgcagacccaggtcttcatttctctgttgctctggatctctggtgcctacggggacatcgtgatgagccagtttccagacctccctggctgtgtctcgtgggcgaggagggccacatcaactgcaacgtccagccagagttggtttttacttcggcccccaactaataaccaactacttagcttcggtaaccagacagaaagtaggacagctacctaaactcctaggtaattacgtggccttcgtacccgggctaacgtccgggttaccaacgtattccagttcggcagggcggtctacggggaccgttatttaccacgttcctccgacctagtccaagccgtacgcccgtgaccgtaagggtcctaggaacgtagtacgggtgtacctaaggtttttattaccgtcgttacacgtaacctaaccttaaggttttaacttacccttttctttaccccgttcttaaccgggttttccggggaacgggaaccgggttaaccgaaggggttacggaagttaaccgtaaccgtaaaacggttaacttagggtaccgggttacctaaccggtacccttaagtttacccttcggttttacctttaccctacttttaccccccgg

SEQ ID NO: 65900 - DNA, 658 bp, Homo sapiens
  misc_feature: GYAE6OF02JA6OS.31.78.H01.1.454.CMB.1.raw
  modified_base (407)..(407): a, c, t, g, unknown or other
  misc_feature (407)..(407): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgactaacgtccaggccaaggtagttgttttattccggaccccctaacaataaaccaactacttagtccttagtaccaagacgaagaaacgtagacagacctacctaacctcctgtattacgtggcttaccgaccggctacgtcccgggtacctaacgtattcagttgcgagtcggtcgtcgggaccgtntttaccactctccaccatcgacgtcacgtccgtagcgaggtacctaggaacgtgtagggtccgtacttaaggttttactacgttcgtacgtacgttacaaaccgttattacctttacgtttaccgtttccgtaccgttacggttaccgacgggtacggtaacgggaacggttacggtacgtaactaacggtaaacgtaacgttagtccgtactacggtacctactaccgtcttacggttcctagttacccg

SEQ ID NO: 65901 - DNA, 792 bp, Homo sapiens
  misc_feature: GYAE6OF02JGHTC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaacgtccagccagagttgttttacttcggaccccaacaataacaactacttagcgttaggtaccagcaagaaagtacgacagaccctacctaaactcccgtagtactttacgtcggtcttccgtaccgggctacgttcccggggttacctaaccgattccgattcggcgacggtaccgggtcgttacggggaccgtagtttccgaacttcctacaccaacgtccgacgcgaacgcccgtcggaccgtaggccgttagaagtacgttggtacgggtaccttaaggtttttaacttacgttcgtacgtacgtacctaaacgttaactttaactttaccgtttttacccgtttttaccggttacccgtttaaccgggtttttaccggggaaccggggttaaacggggtaaccccggttaagggggttaccgggtaacgttaaaacggtaccccggttaaaaaacccgggttaacctttacgggggttaaccggttacccgttaacggtaaccccgttaaccccggttaacttttccccggtttaaccggtttttacctttaacccccgtttaaccgg

SEQ ID NO: 65902 - DNA, 663 bp, Homo sapiens
  misc_feature: GYAE6OF02GFJBP.31.78.H01.1.454.CMB.1.raw
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctccctggctgtgtctcgtgggcgaggacgggcccaccatccaactgaccaagtccagccagtagttagttttattccggacccctaccaaataaacaactacttagcttacggtaccagactaagaaagtaggacacgtaccctacctaaactcctagtacttacgnggtcttccgacccggntacgtccgggtacctaacgtntctagtcgnaggcggtctagggaccgtacttcacgtctaccacgtanccgaacnctacgcctacgacgacgggtactagaacgtgtggaggttaccgttaaggttttaactacgttcgtaacggaactaacttacgttaagttaaccttacgtttcctttaccgtaccgttacgttccgggtaacggaacggtaaccgagggtacggacgtaacgtaaccgtaaacggacggttcggacggtcgtacgacctacgtaacgttcttacggttccttacctaccg

SEQ ID NO: 65903 - DNA, 592 bp, Homo sapiens
  misc_feature: GYAE6OF02IESME.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggaggccaccatcaactgcaacgtccagccagtagttgttttattcggaccccaccaataaacaactacttagcttggtaccagcagaaagtaggacagcctactaaactcctgtacttacgtggtcttccgtacccgggctaacgtccgggttacctaaccgattcagtcgcaggcggtcgtgggaccgtatttcactctacaccatcagcagcctgcaggtctagaagagtgtggacttagtttactactgtacgagccaaatattacttacttctttaccgtcttaacgtttccgggcgggtacgggaacctaagggtacggacgtaacgtacgaaacggtacttggtacggtactaggcccaactacttcgtacgttaccttacgtaccg

SEQ ID NO: 65904 - DNA, 570 bp, Homo sapiens
  misc_feature: GYAE6OF02F7EQJ.31.78.H01.1.454.CMB.1.raw
  modified_base (315)..(315): a, c, t, g, unknown or other
  misc_feature (315)..(315): n is a, c, g, or t
  modified_base (385)..(385): a, c, t, g, unknown or other
  misc_feature (385)..(385): n is a, c, g, or t
  modified_base (422)..(422): a, c, t, g, unknown or other
  misc_feature (422)..(422): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactacaagtccagccagagtgttttattggccccacaataacaactacttagcttggtaccagcaagaaagtaggacagcctacctaaactcctgactttacgngggtcttcgtacccgggcacgtccggggttcctaaccgtattcaattcggcaggcgggtctcgggacctntttcactctacaccatcagcagcctgcagctgaacgntggtgctagtttattactgtactagcaactattatactttcgtttcgtctacgtttcggacgggtaacggtaccaagggtgaagtactaccgtaaacgtaacgtaggtacggctacgccaactgtaccttgtcttaccgtacttcccg

SEQ ID NO: 65905 - DNA, 799 bp, Homo sapiens
  misc_feature: GYAE6OF02HS54S.31.78.H01.1.454.CMB.1.raw
  modified_base (185)..(185): a, c, t, g, unknown or other
  misc_feature (185)..(185): n is a, c, g, or t
  modified_base (199)..(199): a, c, t, g, unknown or other
  misc_feature (199)..(199): n is a, c, g, or t
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgcctacggggacatcgtgatgagccagtttccagactccctggctgtntctcgtgggcgagnggccaccatcaactgcaagtccagccaggagttgttttattcggcccctaacaataacaactactaagcttgtaccagcaagaaagtaggacacgacctactaaactctacgtactttaacgngggtccttaccggaacccgggctaaccggttcccggggttaccctaaaccgtatttctaactttcggcgacggtcgggttaccgtcggggtaacctacgttttaccgacttaccctacgtaaccaacgttacgaaccggtaccgaacgtccccttaaaggcccgtaagggtacccgttaaagggtaaaagtaacggttcggttacgggaactttaaacggtttttaaacgttaccttacggttaacgtaacgtaaaccgtaaaccttaattttaaacctttaaccgttttaccgttttaccgttaacctttaaccggtttttaccggggaacggggttaaacggtaacccgttaaaggggtaccggtaaagtaccggttaaaccgtaaaacccggtaacgttacgggttaacggtcccgtaacgtacctaaacccgttaacttccggttttaaccgttccgttttaaccgttaaccc

SEQ ID NO: 65906 - DNA, 721 bp, Homo sapiens
  misc_feature: GYAE6OF02GQDYK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatacaactgcaacgtccagccagagttgttttatttcggccccctaacaataaaccaacttacttacgcttcggtaaccagacaagtaaagtaggaaccacgcccttacctaaaacctccttagattttacgtcgggtcctttaccgtacccggggctacggttcccggggtttaccctaaacccggtatttccgagtttcggaccgtacgggtccggggttcgtacggggaacccgttattttccaacgttccctaccacccgttatccgacgccacgtcccgtcgaccgacggtcgaacgaagtacgttggttacgggacttaaggttttattacgttcgtacgaacgtacgttaactatttaacttacttttccgtttacgttaccttacgtttccgggacggtaacgggtaaccgtaacgggtaggacgtactaaccggtaaacggtaacggtcggttacggactcggtacctaccttagttccgtttaggttaccttacgttacccg

SEQ ID NO: 65907 - DNA, 774 bp, Homo sapiens
  misc_feature: GYAE6OF02HY0GC.31.78.H01.1.454.CMB.1.raw
  modified_base (260)..(260): a, c, t, g, unknown or other
  misc_feature (260)..(260): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggcccacatcaactggaccaagtccagccagagttgtttttaagtcggacccccaanaataacctaacttaacttagctttacggtaacctacgcgaagaaaaggtacggaactacgaccctaccctaaaactccgttagacttttaacgtcgggtaccttccggtaacccggggtcctacgggttccccgggggttttaacccctaaaaccggtacttccgttaacgtcgggtacccgtaagggtccccgggggttactaccggggggtaacccttagttttaccccgtacgtccctttaacccggaacctttaacggccgtaacggcctaacggtcccgttacggtaccgtacggtacgttacggaaacgtaagttcgggtacggtacgttaacggtttaacgttacgttacgtacgtaacgtactaacgttattaacgttaactttccgtttacgttaccttacgttttacggacgggtacggtaaaccgtagggtacggtagtacgtaccgaaacgtaaccgtggtacgtctacgtcctacgtacgtaccgttcgttctacttaccg

SEQ ID NO: 65908 - DNA, 694 bp, Homo sapiens
  misc_feature: GYAE6OF02FRNP2.31.78.H01.1.454.CMB.1.raw
  modified_base (302)..(302): a, c, t, g, unknown or other
  misc_feature (302)..(302): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacagtcgtgatgagcctagtttccagcctccctggctgtgtctcgtgggcgagcgggccaccatcaactgacagtccagccagtagttgttttagttcggacccccaactaataaaccaactacttagcgttacgaccagcaagaagtaggacngccctactaactcctagtactttacgcggtcttaccgtaccgtcgggactacgttcccggggttacctaaccgtattaccgtagttcgggacgtagggtccgggtacgttcggggaccttacgtttaccgtacctcctaccacctacgtacgacgtacgacgcctgaccacgggtctaggaagtacggtgtcggacgttagtttactttacgtcgttacacggtactaacttatttaccttaccgttttactttaccggtctttaccgttccgggaccgggttacgggaaccgttagggtacgtacggtacgtaaacccggtaaacgttacggttacggttacggtacgtacggtacccgtaccttaccggtcgtttaccgttacccgttac

SEQ ID NO: 65909 - DNA, 784 bp, Homo sapiens
  misc_feature: GYAE6OF02IIVVX.31.78.H01.1.454.CMB.1.raw
  modified_base (426)..(426): a, c, t, g, unknown or other
  misc_feature (426)..(426): n is a, c, g, or t
  modified_base (544)..(544): a, c, t, g, unknown or other
  misc_feature (544)..(544): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctacgtttccagacctccgtggctgtcgtactcgtgggcgaggacggccaccataccaactgactaacgtccagccgtaagttaggtttcgttttacgttccggaccccctaaactaaactaaacctaaccgttacgttacggttaccgtttacggaacccaggaacctaaaaggaaacggtaacggaccaccggttaccccttaaccttaaacctccgtagtttacgttaccggtcggtacctttcccggaacccgggtntaacccgggttcccgggttaaccctaacgtcttacacggttcggcgtacgggtcgggtacgtccgggtaacttcttacaccttaccgacctaacgtatacgacgctaccggtccgtanccgggtaacggtacgtaataaacggtcgttcggtaggtacgttttaacggtttacctaggtcgtaacgacgtaaaccttaattaacgttttccgtttacgttttcccgtttaacggtccgtttaccggggtaaccggtacggggtaaacggaaccgttaagggggtacgaacgttactaacgggtaaacgtggtcgtacggactccgaacctacgttcctcggttacttcctaccttacg

SEQ ID NO: 65910 - DNA, 646 bp, Homo sapiens
  misc_feature: GYAE6OF02HTV7A.31.78.H01.1.454.CMB.1.raw
  modified_base (325)..(325): a, c, t, g, unknown or other
  misc_feature (325)..(325): n is a, c, g, or t
  modified_base (352)..(352): a, c, t, g, unknown or other
  misc_feature (352)..(352): n is a, c, g, or t
tcagcagtagacgtcacgaccggtgctcgatttagtgtgagtagtttggggtttgggggagctacaacaggcaggcccccccccaggggcagcaagatggtgttgcagacccaggtcttcatttctctgttgctctggatctctggtgccgtacggggacatcgtgatgagcctagtttccagacctccctggctgtgtctcgtgggcgaggacgggcccaccatacaactgacaacgtccagccagtagttgttttagttcggacccccaacaaataaccaaactacttagcgttggtacccagacaaggaaaagtaggacacnccctacctaaactcctagtatttacgnggtccttaccgacccgggctacgttccggggtaccctaaaccggattcaagttggccgaggcgggttctggggaacccttattccactcctaccaccatccagccagcccgtgaccgaggctaggaagtagtggtcggatagtttaacttcgtacgtcgagactaaactatttaacttacctttcttacgtcttaaccgtttccgggacgggtaacggaaccgtaaggacggagtacgtaaccgaaacgtacgtggtagtcgtcgactaccagttccgtacgttcctcgtaccg

SEQ ID NO: 65911 - DNA, 698 bp, Homo sapiens
  misc_feature: GYAE6OF02HT4HM.31.78.H01.1.454.CMB.1.raw
tcagcagtagacgtcacgaccggtgctcgatttagtgtgagtagtttgggtttgggggagctacaacagggcaggcagggggcagcaagatggtgttgcagacccaggtcttcatttctctgttgctctggatctctggtgcctacggggacatcgtgatgagccagtttccagacctccctggctgtgtctcgtgggcgaggacgggcccaccatcaactgacaagtccagcctaagagttgttttacttcggacccccaactaaataacctaaaccttacgttaacgtccgttacggtaacccaggaccaaggtaaaaggtaggaccagccctacctaaacctcctagtactttacgtcgggtcctttaccggtacccgggtccgtacggttccccggggttacctaacccgtattacagttcggcgtacgggccgggtcgtacggggaccctacgtttccacttccacacccatccgagccacgcctggcacggtcgagaagtatcgggtacggtacgtttaaggtttaacttacgtagtaccgaacgtctaaacttattaacttacctttctttaccgtcttaacggttccgggaagggtaacggtaacgtagggtacggtagtaacgtaaccgaaacggtacgttggtacggtccgtagcctaacgtacgttcgtacgttacctacgtaaccg

SEQ ID NO: 65912 - DNA, 653 bp, Homo sapiens
  misc_feature: GYAE6OF02GL2BC.31.78.H01.1.454.CMB.1.raw
  modified_base (359)..(359): a, c, t, g, unknown or other
  misc_feature (359)..(359): n is a, c, g, or t
  modified_base (457)..(457): a, c, t, g, unknown or other
  misc_feature (457)..(457): n is a, c, g, or t
  modified_base (515)..(515): a, c, t, g, unknown or other
  misc_feature (515)..(515): n is a, c, g, or t
  modified_base (543)..(543): a, c, t, g, unknown or other
  misc_feature (543)..(543): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagacctccctggctgtgtctcgtgggcgaggacgggcccaccatacaactgacaacgtcccacgaccaggtagtttagtttttacgttcggacccccaacctaaataaaccaacttacgttagctttagggtacccagaccaagtaaaagtacggacacgaccctacctaaacctcctgtaatttacgngggtccttccgacccgggctacgttcccggggttacctaacgtacttccagttcggactaggcgggtcgtcgggaccctatttccacttcacacctanccagcacgacgtgcgagtcctaggaagtagtcggtggacttaagtttactactacgtnaacgtactaatactttaacttacctttnttttcccgtattaccgtttacggccgggtaacggaacgtagggtgtacgattaacggaaacgtcgtggtcgacgtcgaccgtacctattccgttcgttaccttactaccg

SEQ ID NO: 65913 - DNA, 834 bp, Homo sapiens
  misc_feature: GYAE6OF02IQ4IY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcggtgatgagcctagtttccagactccctggctgtgtctcgtgggcgaggacgggccaccagtcaactgacaagtccagccagtgttgttttatcggccccacaataacaacttacttagcttcggtaccagacaaggtaaagtaggacacggtccctacctaaactccgttgtactttacgcgggtccttaccgtacccgggtactacggttccccggggtttacctaaaccggtattacctagttcggacgtacggtccggggtcgtacggggtaacccgttacttttccgacgtttcctacccgtaacctacgttacgaacgtccgtaaccggtcccgttacgggacccggtaacggggtccttaacgggtaaacggtagtttacggggttacggttacgtttaacgggtttttaaacgttttaccggttccggttaccggtaaacgtacccgtaaaaccgtttacgtttttaaccgtttaaccgttttttccccgttttaccgtttaaccgtttaaccgggttttccgggggtaacccggggtaaaccgggttaaaccggtaaggggttacgggtacgtaaccgttaaccggtaaaaccggtacgttacgggtaccggtaccgtaccgtaccgtacccgttagttacccggtacggttttccctaccgtttaccccgg

SEQ ID NO: 65914 - DNA, 882 bp, Homo sapiens
  misc_feature: GYAE6OF02GUAGE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggcccaccatacctaactggaccaaacgtccaagccaaggtacgttagtttttacgttccggacccccaacctaaactaaacctaaacttaccgttaagtaccgttacggttaaccagacgaaaggtaaagtacggacacgacccttaacctaaacctccgtagttacgtttacgtcgggtaccttaccgtacccgggcgtaccgttcccggggttacccttaaacccggtacttcgtacgttcggacctacgggtccgggtacggtcgggtaaccccgttagtttacccacttcccgtacaaccgtaacttccgaacgtaccgacgtccctacggacgaacgggtacgtaacggtaaacggtaacgttgggtaaccggtaccgtttaagggtttttaaactttaccggttacgtaccgtaaacgttaacctaaaccgtttaacttttaaacctttaccgtttttacccttttaccggtttaacccgtttaaccgggttttacccgggggtaacccggggtaaaccggggttaaacccggttaaacggggtacgggtaacgttaaccgtaaaccgggtaaaacccggttaaccgttacgggggtaacgttacccgttacggtaaccccttaaccggttagtttacccggttccgtttaccgttcccttaaccccgg

SEQ ID NO: 65915 - DNA, 674 bp, Homo sapiens
  misc_feature: GYAE6OF02GT09K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacgggccaccatccaactgacaacgtccagccagtagttgttttattccggaccccaacaaataacaactactagtcgttagtaccagacaagaaagtagacacgtccctacctaaactccgtagtactttacgtcgggtccttaccggtacccgggtccgtacggttccccggggttaccctaaccggtacttctagttcggcgacggtcgggttcgtacgggtaccgtattccacctcctacacccatccacgactacgtccgtcgcgtacggtctaggaagagtggtcggtacttagtttaacttacgtgtacacgtactaaacttactttacttaccttttctttccgttaccgttacgttccgggacgggtaccggtaacgtaacgggtaggacgttaagtaccggtaaacgtagtacggtacgtacgtcgacctacgtacttcgttcgttaccgttactacccg

SEQ ID NO: 65916 - DNA, 588 bp, Homo sapiens
  misc_feature: GYAE6OF02I9NGJ.31.78.H01.1.454.CMB.1.raw
  modified_base (571)..(571): a, c, t, g, unknown or other
  misc_feature (571)..(571): n is a, c, g, or t
  modified_base (583)..(583): a, c, t, g, unknown or other
  misc_feature (583)..(583): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctctggtgcctacggggacatcgtgatgagccagtttccagctccctggctgtgtctcgtgggcgagagggccaccatcaactgacaagtccagccagagttgttttattcggccccacaataacaactacttagcttggtaccagcagaaagtaggacagcctacctaaactcctagtactttacgtgggtcttaccgtacccgggctacgttccggggttacctaaccgtattcagttcggcgaggtcgggtctacgggaccgtatttccactctcaccatcagcacgcctgcacggctagaagatggtggacttagtttacttactgtcaacgtcaactatttacttacctttcctttcgttacctacgtttccgggacgggtacggaaccgagggtagagtactaacgaaacgtacgtggtaggcgtagcacctntcttcgtccttntaccg

SEQ ID NO: 65917 - DNA, 774 bp, Homo sapiens
  misc_feature: GYAE6OF02H9ZZM.31.78.H01.1.454.CMB.1.raw
tcagcagtagacgtcacgaccggtgctcgatttagtgtgagtagtttgggttgggggagctacaacaggcaggcagggcagcaagatggtgttgcagacccaggtcttcatttctctgttgctctggatctctggtgcctacggggacagtcgtgatgagcctagtttccagacctcctggctgtgtctgtgggcgaggaggccacgatcaaactgaccaagtccagccagagttgttttagttcgccccccacgtaaatacaaaccttacttaagcttacggtacagtcaaaggtaaaacgtggaccagtaccctacctaaactcccgtagtaacttacgtcgggtccttaccggtaccccggggctaacgggttacccggggtttaaaccaaccgtattccgtaagttcggacagggtcccgggtacgtacggggtaacccgtattttaccccgcgttaccacctaccgtagtacgtaccgtacaacgtcccgtacgtaccgtacggtctaacggtaacgaaggttaggttacgggtacttaacgtttaacgttaaaccgtttcggtaccgtacgaacctaaaccttaacgtttaaccgtttacctttttacccgtttaccgttaccgttaccggttttaccgggaccgggttaaacggggaaccgtaaaggggtacgggtacgaaccgttaacggaaaccggttaacggttacggtacggtaccgtcggtaccgacccgttaagtccgttacgttccttacccgttacccg

SEQ ID NO: 65918 - DNA, 636 bp, Homo sapiens
  misc_feature: GYAE6OF02F2BDJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccctaacaataacaactacttagcttggtacagcaagaaagtagacagcctacctaaactcctgtatttacgtgggccttcgacccgggcacgttcccggggttacctaaccggattctagttcggcaggccgggtctcggggaccgtactttcaccttctcacctatcagccacgcctcgcgaggtctagaaagtagtggtcggtctaggttttaactacgttgtacagtacaaacgtatttattaccttttcgtttaccgttaccgtacgttttcggacgggtaacgggtaccgtaagggttagacgtaagtaccgtaaacggtaaccgttcgggtacgttaccgtagtaccgtaaccctaagttccgttacggttccttaccttacccg

SEQ ID NO: 65919 - DNA, 601 bp, Homo sapiens
  misc_feature: GYAE6OF02G83D7.31.78.H01.1.454.CMB.1.raw
  modified_base (273)..(273): a, c, t, g, unknown or other
  misc_feature (273)..(273): n is a, c, g, or t
  modified_base (416)..(416): a, c, t, g, unknown or other
  misc_feature (416)..(416): n is a, c, g, or t
  modified_base (438)..(438): a, c, t, g, unknown or other
  misc_feature (438)..(438): n is a, c, g, or t
  modified_base (477)..(477): a, c, t, g, unknown or other
  misc_feature (477)..(477): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtagcctacggggacatcgtgatgagccagtttccagctccctggctgtgtctctgggcgagagggccaccatcaactgcaagtccagccagagtgttttatggccccacaataacactactagctggtaccagcanaagtaggacacgcctctaaactcctagactttactgggccttcgtacccgggcacgttcccggggttcctaaccggtacttcgtattggccaggcgggttcgtggggacccgtatttccactctccacctaatccagccgacnccctgcgacggcttagaaagtntaggtggcctaagttttattactggtctagcctaaactnttacttacgtttactttccgtactaccgttttacgggcggtacggtaccgaagggtacggagtaacgtacgtaaaacggtacttaggtcgcgttacgaccgtacagttctgttacttacgtacc

SEQ ID NO: 65920 - DNA, 598 bp, Homo sapiens
  misc_feature: GYAE6OF02HGB9F.31.78.H01.1.454.CMB.1.raw
  modified_base (235)..(235): a, c, t, g, unknown or other
  misc_feature (235)..(235): n is a, c, g, or t
  modified_base (412)..(412): a, c, t, g, unknown or other
  misc_feature (412)..(412): n is a, c, g, or t
  modified_base (449)..(449): a, c, t, g, unknown or other
  misc_feature (449)..(449): n is a, c, g, or t
  modified_base (573)..(573): a, c, t, g, unknown or other
  misc_feature (573)..(573): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatggagccagtttccagacctccctggctgtgtctcgtgggcgagaggccaccatcaactgcaagtccagccagagttnttttattcggccccaacaataacaactacttagcttggtaccagacagaaagtagacagcctaccaaactcctagtactttactggttccttaccgtacccgggtctacgttcccggggttacctaaacccggtattcctagttcggcgagtcgggtctcgggaaccttttcactcncacccatcagcagcctgcagctagaagtatgtacggntagtttaacttacgtgtacacgtactaactagtttaactctttctttacgtctcgtttccggcggtacggaacctaagggtggagtaataccgaaacgtacgttggtcgtacgttgaccgtacncttcgtacggtttccttactacccg

SEQ ID NO: 65921 - DNA, 788 bp, Homo sapiens
  misc_feature: GYAE6OF02JCY03.31.78.H01.1.454.CMB.1.raw
  modified_base (141)..(141): a, c, t, g, unknown or other
  misc_feature (141)..(141): n is a, c, g, or t
  modified_base (174)..(174): a, c, t, g, unknown or other
  misc_feature (174)..(174): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (339)..(339): a, c, t, g, unknown or other
  misc_feature (339)..(339): n is a, c, g, or t
tcagcagtagacgtcacgaccggtgctcgatttagtgtgagtagtttgggtttgggggagctacaacaggcaggcaggggcagcaagatggtgttcgcagacccaggtcttcatttctctgttgcttctggatctgtggtnacctacgggcattcgtgatgagcctagtttccngactccctggctgtgtctcgtcgggacagcggcctacagtcaactgctaagtccancaagtnttgttttaatcgacccctaataataacaacttacgtagtcttggtaaccaagcaaggaaagtaggacagtccctaacgttaaaccgtcgttagaacttttacncggggtacttttacccggaacccgggctaacgggttaccccggggtttacctaaacccggtagttttcccgagtttaccggccgaaacggggtttccggtaccggttaccgggggaacccttacggttttccctaaacgttcccgtaaccaacccgtttaggacccttacgccgtacgtacccgtagaccgtaacggtcgtaacggtaaagtacgttaacggtcggttaccgttaaaggttttcgttaaccggttgtaaccgtacgtaaccgtaaatacgtttaagtaacccgtttttcgttaaccttcggaacgttttaccgggacggttaacgggtactaacgggtagtacggtaagtaacccggtaaataaccgggttggttaaccggtcgttaaccgacgttacccggtaaccgttcgttccggtttaccgtaaccttccccggg

SEQ ID NO: 65922 - DNA, 542 bp, Homo sapiens
  misc_feature: GYAE6OF02F5PRZ.31.78.H01.1.454.CMB.1.raw
  modified_base (315)..(315): a, c, t, g, unknown or other
  misc_feature (315)..(315): n is a, c, g, or t
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcaagaaagtaggacagccctactaaactcctgactttacgngggtcttccgtacccgggctacgttcccggggttcctaaccgtattcagttggcaggtcggtctgggacctatttcactctacacctatcagcagcctgcaggctgagagtgngactagttatctgcagtcaatattatacttcttcgtctacgtttcgcggacggacgtaggtagagactaacgaaacgtacgtggtacgctagactactatcgtgtcttctaccg

SEQ ID NO: 65923 - DNA, 655 bp, Homo sapiens
  misc_feature: GYAE6OF02HKTVF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagacggccaccatcaactgacaacgtccagccagagttgttttattcggccccaacaataacaactatagcttaggtaccagcaaggaaagtggacagcctacctaaacctcctagtactttacgtgggtacctttccgacccgggtctacggttcccggggttacctaaccggtattcagttcggcacggcgggtcgtaggggacccgtatttccacctctccacctatcgacgctacgcctagaccgtaggtcaggaacgtagtggtcggtacgttaagttttacttacgttacggtcaagtacctaaacttatttaacttacctttacgtttccgtcgttaacggtttccggggaccggtaagggtaaccgtaagggtggtaagtaacgttaaccgaaaaggtacctgggtacgtcgtacgaccgacctagtcttacggttccttacgtacccg

SEQ ID NO: 65924 - DNA, 631 bp, Homo sapiens
  misc_feature: GYAE6OF02FIASY.31.78.H01.1.454.CMB.1.raw
  modified_base (334)..(334): a, c, t, g, unknown or other
  misc_feature (334)..(334): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcactgcaagtccagccagagttgttttattcggccccacaataacaactacttagcttggaccagcagaaagtggacagcctacctaaactcctgactttactgggcctttcctacccggggntacgttcccggggttacctaaaccggatttcgaatttcggctaggcgggttctcggggacctatttcactcctacaccatcagcacgtcctgacgacgcgtagaaagtagtggtacggcttaagtttacttacgtgtacacgtctaaacttatttactacttttccgttttacgttaccttacgttttccgggaccggtaacgggtaccgtaagggtggtaacgactaacggtaaaacgtacggttacggtcggtacgtagacccgactaccgttcgtacggttccttacgtacccg

SEQ ID NO: 65925 - DNA, 744 bp, Homo sapiens
  misc_feature: GYAE6OF02IMKKN.31.78.H01.1.454.CMB.1.raw
  modified_base (380)..(380): a, c, t, g, unknown or other
  misc_feature (380)..(380): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagagggccaccatcaactgcaagtccagccagtagttgttttagttcggacccccaacaaataactaactacttggaccttacggtaccagacaaggaaacgtagacacgcctacctaaactccgtagtatttacgtggtaccttccgtacccgggctacgtcccgggttacctaaccgtnttactagttcggactacggtcgggttccgtaggggtaccctattttacccgacttcctacctacctacgtcaacgctacgcccgttacgaccgtaggtactaggaaacgtgttacgggtacggtaccgtttaaggtttaaccttacgtcggttaccagtaaccaaatttaacgtttactttaaccgtttttccgtttacgtaaccgtttacgttaccggggacggggtaaaccgggtaaacgtaacgggttacggggaagtaaaccgttaaccggaaaaccggttaacggttgggtaaccggtacgttacccggaaccgtaacccttacggttccgttacccggtttcttacccgttaaccccg

SEQ ID NO: 65926 - DNA, 788 bp, Homo sapiens
  misc_feature: GYAE6OF02IBLWA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgcaagtccagccagagttgttttattcggccccacaataacaactacttagcttggtaccagcagaaagtgacagctcctaaactcctagactttacgtgggtccttcgtacccgggctacgttcccggggtttacctaaaccggtatttccgtaagtttcggaccagggtccgggttccgtaggggtaacccgtattttccaacctttccgtacctaaccctataccgtagtccgtaacgtcccgttcggaccgtacggaacttagggaaagttacgtacgggtcggtaacgttaacggttttttaaacgtttaccttcgggttacaacgtaaccgtaaaacgttaacttttaaacgtttaaccgtttttcccttttaccggtttaccggtttaacccggttttttaccgggggaaacccggggtaaccgggggtaaacccttaaagggggttaccgggtaacgtaacggttaaaccggtaaaaacccgggttacgttacgggttacccggggttaccttaccgggtccctaaacccgtcggtttaccctttggtacccttttacgtaccccg

SEQ ID NO: 65927 - DNA, 729 bp, Homo sapiens
  misc_feature: GYAE6OF02G8EO3.31.78.H01.1.454.CMB.1.raw
  modified_base (163)..(163): a, c, t, g, unknown or other
  misc_feature (163)..(163): n is a, c, g, or t
  modified_base (473)..(473): a, c, t, g, unknown or other
  misc_feature (473)..(473): n is a, c, g, or t
  modified_base (495)..(495): a, c, t, g, unknown or other
  misc_feature (495)..(495): n is a, c, g, or t
  modified_base (701)..(701): a, c, t, g, unknown or other
  misc_feature (701)..(701): n is a, c, g, or t
  modified_base (718)..(718): a, c, t, g, unknown or other
  misc_feature (718)..(718): n is a, c, g, or t
tcagcagtagacgtcacgaccggtgctcgatttagtgtgagtagtttgggtttgggggtaggcgtacgaacaggcaggcgaggggcgagcaagagtggtgttgcagacccaggtcttcatttctctgttgctctggatctctggtgccgtacggggacatcgngatgacgccagtttccagacctccctggctgtgtctcgtgggcgaggagggccaccgatcaaacgtgccaaggtccacgaccgtaggagttcgtttttaagttcggaccccctaaccaaataaacctaaaccttacttaacggcttacgggtaaccaggacaagtaaaacggtaaggacctaggtccctacctaaaacttcctagtaatttaacgtgggacctttccgaccccggggtcaaggttcccggggtttacctaaacccgagtttcacggttcggtcacgggcgggttcttcggggaacccgtntttccgaactcctcaacgtacncgtaagccgaacgtccgtacgacgacgcgttacgaaggtaactcggttaggcgttaacggtttacgttaacgtcgtacgaacgtacaaaacctagtttaacttaaccgtttcttttccgtaccgttaccgttttaccgggcgggtaaaggtcccgtaaaggggtcgtaaggacgttaaccgaaacgtaacggttcgtacggtacgngtaccgactcgtacgtnttccgtctacg

SEQ ID NO: 65928 - DNA, 698 bp, Homo sapiens
  misc_feature: GYAE6OF02GHB1D.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagtgttttattcggcccacaataacaactacttagcttaggtaaccagcaagaaagtaggacacgcctactaaactctagtacttacgtggtccttcgtacccgggctacgttacccggggttacctaaccgtagttaccagtttcggacgtcggacggggttaccgtcgggtaacccgtagttttaccgacgttccgtacctaacccgtataccgaacggacctaacggtcccgttagaccgaaggtaccctagggtaaagtacgttggtacgggtaccttaaggttttaacgttacgttcgtaccgacgtactaaaccttagtttactttacctttcgtttaccgtacgttacgtttaccgggacgggtacgggtaccgtaagggtcgtaacgtacgtacgtaaaacggtacttaggtcggtacgttaggaccgtaaccttagttccgttacgttcgttactaccg

SEQ ID NO: 65929 - DNA, 822 bp, Homo sapiens
  misc_feature: GYAE6OF02FILSZ.31.78.H01.1.454.CMB.1.raw
  modified_base (769)..(769): a, c, t, g, unknown or other
  misc_feature (769)..(769): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatccctgtgcctacggacgatgtgatgagcctacgttactacgactccctcgcgtcgtgtctcgtcggcggagagggaccgacccaacgtacaactacgtcgaacgtaccgtaccgaccgacgtaggttacgtttttacgtttttacggtaccccccgaaccctaaaactaaaactaaaccttaacctttagtacgtttccggtttaaccggaacacgtaacggaaaaagggttaacggaacgtaacgacccttaccccgttaaaaccttacccgttgaagtttttaaccgtttcgggaccgtttacctttaacccccgggccgtaacgtttcccgggggtttacccccggttaaaccctaaacgttttcgtaccgtttaggggtccgaacggtaccgggggttccttacggggtaaccccggaatttttccggaacctcctttacccgaaccaacgttacaccggacgtacgtcccgttcgaccgtacggtacgttacgaaacggtaaagtttcgtcgggtaacgttaatttttaaccggtttaactcgggttaccacggtacgtaaaccttagtttaactttacgtttacctttccgttacttacgtttacgggtcgggaacgtacgtaggagcgtanacgtaaccgtaagtcgtcggctcgacgtcacgttctcgttctcgtacttcccg

SEQ ID NO: 65930 - DNA, 821 bp, Homo sapiens
  misc_feature: GYAE6OF02J2LLK.31.78.H01.1.454.CMB.1.raw
tcagcagtagacgtcacgaccggtgctcgatttagtgtgagtagtttgggtttgggggagctacacaggcaggcagggcagcaagatggtgttgcggacccaggtcttcatttctctgttgctctggatctctggtgccgtacggggacatcgtgagtgagccagtttccagacctcccgtggctgtcgtctcgtgggacgaggacgggccacctaagtacgaactgacaacgtcacgccagtagttgttttacgttcggaccccctaactaaataacaaccttacgttagcgtttaggtaccagctaagaaacgtacggacacgtccctactaaacctcttagtaactttcgacggtccttcgtaccccggctacgttccggggttaccctaaccggtatttcaacgttcggcgtacgggtccggtacggtacgggtacccgtttatttccgtaaccgtcctaccgtaaccctacgttaccgacggtacccgtacgtacccgttacggacccggtacggttaaccgttaggtaaccggttaacggttacggttacgggttaaccgttaaaggtttttaaccgttaccgttacggttaccgtaacgtacccttaaacgttacgttttaacttaaccgttttccgtttacgttaccgttaacccggtttacggggaaccggtaccgggttaaacccggtagggtaaggtaccgttaggtaacccgtaaacggtaaccgtttggtaccggtacccgttaccgtacccgtaacccgttacggttacccgttagtttccccgtttaccgtaaccttttcccccgg

SEQ ID NO: 65931 - DNA, 883 bp, Homo sapiens
  misc_feature: GYAE6OF02F0K2Q.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatggacgcctagtttccagacctcccgtggctgtcgtctcgtgggacgaggacggccaccataccaacgtgacaacgtccacgccagtacgtttagtttttacgttccggacccccaactaaactaaacctaaccttaccgtttacgtcgtttacggtaaccagaccaaaggtaaacggtacggacacgtcccttaacctaaacctcctagttaactttacggcgggtcctttaccggtacccgggactacgggttccccgggttaccctaaacggttacttacctagttcggacgtacgggtccgggttacgtacggggaacccttagttttaccaccgttcctacctaacctacgttaccgacgtacctacgtcccgtacgaccgacggtaccgtaacggaaaggtacgttacgggtacggtaccggttttaacgtttttaacgttttaccgttacggttaccgtaaacggtaaccctaaacgtttaacgtttttaaacctttaacccgttttttaccgtttttaccccggtttaaccgtttaacccgggtttttaccggggaaccggggttaaccgggtaaaccgggttaacggggttaggggtacgtaaaccgtaaccggtaaaaaccggttaccgtttaacggggttaccggttaacgtaccggtaaccccgtaacgttacccgttacccggtttacgtttacccgtttacgttacccccgg

SEQ ID NO: 65932 - DNA, 781 bp, Homo sapiens
  misc_feature: GYAE6OF02JPVBR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcagttccagactccctggctgtgtctcgtgggacgagagggccaccatcaacgtgcaagtccagccgaagtgttgttttacgttcggaccccctaactaactaaactaaccttacttaacggcttttcgggaaccacgtcaaaggtaaaagttacgggaaaccacggtacccttaacccgtaaaactccgttacggtaacttttaaccggcggggtacctttaccggaaccccgggggtctaacggttccccgggggtttaaccctaaaacggtctttacgtaacgtttcgggactaacgggtccggggttccgtacggggacccgttaacgtttccaaccttcgttaacccaccgtaaacttccgaacgccgtaaccggtcccttacgggcctaacgggtaccgttaacggaacggtaagttccgggttaggacgttaacggttttaactaccgttacggttacaacggtaactaaactaaacggttttcttaaccctttcgtttaccggttaaccttccggttacgggtaccggtaacggtaaccgtagggtacggtacacgtaacgtaacgtacgtgtaacggtctacggactactaatcgtagttactacgtaccg

SEQ ID NO: 65933 - DNA, 607 bp, Homo sapiens
  misc_feature: GYAE6OF02G07ED.31.78.H01.1.454.CMB.1.raw
  modified_base (238)..(238): a, c, t, g, unknown or other
  misc_feature (238)..(238): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
  modified_base (404)..(404): a, c, t, g, unknown or other
  misc_feature (404)..(404): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (480)..(480): a, c, t, g, unknown or other
  misc_feature (480)..(480): n is a, c, g, or t
  modified_base (512)..(512): a, c, t, g, unknown or other
  misc_feature (512)..(512): n is a, c, g, or t
  modified_base (577)..(577): a, c, t, g, unknown or other
  misc_feature (577)..(577): n is a, c, g, or t
tcagcagtagacgtcacgaccggtgctcgatttagtgtgagtagtttgggtttgggggtaggcgtacaacaggcaggcaggggcagcaagatggtgttgcagacccaggtcttcatttctctgttgctctggatctctggtgcctacggggacatcgtgatgagccagtttccagactccctggctgtgtctcgtgggacgagagggccaccatcaactgcaagtcccagcccaaggngttgttttattcggccccctaacaaagtaaactactaacttagcttaggaccagacagaaaagtacggacagcccttaccaaactccagtatttacngggtctaccgtacccgggntaacgtccggggtttccctaaccggtattccagttggaccagccgggttntcgggaaccctattttccacgtctccaaccgtagtcacgctacgcctagcagcgtnaacgtancgngactagtttnactgctagacactattacactttcgttcgttnaccgtttcggcgtaacggtacaaggttcgatacgaacctaaacggaaccttagcggtacgttacnccgttaaccattcccgtattcgtacctacg

SEQ ID NO: 65934 - DNA, 800 bp, Homo sapiens
  misc_feature: GYAE6OF02FLVBA.31.78.H01.1.454.CMB.1.raw
  modified_base (320)..(320): a, c, t, g, unknown or other
  misc_feature (320)..(320): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggcccaccatcaactgacaacgtccagccagtagttgttttagttcggacccccaactaataacactacttagcttgaccagcagaagtagacagccctactaaactccagtatttacgnggtccttacgtacccgggactacggttcccggggttacctaaccgtnttactacgttcggacgtacggtcggggtacgtcggggtacccttatttccgacttcctacctacccgtagtccaaggtcccaacgtcccgtacgtaccgtacggtaccgtaagaagtacggttcggtacggtacgtttaacgttttaacgtttaccgttacggtaaccgtaggtaaaccctaaagttaacgtttttaaccttacccttttttacccggtttttacgttacccggtttaacccgggttttaccgggggaacccggggttaaacgggttaaacccgggttaacgggggttacgggtaaccgttaaccggtaaacccggtaaaaacgggttacccggttaaggggttacccgggtaccgttaccggaaccttaaccccggttcggtttaccgtttaccggtttacccgtttccgtttaacccccgg

SEQ ID NO: 65935 - DNA, 668 bp, Homo sapiens
  misc_feature: GYAE6OF02HP2S0.31.78.H01.1.454.CMB.1.raw
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgaccgtacgggggacatcggtagatgagcctagtttccagacctcccgtggctgtgtctcgtgggcgagacggccaaccatcaactgacaacgtccagccagtagttnttttagtcgaccccaacaataacaacttatagcttaggtaccagacaaggtaagtaggacacgtaccctacctaaacnctagtactttcgcggtcttaccgaccggctacggttacccgggttacctaaccgtattcgattcggcgacgtcgggtcgtacggactnttcgaccttctaccactactnacgacacgtccgtacgcgtacgcgtagaagtagtggtacggtacttaagtttactttacgagtaccagtactaactacgtttaacttacctttcgttccgtaacttacggtttaccgggaacggtacggtaaccggtaagtacggtacgtaacgtaaccgtaaacggtaacgtacggtacggtaccgtaccgtacgtaacctagttacccgttacgttaccttaccggttaccc

SEQ ID NO: 65936 - DNA, 916 bp, Homo sapiens
  misc_feature: GYAE6OF02HQDTU.31.78.H01.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactcccgtggctgtcgtctcgtgggcgagnggccaccatcaactncaagtccagccagtagttgttttattcggacccccaacaataaccaacttacttacgtcttcggtaaccaggtacaagaagtacgacacgacctcctaaaccgtcctagtaatttccgcgggtccttaccgtacccgggctacggttcccgggttacctaaccggtattccgaagtttcggctaaggtccgggttcgtacggggacccgttatttcccaacgttccctaccacccgtactacgaacggtccaaccggtcccttaggaccggtacggtacgttaacgggtaaacgtaaggttcggggttacgggaaccgttttaaaggtttttaaccgttaaccggtttaccggttaaaccgtaaacgggtaaccctttaaaacggttacctttttttaaaaccggtttaccccgtttttttacgttttttaccccgggttttaacccgtttaacccgggggttttttaaccccgggggaaacccggggggttaaacgggttaaaacccccggggtttaagggggttaccgggtaaaacggggtttaacccgttaaaaaaccccgggttaaaacccgggttaaaccggttttccgggggtaacccgggtttacgttccggtaaacccccggtttaaaacccttccggtttttaacccggttttaacccgggttttaccctttaccccctttaaacccgg

SEQ ID NO: 65937 - DNA, 742 bp, Homo sapiens
  misc_feature: GYAE6OF02FN2V2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccaccatcaactgcaagtccagccagagttgttttattcggccccacaataacaactacttagcttggtaccagcagaaagtaggacagcctacctaaactcctgtatttacgtcgggtctttccgtacccgggctacgttcccggggttacctaaccgtacttcgtagtttcggactacggtccgggttcgtacggggacccgtagttttccaaccgtttcctaccaacccgtacttaccgaacgtccgacggtcccttaggaccgtaacgggtccgttaaggaaacggtacgttagggtacgggtaccgttaaggtttttaacgttaccgtttacgtaccgtaacgtacctaaacctaagttttaacgttaaccgtttttaccgtttttacgttacccttaacggttttccgggacgggtaaacgggttaaccgtaaaggggttcggtaacgtacgtaaccggtaaaaccggtaacgttacggtacggtacgttacggactacccgtacgttaccgttacgtttaccgttacttaaccg

SEQ ID NO: 65938 - DNA, 692 bp, Homo sapiens
  misc_feature: GYAE6OF02G5B06.31.78.H01.1.454.CMB.1.raw
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
  modified_base (188)..(188): a, c, t, g, unknown or other
  misc_feature (188)..(188): n is a, c, g, or t
  modified_base (194)..(194): a, c, t, g, unknown or other
  misc_feature (194)..(194): n is a, c, g, or t
  modified_base (338)..(338): a, c, t, g, unknown or other
  misc_feature (338)..(338): n is a, c, g, or t
  modified_base (443)..(443): a, c, t, g, unknown or other
  misc_feature (443)..(443): n is a, c, g, or t
  modified_base (472)..(472): a, c, t, g, unknown or other
  misc_feature (472)..(472): n is a, c, g, or t
  modified_base (502)..(502): a, c, t, g, unknown or other
  misc_feature (502)..(502): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctcgtggatctntggtnccgtacgggacatgtgatgagcctagtttccagaccgtccctggctgtntctcgngggacgaggcgggacccacctatcaactggccaagtcccaagccaggtagtttgtttacttacgccccgaccaaataacaacctaatacgtacgtacgtacgacgtacaagaacgtaacgacgtacgacctacctaacgtaccncgtactttacgcggtccgttacgacccggtactaccggtccgggttaacccgtaccgtaattcgtactacggtcgacggtcggttaccgtggtaacggttacctntaaccgtaccgtctaacccgaatccgganacgtaccgactcgcgtagccgtagtaacgngtaaccggtgtacgtagtttacgtactttacgactacggactaacgtaattaacgtacctttcgttacttccgttagtacccgggttacgggaccgtaacggaacgggtgtaagaccggttaacaaacgggtaccgtagtccggtagccgtacgacccgttaatccggtttacgtacgtttacctaccgg

SEQ ID NO: 65939 - DNA, 805 bp, Homo sapiens
  misc_feature: GYAE6OF02I3K73.31.78.H01.1.454.CMB.1.raw
  modified_base (376)..(376): a, c, t, g, unknown or other
  misc_feature (376)..(376): n is a, c, g, or t
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
  modified_base (512)..(512): a, c, t, g, unknown or other
  misc_feature (512)..(512): n is a, c, g, or t
  modified_base (760)..(760): a, c, t, g, unknown or other
  misc_feature (760)..(760): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgaccgtacggggacatcgtagatgacgcctagtttccagacctcccgtggctgtgtctcgtgggcgagacgggcccaccatacaactcgacaacgtccagaccagtagttgttttacttccggaccccctaacaataaacctaaccttacttacgacgttcggtaacccaggaacctaaaggtaaaaggtacggaacgaccgtacccttaacctaaacctcctagtaactttaccggngggtacctttaccggtaccccgggntaccggttccccgggttacctaaccgtnttaccgtagttcgacgtggtccggggttctacggggaccttacttctaccgttcctacctaacccgtagtccgaacggtaccnccggtaccgttcggaacccgtacggggtactaaggtaaacggtagttcgggtacgggaccttttaaggttttaactttaccggtacgttacgaaccttaacgtaaactttattttaaccgtttaacccgttttccgtttacttaccggttaaccggtttccggggtaacggggtaaaccggtaaaccgtaggggtacggtaagaacccgttaaaccgtaaaccgggttagttaccgggtggtaacccncgtcccttaaacgtccggtttacctgtttcccgttacgtacccgg

SEQ ID NO: 65940 - DNA, 647 bp, Homo sapiens
  misc_feature: GYAE6OF02JBHAU.31.78.H01.1.454.CMB.1.raw
  modified_base (230)..(230): a, c, t, g, unknown or other
  misc_feature (230)..(230): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagngttgttttattcggccccacaataacaactactagctcggtaccagcagaaagtaggacacgaccctacctaaacttctagtactttacgtacggtcttaccggtacccggacacgttcccgggttacctaaccgtnttactagttcgacgacggtcggtcgtcggtaaccgtattcctactctacacctatacacgactacgtccgtagacgacggtcaggtacgtagtcggtacgacttaggtttactacggtctacgtcaacgtaacttattacttacctttcgtttaccgtaccgtttaccggttacggggaccggtaacggtaagtacgggtacgtacgtaacgtaacgtaaaccgtagttcggtacgacgttacgaccgtactaccgttgtacctttacgtaccttacccg

SEQ ID NO: 65941 - DNA, 582 bp, Homo sapiens
  misc_feature: GYAE6OF02G1N5I.31.78.H01.1.454.CMB.1.raw
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (553)..(553): a, c, t, g, unknown or other
  misc_feature (553)..(553): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccgatcaactgaccaagtccagccagtagttgttttattcggaccccaacaataacaactacttagcttggtaaccagcaaggaaagtaggacacgaccctacctaaactcctagtatttacgnggtccttccgtacccggntacgttcccggggttacctaaccgtnttcgattcggacaggtccgggttcgtggggacctatttccacttcctccaccatccagcacgccgtgacgngctaggantgtagnttagtttatcgtgacagacaatattactacttcgttacgtcttacgttcgggacggtagacgtaggtacagtactaacgaactatggcgtacngaccctacgtattccgtcttcctataccg

SEQ ID NO: 65942 - DNA, 581 bp, Homo sapiens
  misc_feature: GYAE6OF02G7N8V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccaccatcaactgcaagtccagccagagttgttttattcggccccacaataacaactactagcttggtaccagcagaaagtaggacagcctacctaaactcctagactttacgtgggtcctttccgtaacccgggctacgttcccggggttacctaaaccggtattacgagttggactaaggcgggttactcgggtaccctatttccgactctcaccatcacgcagcctagcgaggctagaagagtgtaggtactagtttactacgtcgtacacgtacaactattactactttcttcgtctacgtttcggcgtacggaacctagggtagagataccgaaacgtactacggtagctagccacgtatacgtctactactacg

SEQ ID NO: 65943 - DNA, 788 bp, Homo sapiens
  misc_feature: GYAE6OF02GQA0M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcctggatctctggtgcctacggggacatcgtgatgagccagtttccagactccctggctgtgtctcgtggcgaggcgggccaccatcaactgcaacgtccagccgagtagttgttttacttcgacccctacaataaccaactacttagcttggtaccagacaagaagtagacacgcctacctaactccgtagtacgttacgtcgggtaccttccggtacccgggctacggttcccggggttaccctaaccgttacttacgtacgttcggaccgtacgggtacgggttccgtacggggtaacccgttaacgtttccgtaaccgttccctaccgaaccttacgtacccgaacggccgtaccggtacccgtcggacccgtaaacgggtccggtaaaggttaaccggaaggtttccgggtcggtaaacccgttttaaggttttaaaccgtttacggtacggttaacccgaacggttaacctaaacgtttaacttttaaccgtttaacccttttccttttacccggttaacttacccggggtttaccggggacgggtaaaccggtaaccggttaacggggagtaacggtacgtaaaccggaaacgttacggttagggtccgtaccttacggacctaccgtaccttcggtacgttaccttaccgtaacc

SEQ ID NO: 65944 - DNA, 829 bp, Homo sapiens
  misc_feature: GYAE6OF02F54Z8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgaccgtacgggactagtcgtgtatgacgctacgtttccacgtacctccgtcgtcttgtcgttctcggtgggcgaggacggaccacatacaacgtcgactaacgtccacgaccgtaagttagttttacgtttttacgttccccggacccccaaaccttaaaactaaacctaaaccttaaccgttacgtccggtttacggtaacccaggaaccgtaaaaggtaaacggtacggaaccgacgtacccttaacccttaaaccttcccgtagttacgtttaccggtcgggtaccttttaccggacccgggtacttaccgggttccccggggtttaaccctaaaccgttcgttaacgtcggttacggaccgacggttccgggttcggtacgggtaccctttacgtttaccacctttacctacccgaacctaacgtcgacgaccgtaccggtccgtacgaccgacggtacgtaacggtaagtacgtcgggtacgttacgttaagtttacttacgttcgtactacgtactaacttacgttaacttaccgtttactttacgttaccgtttacggttaccggtacggtaacggtaaccggttaaggtacggtacgtaacgtaaaccgtaacgttaacgttacgggtaccgtacgtaccgaccgtaccgtacgttccgttcgttacttaccgttacccg

SEQ ID NO: 65945 - DNA, 597 bp, Homo sapiens
  misc_feature: GYAE6OF02I9B56.31.78.H01.1.454.CMB.1.raw
  modified_base (339)..(339): a, c, t, g, unknown or other
  misc_feature (339)..(339): n is a, c, g, or t
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccaggagttgttttacttcggaccccacaataacaactacttagcttggtaccagcagaaacgtaggacagcctacctaaactcctgtatttacgtgggcttccgacccgggtnaacgttcccggggttcctaaccggtattctagtcggcgacggtcgggtcgtcggggtacctatttcactctcaccatcacgcacncctgcaggctagagatggtgactgtttaattctgtacacgtcaactatttactaccttttcctttcgtaccgtttacgtttccggggacggaacggtaacctaagggttcggagtataaccgtaacgtaaccgttggacgtcgtagaccgtacacttcgtacttcttctaccg

SEQ ID NO: 65946 - DNA, 754 bp, Homo sapiens
  misc_feature: GYAE6OF02F4KXS.31.78.H01.1.454.CMB.1.raw
  modified_base (593)..(593): a, c, t, g, unknown or other
  misc_feature (593)..(593): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgccgtacggggactatcggtgatggagcctagtttcccagacctccctggctgtgtctcgtgggcgaggacgggccaccatacaactgaccaagtccagccaggtagttacgttttattccggaccccaccaataaccaacttacttagtcgttacggtaaccagacgaaggtaaaggtacggacaacgtaccctaaccctaaactccgtagtaactttacggtcggggtcctttacccggacccggggtactaccgggttacccggggtttaccctaacgtacttcgtagttcgggaccaacggggtcgggtccggtacggggtacccgtaatttccgacttccctaccaacctataccgacggtccaacgtccctggacggacgtcgtaaggaagtacgtggtacggtactttaaggtttacctagttcgtacgaaactaccgtaaagtttnttaacttaccttttcgttaccgttaccgttacgggtttaccgggacggtacgggtaacctagggggttacgaacggtactaaaccggaaacggtaaccgttgggtaaccgtacgtaccggtacgtacctacgtttccgtacccggtttactacctacccgg

SEQ ID NO: 65947 - DNA, 819 bp, Homo sapiens
  misc_feature: GYAE6OF02IH6H9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccacatcaactgacaagtccagccagtagttgttttattcggcccccaacaataacaactacttagcttggtaccagacaagaagtagacacgccctacctaaactcctagtattacgtggtaccttccgtacccgggctacgttcccggggttacctaaccggtattcagttcggaccaggtccggggtcgtcggggaaccgttacgttttccgaccttaccgtacccaaccctacgttaccgaacggtccgtaaccgtcccgttacgggaccgtaacgggtaccttaagggaaaacggtagtttacgggttacgggtaccttttaaagggtttttaaacgtttaaccgttcggtttaaacctacgttaaacccgtaaaacgttaaacttttaaaccgtttaccgtttttacccgttttaccggttacccgtttaacccgggtttttccggggtaaccgggggtaaaccgggtaaacccggttaaagggggttaacggtaacgggttaactaacccggtaaaaacggttaaccggttacgggttaccggtaccgttacggaacctaacccgttaaccgttacccggtttacggtttccctttaccgttaacccg

SEQ ID NO: 65948 - DNA, 821 bp, Homo sapiens
  misc_feature: GYAE6OF02GQ21X.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggccaccgatccaacgtgacaacgtccacgccaggagttgttttacgttccggaccccctaacaaactaaacctaaccgttacttagtcgttacggtaccagcaaagaaaggtacggacacgaccctacctaaactcctagtactttacgtgggtccttacgtacccgggctacgttcccggggttaccctaaccggtacttcgaacgttcggacgtacgggtccgggttacgtacggggtaacccgttagtttcctacctctacccaaccgtacttaccgacgtcccgaaccgtcccgtacggaccggtacggtacgtaacgggaaacgttaacggttcggggttaccggtacgtttaacggttttaaactttaacccggttacgttaacgtaaccggtacctaaaaccgtttaacgtttaaaccttttaaccgtttttacccggttttacccgtttaaccgtttacccgggtttaaccggggtacccgggtaaacgggtaaacccggtaaggggttaacggtacgtaacgtaaccgtaaaccggtaacgtttcgggtaacggtcctaccggaccgtaccgtaacgttcggttacgttcccttaccgttaccccg

SEQ ID NO: 65949 - DNA, 756 bp, Homo sapiens
  misc_feature: GYAE6OF02IC915.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggcccaccatccaactcgacaacgtccagccagtagttgttttattcggccccaacaactaacaacttacttagcttaggtaccagacaagaaagtagacacgcctaccctaaactcctagtactttacgtcggtccttccgtacccgggtctacggttcccgggttacctaaccgtattccgtagttcggcgtagggtccgggtcgtacgggtaccttatttaccaccgttccacctaccatccgaaacgtccgtacgtcccgtcgacgacgggtccgttaaggtaaacgtgttacggtcggttacgtttaacggttttaacgtttacgtacgttacgaacgttacctaaacgttactttaactttaccgttttacgtttaccgttccgttaccggttttccggggaacgggttaacggggtaaccggttaacggggtacggtaacgtaacgttaacccggtaaaacggttaacggttacgggtcggtacccgtacgtaacccgttaaccgtaccgtttacccgttacggtttacccgttcttaacccccgg

SEQ ID NO: 65950 - DNA, 748 bp, Homo sapiens
  misc_feature: GYAE6OF02FLFHF.31.78.H01.1.454.CMB.1.raw
  modified_base (385)..(385): a, c, t, g, unknown or other
  misc_feature (385)..(385): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacggccacatcaactgacaacgtccagccagagttgttttattcggcccccaacaataaccaactacttagcttaggaccagacaaggtaaagtacggacacgccttacctaactcctagtactttacgtcgggtcttaccggtacccgggtactacggttcccggggtttaccctaaccggtntttacgagttcggaccgtagggtccggggttaccgtacggggtaacccgttagttttccgaccttccgttacctaacccgattaccgaacgccgaaccgtcccgtacggaccgacggtaccgtaaggaacggtacgttaggtacggtacgtttaacggttttattaccggttgtacgtacgaactaaccttatttaactttacgttttctttaccgttaccgttaccgtttaccggggacgggttaacggtaaccgtaagggtaccggtacgtaacgtaccggtaaacgtaaccggtcgggttaacggtaccgttacggtccctaacggttaccttcggtttacgttacttaccgttaacccg

SEQ ID NO: 65951 - DNA, 723 bp, Homo sapiens
  misc_feature: GYAE6OF02I2GXQ.31.78.H01.1.454.CMB.1.raw
  modified_base (351)..(351): a, c, t, g, unknown or other
  misc_feature (351)..(351): n is a, c, g, or t
  modified_base (455)..(455): a, c, t, g, unknown or other
  misc_feature (455)..(455): n is a, c, g, or t
  modified_base (483)..(483): a, c, t, g, unknown or other
  misc_feature (483)..(483): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtggcgagaggccacatacaactgcagtcgtcagaccagtagtttgtttttaacgttccggaccccctaacaaacgtaaacctaaaccttaactagtcgttacggtacgacgacgaaagaaagtacggacaacgcctaacctaaactcctagtacttacgnggtacctcgtacccgggctacggttcccggttaacctaacgtatcgtagttcggactacggaccggtcgtacgggactacgtttacaccgttctaccaccgtanacgacgtcaacgtccttagacgacggtntaacgagagttgtcggtacgttaattaccttagtcgtactaagaccttaaacttaagtttacttaccgtttaaccgtttcgtaacccgttaaggtttcccgggtacgggtaacccgggaaacgttaacggtaggggtaaccttaaacgtaaccggtaaaaccgttaaggttaccggtacgggttaaccgtaccgtaaccgttaacccgtagggttaccctttacggttactttaacccgg

SEQ ID NO: 65952 - DNA, 752 bp, Homo sapiens
  misc_feature: GYAE6OF02F1S2Q.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctggcgagagggcccaccatcaactgcaagtccagccagagttgttttattcggccccaccaataacaactacttagcttggtaccagcagaaagtaggacagcctacctaaactccgtagtactttaacgtcggggtcctttaccgtacccccggggactacgttacccccgggggtttaccctaaacccggtatttaccgtagtttcgggacgtacgggtccgggggttctacgggggtacccgtacttttcccgaaccttccgtaccctaacccgacgttacccgaacgtaccaacggtccccgtacggccgaacgggtcgtaaggtaaacggtaagttcgggtacggtacgttaaggttttaacttacgtcgttacacgacctaacttaatttacgtaccttttaccttttaccgtaccttaccgttttaccgggaccgggtaacggggtacccgtaaggggttaggacgtaacgtaacccgtaaaaacggtaacgttagggtcgggtactacggtacccgtacctaagttccgttacgttaccgttaccttaacccg

SEQ ID NO: 65953 - DNA, 877 bp, Homo sapiens
  misc_feature: GYAE6OF02JQJVA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggaccatcggtgatggacgccagtttccagactcccgtggctgtgtctcgtgggcgagcgggcccaccagtcaacgtgcaacgttcccaagtaccgaggtacgtttggtttttaactttccgggacccccctaaccaaattaaaccgaaaactttaccgttacggtaccgtttacggttaaccccaggtacctaaaacgggtaaaacggttaacggggtaacctaacggtacccctttaaccccgttaaaaaacccgttccccgttaaggttaaaccgttttaacccgtttcggggggttaccccctttaaccggttaacccccggggggtaactaaccggggtttcccccgggggggttttaacccttaaaaccccggttagttacccgttaaacggtttcggaccgggtaacgggtaccggggttaccttacggggaacccgttacttttctaaccgttcttacccgaccttaacgtccagggtaccacgtcctccggagacggtacgtagacgtagttacggtagtccttaggtttaactttactccggttacaagtcctaaacgttaacgtttattaaccctttcgttaccgttacgttcggtttacccggtacggggtaaccggtaaccgtaaggggtacgtacgtaaccgtaaccgaaaggttaaccggtagtacgggtaccgagtaccaccggttacttaccgttgtttccgtacgttaacccg

SEQ ID NO: 65954 - DNA, 582 bp, Homo sapiens
  misc_feature: GYAE6OF02HCN1O.31.78.H01.1.454.CMB.1.raw
  modified_base (139)..(139): a, c, t, g, unknown or other
  misc_feature (139)..(139): n is a, c, g, or t
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
  modified_base (324)..(324): a, c, t, g, unknown or other
  misc_feature (324)..(324): n is a, c, g, or t
  modified_base (422)..(422): a, c, t, g, unknown or other
  misc_feature (422)..(422): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtnccctacggggacatcgtgatgagccagtttccagacctccctggctgtcgtctcgtggcgaggacggccacatcaactgacaacgtccagccagngttgttttattcggccccaacaataactaactacttagcttaggaaccagcaagaagtagacngacctactaactcctagtactttacgnggtcttccgacccggatacgttccgggttacctaacgatactagttcggcgtaggcgggtctacgggactattcgactctaccacactcacgcagccngacagctagaagctggtagtcgtaagtttactacgtntnacgtacactattaacttacctttcgttacgtacttacgttcgggacggacggtacaggtgagtacgtacgaaacggtatggtacgcgtacgacaccgttatacgtcgttacttacgtaccg

SEQ ID NO: 65955 - DNA, 813 bp, Homo sapiens
  misc_feature: GYAE6OF02HI5XD.31.78.H01.1.454.CMB.1.raw
  modified_base (410)..(410): a, c, t, g, unknown or other
  misc_feature (410)..(410): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagcctagtttccagactcctggctgtgtctcgtggcgagaggccacatcactgacaagtccagccagtagttcgttttagttccgcccctaactaaactaaccaacttacttacgtcttacggtaaccagacaaggtaaaggtacggactacgacccttaacccgtaaaccttcctaggtacttttaccggtacgggtcctttaccgtacccggggactacggttccccggggttaacctaaaccgttnttacgtacgtttcggactacgggtcggggttaccgtacggggaacccgttacgtttccgaaccttcgtaccctaacccgtacgtaccgacgtccgtacgtaccccgtttgaaccggtacggtcgttaaacggtaaacgtggttacggttcgggtactttaacggttttaacgttcgtacgttaccgaacgtacctaaaccgtttagtttaaccttacgtttttacccgtttcgggttaacccgtttaacggtttcccgggggaaacgggtaaacccgggttaaaccgggtaaggggtaccgaacgttaccggttaaacgtaaaaccgggtccggttacggtcgggttaaccctaggtaccctaaaccggtccgttcggtttaccgttacttccgttaccccgg

SEQ ID NO: 65956 - DNA, 779 bp, Homo sapiens
  misc_feature: GYAE6OF02JC6KN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccacatcaactgaccaacgtccacgaccagtagttcgtttttagttccggacccccaacctaaagtaaacctaaaccttaacgttagtaccgtttacggtaaccccagaccaaaggtaaaacggtagggaaccacggtacccttaacccgttaaaacctccgttaggtaacttttacggtcgggtacctttccgtacccgggcgtaacggttcccggggttacctaaccgtattacacggtttcggacgtacggtccgggttccgacggggtaccgtatttacaacgtcctaccacctatcgactcgtacgccgtcgacgtacggtcgtaagtaacgtagtacgggtcgtactttaacggtttattaccgttacgtaccaacggtacccaaacgttaattttaaccgttacctttttaccgttttacccgttaccgttaaccgggttttaccgggggaacggttaccgggtaaaccgtaagggttacggaacgtacgttaacggaaacggtaaccgttagggtaccgacgttacgaccgttaactacgttacgttacgttacctttacgtaacccg

SEQ ID NO: 65957 - DNA, 834 bp, Homo sapiens
  misc_feature: GYAE6OF02I8HTA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagacgttgttttattcggaccccaacaataacaactactagcttaggtaccagacgaagaaacgtaggaccagtccctacctaaactccgtagtaactttacgtcggtactttaccgtacccgggctaacgtttcccggggttaccctaaaccggtactttaccgtaagttacgggtaccgtaacgggtccggggttaccgtacgggggtaacccgttacgtttttaccggaaaccttcccgtacctaacccgtacttacccgtaacgtaccgtaaccggtcccgttacggaccggtaacgggtacgtaacgggtaaacggtacgttacgggttacggtacgtttaaacggtttttaactttaaccggtttcggttaaccgtacggtaaccgtaaactttaacgtttaacgtttacccgttttaccgttttaccgttaaccgtttaccggttttaccgggaaccgggttaaccgggtaaccgttaacggggttacggtaaccgttaacgtacccggtaaaaacgttaacggttacgggttaccggtaacgttaccgtaaccgtaccgtaaccgtttccggtttacgtttacccgttaccgtttaacccg

SEQ ID NO: 65958 - DNA, 657 bp, Homo sapiens
  misc_feature: GYAE6OF02GT52U.31.78.H01.1.454.CMB.1.raw
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
tcagcagtagacgtcacgaccggtgctcgatttagtgtgagtagtttgggtttgggggagctacaacaggcaggcaggggcagcaagatggtgttgcagacccaggttcttcatttctctgttgctctggatctctggtgccgtacggggaccatcgtgatgagccagtttccagacctccctggctgtgtctctgggcagcggccaccatcaactgcaagtccagccaagagttgttttattcggccccaacaataacaactacttagcttggaaccagctaagaaagtaggacacgtcctaccgtaaacctcctagtactttacgtgggtccttcgtacccgggntacggtcccgggttacctaacgtnttcgtagttcggcgtacggtcgggtctcggggtaccgtacttttccgaccttccgtaccaaccctatccgaacgccgacgtcccgtgcctacggtaccgtaggaaagtcgtcggtgtacgttagttttaacttacgtcgtacctacgacgtaactatttacttacctttcgtttcgttactacggtttcgacggtacggtaaccgtaagggtcggagtacgtacgaaaacggtacttcggtacgtaccgtgtaccctacgtagttccgtacgttacctacgtaccg

SEQ ID NO: 65959 - DNA, 774 bp, Homo sapiens
  misc_feature: GYAE6OF02G81F5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaacgtccagccagagttgttttattcggccccacaactaacaactacttagcttaggtaccagtacaagaaacggtagacacgtaccctacctaaactccgtagtaactttacgtcgggtcctttcccgtacccggggtctacggtttccccgggggtttaccctaaaccggtactttccgaacgtttcgggaccgtaaggggtccggggttaccgtacgggggaaccccgttaattttcccggaacctttccgtaccaacccgtaagtccgacgaccgtacgcccgttaggaccgtacgggtactaaggaaacgtagttcgggtacggactttaacggtttacttaacgttcgtacgaacgtacctaaacttaactttaccgtttaaccttttccggtttaccgttaaccgttaccggttttccggggaaccgggtaacgggtaaccgtaacggggttaggaaccggttactaaccggtaaaaaccggtacgtttgggtaaccggttaccgtacgacctaaccgtagtttccgttaccgttaccttacgttacccg

SEQ ID NO: 65960 - DNA, 951 bp, Homo sapiens
  misc_feature: GYAE6OF02GP01Y.31.78.H01.1.454.CMB.1.raw
tcagcagtagacgtcacgaccggtgctcgatttagtgtgagtagtttgggtttggggagctacaacaggcaggacaggggcagcaagatggtgttgcagacccaggtcttcatttctctgttgctctggatctctggtgcctacggggacagtccgtgatgagccagtttccagacctccctggcctgtgtctcgtgggcgaggacgggccaccatccaacgtgacaagtccaagcccaagtacgttgtttttacttcggacccccaactaataaccaacttaccgttagcgttcggtaaccagtacaagtaaaggtaggactacgcctacctaaacgtcctagtactttacgtcgggtcctttaccgacccgggactacggttacccggggtttaccctaaccggtatttccgaagtttcggaccgtaacgggtccggggttacgttacggggtaaccccgttacgtttttacccgaaccgtttccttaccgaacccgtacgttacccgtacggaccgtaaccggtcccctacggtaccgaacggggttacccgttaacgggtaaacgttacggtttaccgggttacgggtaccgttttaaacggttttttaaccgttttaacccgttacgggttacccgtaaacggtaacccgttaaaacgtttaacgtttttaaccgttttaaccccgtttttttaaccgtttttcccggtttaaccgttttacccgggttttttaccggggtaaaccgggggttaaacccggggttaaaaccccggggttaaagggggttttaccgggaaaccgggtttaaacgttaaaaccccgggtaaaacccggttaaaccggttttccggggtaccggtttaacccggttaaccggttacccgtaacccgttaccggttttaaccgtttaacccggtttaccgtttaaccccgtttaaccccg

SEQ ID NO: 65961 - DNA, 675 bp, Homo sapiens
  misc_feature: GYAE6OF02JQK1X.31.78.H01.1.454.CMB.1.raw
  modified_base (663)..(663): a, c, t, g, unknown or other
  misc_feature (663)..(663): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggacgggccaccatcaactgacaagtccagcccagtagttgtttttacttcggcccctaaccaaataacctaacttacttacgacctttggtaccacggtacaagtaaaaggtacggacaacggtacccttacctaaaaccgttaccgttacgtaacttttaccgtaggggtcctttaccgtaaccccgggtcgtaacgttcccgggggtttacccctaaccgtacttacgtagttcggtacgacggtcgggtcgtacgggtaccgtacgttcgtactccgtacacctatcgaacgcgacgcctacgcgtagctaggagacgttcgtagggtcttagtttacttaacgttcgtactcgtacctaagtaacttacgttaacctttccgtttacttcgttacgttcgggtacggaaggaccgtaaggtacgagtactacgaactacgtgtagcctgacgctacgtntcgttctatccg

SEQ ID NO: 65962 - DNA, 553 bp, Homo sapiens
  misc_feature: GYAE6OF02GPMF0.31.78.H01.1.454.CMB.1.raw
  modified_base (136)..(136): a, c, t, g, unknown or other
  misc_feature (136)..(136): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
  modified_base (445)..(445): a, c, t, g, unknown or other
  misc_feature (445)..(445): n is a, c, g, or t
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
  modified_base (548)..(548): a, c, t, g, unknown or other
  misc_feature (548)..(548): n is a, c, g, or t
tcagcagtagacgtcacgaccggtgctcgatttagtgtgagtagtttgggtttgggggtaggcgtacaacaggcaggcagggcagcaagatggtgttgcagacccaggtcttcatttctctgttgctctggatctntggtgccgtacgggacatcgtgatgacgcctgtttccagcctccgtggtctgtgtctcgtgggcaaaggcgggccctacgctacgaactgacaacgtccagccaggttgttagttttgttccggacccactaataaccagtactagtcgtaggaccagctagaagtgacngcctactaacggctnattcgngctccgtacggncgtcggtcctaanttgctgcgngccggtaancggtactctcnctctacnccggtagtccagcncgctcgcgtaacgcgtagtatcgtgtacgtacgtattctcgtntaacgtcactactactattacggtcttcgttacgtcgtacgtacgaggtacctggtacgctagaacgtggactntcggaactnacgtcgtatcgtgtaacctntccgg

SEQ ID NO: 65963 - DNA, 917 bp, Homo sapiens
  misc_feature: GYAE6OF02HXQ9R.31.78.H01.1.454.CMB.1.raw
  modified_base (441)..(441): a, c, t, g, unknown or other
  misc_feature (441)..(441): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcctggctgtcgtctcgtgggcgagacgggccaaccataccgtaactggaccaaacgttccgagccgtaaggtacgtttagtttttacgttcggacccccctaacgtaaactaaacctaaccttaactttaacgtccgtttacggtaaccgaacgtaccgaaaggaaaacggttaacgggacctaaccggtcccttaacccgttaaaacccttccgttaaggttacttttaaccggtcgggtacctttacccggtaaccccgggnttacgttaccgggttaccggggttaccctaaccggttactttccgtaaggttcggaccgtaacgggtccggggttaccgtacggggtaaacccgttacgttttacccgaacctttcccgtaacccgtaacccgttacgttaccgacgaccgtaccgtcccgtagggtacccgtacgggtacgtaacggtaaacggtcggttacggtacggttaacgtttaacggtttttaacgttacccgtttacggtaccgtaaccgtaccttaaactttaaccgtttaacttttaacccgtttacccgtttttaaccgttacggtttacccggttttcccggggaaacgggtaacccgggtaaccggtaacggggttacggtaaccgtaaccggtaaccggtaaaacccggtaccggttcgggttaccgtacccgttcggtacccgttaaccgttaacgtttccgtttaagttacccttaccgg

SEQ ID NO: 65964 - DNA, 671 bp, Homo sapiens
  misc_feature: GYAE6OF02GETUT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgacaagtccagccagtagttgttttatcggaccccaacaataacaacttactagtcttacggtaccagacaaggaaagtaggacacgacctacctaaactcctagtactttacgtcgggtacctttaccgacccgggctaccggttcccggggttacctaaaccggtattccgagttcggacgacgggtccggttcgtacgggtaccgtactttaccgactccgtactaccatcgacgcgtaacgccgtgacgacgtacgtaggaaacgtgtcggtacgtacgttacgtttagtacttacgtaccgtacgtactaacgttatttaacttacctttccgtttacgtaccgttacgtttccgggacggtacggtaacgtagggtagtacgtacgtaacgtaacgtacgtacggtcgtagtcggacctacgtacgtacgttacgtcttaccgtccg

SEQ ID NO: 65965 - DNA, 794 bp, Homo sapiens
  misc_feature: GYAE6OF02GVTW6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggacgggccaccatcaactgcaagtccagccagagttgttttacttcggaccccaacaaataacaactacttagcttaggtaccagcaaggaaagtaggacagccctacctaaactcctagtaactttacgtgggtccttaccgacccgggctacgttcccggggttacctaacgtacttacagttcggcgtacggtcgggttcgtacggggaccgtatttccgaccttccgtaccaccctacgtaccgtacggaccgacgtcccgtggaccgtacgggtaccgtaaggtaaacggtacggttaggtcgggtaccgtttaaggtttttaacgtttaacgtttcggttaccgtaaacggtaacctaaacgtttaacttttaaacgtttaacccgttttttccgttttaccgttaacccgtttacccgggttttaccgggggtacccggggtaaaccggggtaacccgtaaaggggttacgggtaacggtaacgttaaacccgtaaaaccgggtaaccgtttagggtaacgggtacccgttaccggaacccgtacccgttaacgttcccgtttaccgggtttacctttaccgtaccccg

SEQ ID NO: 65966 - DNA, 709 bp, Homo sapiens
  misc_feature: GYAE6OF02HPGZG.31.78.H01.1.454.CMB.1.raw
tcagcagtagacgtcacgaccggtgctcgatttagtgtgagtagtttgggtttgggggagcctacaacaggcaggcaggggcagcaagatggtgttgcagacccaggtcttcatttctctgttgctctggatctctggtgcctacggggacatcgtgatgagcctagttccagactcctggctgtgtctcgtgggcgagacggccaccatcaactgacaagtccagccagtagttgttttattcggcccccaactaataaacaacttacttagcttacggtaccaggacaaggaaagtacggacacgtccctaacctaaactcctagtactttacgcggtccttaccgaccggtcgtaccgttcccgggttacctaccgtattcagttcggcgtacggtccggggtcctacggggtacccttacttccaccttccgtaccaacctactcgaacgtccgacgtcccgtgacccgagacgtagaacgtgtcgtagggacttagttacttacgtacgttacagtaccgtaacttacgtttaacttaccgtttaccttttacggtaccctttaccggtttaccggggaccggtaaacgggttaacccgtaaggggtccggtaacggtaaccgtaaaccgggtaaacgtaccgttaggtacgtaccgacggtacctaaccgtctttaccggtcccgtttactaccgttaccccg

SEQ ID NO: 65967 - DNA, 619 bp, Homo sapiens
  misc_feature: GYAE6OF02F0F0U.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtaggacagcctacctaactcctgtactttactgggtcttccgtacccgggtcacgttcccggggttacctaaccgtacttcgtacttggcaggcgggtcgtcgggtaccgtatttcactctacaccatcacgcacgtcctcgcacggctagaagattggtgtcgttaagtttattacgtacgtcagactaatacttacttactttcctttcgtccttacgtttccgggacggacgggtaccgtaagggtggtacgtacgtaaccgaaaccggtacgttacgggtacggtacgtcggaccttaacgtaccttaccggtcgttacccttactacccg

SEQ ID NO: 65968 - DNA, 658 bp, Homo sapiens
  misc_feature: GYAE6OF02G9DP2.31.78.H01.1.454.CMB.1.raw
  modified_base (279)..(279): a, c, t, g, unknown or other
  misc_feature (279)..(279): n is a, c, g, or t
  modified_base (394)..(394): a, c, t, g, unknown or other
  misc_feature (394)..(394): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagactccctggctgtcgtctcgtggtgagagggccacatcaactgacaagtccagccaagagttgttttattcggccccacaataacaacttactagacttggtaaccngtacaagaaagtagacagcctactaaacgtcctagtacttacgtcggtcttccgtacccgggtcacgttcccgggttacctaaccgtagttcaagttcgacgaggtcgggtaccnggggtacctagttttacgacttccgtacaacctatccaacgcgtacgtcctgaccgagtacgtagaaacgtcgtcgggttaggtaccttaaagggtttaccttacgtacgtaccgtaagtaccaaacttgtttaaccttaacgtttcgttttaccgtcttaccgtttcggaccgggtaacggacgttaacgggaggtacgtaacaccggtaaacggtacgtggtacgtacgtcgaccgactacgttcgtacgttctacttaccg

SEQ ID NO: 65969 - DNA, 830 bp, Homo sapiens
  misc_feature: GYAE6OF02IKF0A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggctgtgtctcgtgggcgaggagggccaccatcaactgacaagtccagccagtagttgttttacttcggcccccaacaaataacaactacttagcttggaccagacaagaaagtgacagtacctacctaaactcctagtaactttacgtgggtccttaccgtacccgggtctaacggttcccggggttaccctaaaccgtatttccaagttcggaccgtagggtccgggttacgtacggggtacccgttaattttcccgaaccgtttcctacctaaaccctagttaccgacggtaccgtaacgtaccccgttacggaccggaaacggtaccgttaacggaaaaggtaacggttacgggttacgggtaaccttaaagggtttttaaccttttaaaccgtcggtttaaccaaacgggttaaccaaaacctttaacgttttaaaccgtttaaccgtttttaccccgttttaaccggttaccgttaacccgggtttttacccggggaccggggtaaacgggtaaaccccggtaaagggggtttagggaccggtaaacgttaacccggtaaaaacggtaccgttagggtaaccggtacgtaccggtacctaaccccggtatttacccggtaccggtttaccttaccgttaccg

SEQ ID NO: 65970 - DNA, 832 bp, Homo sapiens
  misc_feature: GYAE6OF02G3Q7P.31.78.H01.1.454.CMB.1.raw
  modified_base (398)..(398): a, c, t, g, unknown or other
  misc_feature (398)..(398): n is a, c, g, or t
  modified_base (430)..(430): a, c, t, g, unknown or other
  misc_feature (430)..(430): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagttccagacctccgtggctgtgtctcgtggcgagacggccaccgatcaactgacgaacgtccacgacagtagtttgttttacgttccggaccccctaaacgaaattaaaccgtaacttacttacggtaccgttacggtaacccagaccgtaaaggtaaaaggtacggaaccacgtccctaaccttaaaccttccgtagtaactttacgcgggtcctttaccgaccccgggnttaccggttacccgggtttacccctaaacgtnttaccgtagttacggctaacgggtccgggttctacggggaaccgttactttccgaccgttccctacccgtaaccgtagttaccgaanccgtaccgtaccgtcgacggaacggtcgtaaggtaaggtaacggtttccggtaacgtttagttttaacgtttaccgtacggttaccgaacgtaactaaacgttaagtttaacgtttcccgtttaaccgttttacccggtacccgttaaccgggtttacccgggtaacgggtaaccgggtaaccggttaaacgggtacgggtaaaccgtacgttaaccggtaaaaccgtccggttacggttaccgggtccttaaccggaccctaaccgttacgttaccgtttacgtttacccgtttacctaccgttttaccccccg

SEQ ID NO: 65971 - DNA, 764 bp, Homo sapiens
  misc_feature: GYAE6OF02JRBDC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccaagagttgttttattcggcccctacaataacaactacttagcttggtaccagcagaaagtaggacagcctacctaaaccgtcctaggtatttaccgtgggtacctttccgtaaccccgggtctaacgtttccccgggggttacccttaaacccggtactttcgtaacgtttcggaccgtagggtccgggtcgtacggggtaccgtacttttacaccgttctccgaacctagttcaacgtcgacggtccctggccgtaacgggtccgtaggtaaacgtacgttcgggttacccggtagtttaacgttttacgttaccgttagtaccgtaacgttaaccaaccgtttaatttaacctttaccgtttttccgtttaccttaccggtttaaccggtttaccggggtacgggttaaaccgggaaaccgttaggggtaccggttagtaacgtaaacccggtaaaaccggttaccgttagggtacggtaccgttacgtaccctaacgttccgttaacggttccgtttaacctaccggttaaccc

SEQ ID NO: 65972 - DNA, 546 bp, Homo sapiens
  misc_feature: GYAE6OF02HRLEP.31.78.H01.1.454.CMB.1.raw
  modified_base (366)..(366): a, c, t, g, unknown or other
  misc_feature (366)..(366): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagcctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttaactgggtcttctacccgggcatccggggttcctaaccgattcattgcagcgggtcngggaccatttcactctcaccatcagcagcctgcaggctagaagatgnggctagtttattacngttcagcaaacattataactttctttacgtctacttttcgggaccggtagggaacccaagggtgaggtatacgaaaacgtaactggtcggactgacaccgattccgtgttcctatacg

SEQ ID NO: 65973 - DNA, 792 bp, Homo sapiens
  misc_feature: GYAE6OF02ICDXX.31.78.H01.1.454.CMB.1.raw
  modified_base (189)..(189): a, c, t, g, unknown or other
  misc_feature (189)..(189): n is a, c, g, or t
  modified_base (746)..(746): a, c, t, g, unknown or other
  misc_feature (746)..(746): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgccgtacggggacatcgtgatgagcctagtttccagtcctcctggctgtntctcgtgggcgaggacggcccacataccaactgacaacgtccacgccagtagttgttttacgtcggaccccaactaaactaactaacttacttagtcttacggtaaccagtacaagtaaaggtacggaactacgacctacccttaaacgtccttagtactttacggtcgggtccttaccggtaccccgggtactacggttaccccgggttacctaaccgtattactacgttcggaccgtagggtccgggtcgtcggggaaccttacgtttaccgcttacccgtactaacccgtaagtaccaacggtacctaacgtcccgtacgaaccggagggtactaaggtaaacggtagttacgggtacgggtactttaaacggttttaactttacgtacgttaccgaacgtaaacctaaacttaactttttaaccgttaacctttttcccgtttacgttacccgtttaaccgggtttaccggggaccgggttaaacgggaacccgttaaggggtacggtacgtaaacttaaccggtaaaccggttacggttaggccggttaacncggtaaccctaacggtcttaccggttctttaccgtaccttaacccg

SEQ ID NO: 65974 - DNA, 648 bp, Homo sapiens
  misc_feature: GYAE6OF02JEEW6.31.78.H01.1.454.CMB.1.raw
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (429)..(429): a, c, t, g, unknown or other
  misc_feature (429)..(429): n is a, c, g, or t
  modified_base (454)..(454): a, c, t, g, unknown or other
  misc_feature (454)..(454): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagtccagtagttgttttattcggccccaacaactaacactactagcttacggtaccagtcagtaaagtacggacagcctaccgtaaactcctagatttacgtcgggtcttccgtacccggnacgttccgggttacctaaccgtnttcgagttcggcaggtcggtctcgggactnttcgactctcacctatcacgcacgtctcgnacggtctaggaagtagtggtacggntttaagtttacttacgtacgtcgtagtacctaacgtatttacgttaacctttccgtttcgtaactttaccggttaccggggtacgggaaccggtaaccgtagggttacggacgttaacgtacgtaaaccggtattacgggtcggtactcggtaacctccgttaacgttccgttacggttaccttacgttacccg

SEQ ID NO: 65975 - DNA, 807 bp, Homo sapiens
  misc_feature: GYAE6OF02GTCI4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacattcgtgatgagcctaggtttccagacctccctggctgtgtctcgtgggcgaggcggccaccatacaacgtcgacaacgtccagaccagtagttgttttattcgcccccaacaaactaacctaactacgttacgtcttacggtaaccagacgaagtaaacggtagaacagtccctacctaaacctcctagtactttacgtgggtaccttccgtacccgggctaccggttcccgggtttaccctaaaccggtcttacgtagttcggacgtacgggtcggggtaccgttcggggtaacccgttacttttaccgtaccttcccgtaacccgaacctacgttaccacgtcctacggtaccgtgaccggacggtacgtaacggaaagtcggttacggtcggtactttaaggttttactttacgtacgttaccaacgtacctaaaacgtttatttaacctttaccgttttcccgtttaccgtttaccggtttaccgttttaccgggggaaccgggtaacccgggtaaaccggggtaacggtttaggaaccgggttactaaacccggggttaaaaccgtaacgggtttcggtaaccgggtacttacggaaccccttaccgttacgttcccggttttacggtttaccgttacccttaaccccgg

SEQ ID NO: 65976 - DNA, 779 bp, Homo sapiens
  misc_feature: GYAE6OF02I4OEL.31.78.H01.1.454.CMB.1.raw
  modified_base (179)..(179): a, c, t, g, unknown or other
  misc_feature (179)..(179): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagtttcagactccgnggctgtgtctcgtggcgagaggccacatcaactgcaagtccagccagtagttgttttacttcggaccccaactaaactaaacaacttacttagcttggtaccagcaagaaagtagacatcctacctaacgtcctgtactttacgtggtccttccgtacccggacgtacgttaccggggttacctaaccgtacgttacacgtttcggcgtaacggtcgggtaccgtaccgggggtaacccttacgtttccgaaaccctttctaccctaaaccgttactaccgaacgtaccgaccgtacccgtagacgtacgggtacgtaaggaaacgtagttacgggttcgaccgttaaggttttaagtttaccgtacggttacaacgtacctaaacgtaacttttaacttacctttttaccgtttttacgtacccgtttaggttttacccgggggtagggggtaaacccgggttaaacggtaagggggtaaccgttaagggttaacgtaaacggtaaaacccggttaaccggttaggggttaccggtaccgttacgaaccgtaacccgtttagtacccgtttaccggttaccgtttacccttaaccccgg

SEQ ID NO: 65977 - DNA, 666 bp, Homo sapiens
  misc_feature: GYAE6OF02ICTS3.31.78.H01.1.454.CMB.1.raw
  modified_base (499)..(499): a, c, t, g, unknown or other
  misc_feature (499)..(499): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgcctacggggacagtcgtgatgagccagtttccagacctccctggctgtgtctgtggcgagaggcccacatcaatgacaagtccagccagtagttgttttacgttccggaccccaactaactaaaaaaaaactccttaacgttacgtcgttacggtaccagacaaggaaacgtgacacgactaccttaaactctagactttacgtcggtccttcgtacccgggatacggttcccgggttaacctacgtacttcacgttcggactacggtacgggtcgtacgggtaacccgttagtttacctacgttactaccaccgtacgtcaacggtcacggtcctacggaccgaggtacgtagtaacggngtacggtcgtacgttaagtttacgtcgtataccgagtacaattacgttactttacttcgtttacgtaccgttacgttccgggtacggacgggtaacgtacgggtagactcgtaacgaacgtacgtcgtacgtaccgactacgtacgtactcgttcgttcacgttacc

SEQ ID NO: 65978 - DNA, 913 bp, Homo sapiens
  misc_feature: GYAE6OF02FLNV5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacggccaccatcaactgcacgtccagccagagttgttttattcggccccacaataaccaactactagcttggtaccagcaaggaaacgtacggacacgcccttacctaaactcctagtaatttacgtgggtcctttaccgtaccccgggtctacggtttccccgggggtttacccctaaaccggtactttaccgacgttcgggtacctaacggggtcccggggttaccgtacgggggtaaccccgttaacgtttttccccgaaccgtttcccgtacccaaaccccgtaacgtttacccgacggtacccgtaaccggtacccctacgggtacccggtaaccgggtaccggttaaccggtaaacggtaacggttacgggttaccgggttaaccggttaacggtttttaaaccttttaacccgtttaccggttaccgtaaacggttaacccgtaaacccgtttaaacgttttaaaccgtttaacccgttttttaacccgttttacccggtttaacccgttaaaccggttttttacccgggggaaccgggttaaaccggggttaaacccggttaacggggttacgggttaaccggtaacgttaacccggtaaaaaccgggttaacccggttaacgggttaccggggtaccgttaccgggtacccgtaacccgttaaccgttaccggtttaccggttaccctttaccgttaaccccg

SEQ ID NO: 65979 - DNA, 653 bp, Homo sapiens
  misc_feature: GYAE6OF02HDDLS.31.78.H01.1.454.CMB.1.raw
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (342)..(342): a, c, t, g, unknown or other
  misc_feature (342)..(342): n is a, c, g, or t
  modified_base (449)..(449): a, c, t, g, unknown or other
  misc_feature (449)..(449): n is a, c, g, or t
  modified_base (504)..(504): a, c, t, g, unknown or other
  misc_feature (504)..(504): n is a, c, g, or t
  modified_base (540)..(540): a, c, t, g, unknown or other
  misc_feature (540)..(540): n is a, c, g, or t
  modified_base (596)..(596): a, c, t, g, unknown or other
  misc_feature (596)..(596): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcaggacgggccaccgatcaactgacaagtccagccagngttnttttattcggcccacaatacactatanttgtaccngcagaaagtggacngacctacctaaacgtcctagattttacgcgggtacctttccgaaccccggggtntaacggttcccggggggtttacccctaaaaccggcttttacgacgtttcggcctaagggcggggtaccgttcgggggaaccctacttttccaacttcctccaacccngttaccgatccgtaccgtcccgttggaccgtagggtcctaggaagtaggttcggnggtaccttaaggttttaactttcgttacgtcacganaaccttatttactacgttttcttcgtacttacgttcggagacggacgagcgggtanacgtacgaacgtacgttggcgtactcgcgtaccctagttcctacggttctatacccg

SEQ ID NO: 65980 - DNA, 656 bp, Homo sapiens
  misc_feature: GYAE6OF02FO5B7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatccaactggcaagtccagccagtgttgtttattcggccccacaataacaactacttagcttggtaccagcaagaaagtaggacagcctactaaactcctagtatttactgggcttccgtacccggcacgttcccgggttcctaaccgattacagttggcaggtcgggtctagggaccgtatttccacgttcctaccaccgtactccaggactacgtccgtcgacgtacggctagaacgtacgttggtacggattagttttaactcgtacggtacaagtacctaaactatttaacttacgtttacgttttaccggttccttaacggtttcgggaaccggggtaacggtaaccgtaaggggtcggtacgactaccggaaaacgtacggtacggtggtacctacggtacctaaccgttacctccgttacggttaccttccgttaacccg

SEQ ID NO: 65981 - DNA, 760 bp, Homo sapiens
  misc_feature: GYAE6OF02GKRUX.31.78.H01.1.454.CMB.1.raw
tcagcagtagacgtcacgaccggtgctcgatttagtgtgagtagtttgggtttgggggagctacaacaggcaggcaggggcagcaagatggtgtttcagacccaggtcttcatttctctgttgctctggatctctggtgccgtacggggacatcgtgatgacgcctagtttccagtactccctggctgtgtctcgtgggcgagacggcccacgataccaactgacaacgtccagccgaagtagttgttttagttcggacccccaaccgtaaataaccaacttacttacgcgttaggtaccagacaagaaaacggtaggaaccacgtacccctacctaaacctccgtgtactttacgtggtccttccgtacccgggctacggttcccggggttacctaacggtattcgtagttcggctacggtccggtcgtacgggaacctctttacaccgttcctacacccatccgacgtcaccgtcctgccgaaggtcgtaaggtaaacggtagtcggtacggtaacgttagttttaacgttacgttacgttaccgtaagtacctaaacgttacgttttaaccttaccgttttacccgttttaccgtccgtttaaccggtttccgggtaccgggtaaccgggtaaacccggtaaaggggttaccggaaggtacgttaaccgaaaaccgggtacgtagggttccgggtaaccttcggttaacccgtaccttacgttcccgttccggtttaaccttcgtacccgtttcccc

SEQ ID NO: 65982 - DNA, 733 bp, Homo sapiens
  misc_feature: GYAE6OF02IBNL2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgacgctagttccagtactccctggctggtgtctcgtgggccgaggacgggcccaacactcaacgtgactaacgtccagccgagtagtttgttttaacgtcggaccccctaactaaataacctaacgttactaacggtctttacggtaacacggctaagtaaacggtaggaacacgtaccctaacctaacttcgtagtactttacgcggttaccttccgtacccgggctaacggttccgggttaacctaacggtattacgtacgttggaacctgggtccgggttacgtacgggtacccgtactttccaccttaccgtaccaactacgtacggaacgtccgacgtccgtacggtaacgtacggcgttacggaagtacgttacggtcggttaaccgtttagtttaacgttaccgtagttaccgacgtaaccaacctttaagttacgtttaccctttcgttccgtaaccgttcggttaccgggacgggtaaaccggtacgtaagggtacacgtaacgtaccgaaaacgttcgtacgtcggtactcgtaccgactccgttcgtcttcgtactacccgg

SEQ ID NO: 65983 - DNA, 825 bp, Homo sapiens
  misc_feature: GYAE6OF02HMGE3.31.78.H01.1.454.CMB.1.raw
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctcgtggtgccgtacggggacagtcgtgatgagcctagttctagacctccctggctgtgtcctgtgggacgaggacgggccaaccatccaactgcaaacggtccagccagtagtttagttttacgttcggacccccaactaaataaccaacgttacttagtacgttacgggtaaccagaccgaaagaaaaggtacgggacaacggtccccttaacctaaaacttcctacggtaatttaccggacgggtcctttacccggaccccgggggtactaacggttccccgggggttttaacctaaacccggtaatttcttaacggtaccggtacacggggtccggggttacgttccgggggaacctttaacgttttccgaacgttacccttccaaaccctgtcctaacggcctaacgccgtacgccgtacggacgtacgtaagtaagccggttaggtaccgttaggtttaaacttacgtcgtacgtaactaactacgtaaactttaccttaccgttttaccgtttccgttaaccttacccgggtttacggggtaacccggggtaaaggaaccccggttaagggtaccgggtagttaaccggtaaacgtaaaccgggtaaccgttagggtaccggtacggttacggacccgttaaaccgtcgttaccggtttacgtttacccgtacgtttaccccg

SEQ ID NO: 65984 - DNA, 736 bp, Homo sapiens
  misc_feature: GYAE6OF02G8C27.31.78.H01.1.454.CMB.1.raw
  modified_base (363)..(363): a, c, t, g, unknown or other
  misc_feature (363)..(363): n is a, c, g, or t
  modified_base (458)..(458): a, c, t, g, unknown or other
  misc_feature (458)..(458): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcagtttccagctcctggctgtgtctgtgggcgaggacggccactagtcaactgacgaacgtccagccgagtagtttgttttacgttcggaccccctaactaaattaaaccgaacttactacgtcctttagggtaaccctaagaccaaaggtaaacggtaaggaccaacgcccttaacctaaacgtcctagtactttaccggnggtccttccggtacccggataccggtaccggggttcctaaacgtcttacgattcgggactacggtcggggtctacgggaccgttattccgacctntaccaaccgtactacgacgccacggtcctggaccgtacggactagaacgtgtacggtacgtacgttaagtttacgttacgttcgtaccgtagaccttaaacgtagttttaaccttacgtttacccgttttaccgtacgtaaccgttttaccggggtcggtaaaccgggttaaccgggtaagggtcgtaacggttaagtaaccggtaaaacggtacgttcgggtacggccgttaaggtaccccgtaagttaccgttactttcggttacccttctacccg

SEQ ID NO: 65985 - DNA, 843 bp, Homo sapiens
  misc_feature: GYAE6OF02GMHXS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaggggacatcgtgatgagccagtttccagactccctggctgtgtctcgtgggcgagaggccacgatcaactgcaagtccagccagagttgttttatcgccccactaataacactactagcttaggtaccagcagaaagtacgacagcctacctaaactcctagtactttaccgtgggtcctttccgtacccggggctaacgttcccgggggttaccctaaaccggtactttaccgagtttcggacaacggtccgggtccgtacggggacccgttaagtttccaacgttcctaccgaacctagtaccgagacaccggtacctggtacccgaagggaccgttaggaaacgtaacggttcggtacggtaccgtttaaaggttttaacgttttaacgtacggttaaccgaacggtaacctaaacgtttaacgttttaaacgtttaaacccgttttttcccgttttttaccggttaacctttaaccccgggtttttttaccggggaacccggggttaaacccgggggtttaaacccggttaaacgggggtaaccgggttaaacggtaaccggttaaacccggtaaaaaaccgggttaaccgtttaccggggtttaaccgggttaaccggttaccggtaacccggttaaacccggttaccgttttacccgttacggggtttttacccctttacccggtttaaccccg

SEQ ID NO: 65986 - DNA, 847 bp, Homo sapiens
  misc_feature: GYAE6OF02FOPPJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagtgttttattcggccccacaataacaactacttagcttggtaccagcaagaaagtaggacagcctacctaaactcctgtactttacgtgggtccttacgtacccgggctacgttcccggggttaccctaaacccggtatttaccgtaagtttcgggacgtaacgggtccgggggttccgttacggggggtaaccccgttaacgttttttacccgaacccgtttacccgtaaccccgtaaacccgttaacgtaccgaaccgtaccggtaacccgtccgtacggaccggtaccggtacggtaaacggtaaacggtacggttacggggtacgtaaccggttttaacggttttaaccgtttaacggttcggttaaccgtaaccgtaaaccgttaaacctttaacgttttaaaccgtttaccgtttttacccgttttacccgttaacccgttttaccgggtttaccgggggtaaaccggggttaaaccgggtaaaccgggttaacggggtaacggtacgttaaccgtaaacccggtaaaacggttacggttacgggtacggtaccgtaccgtacccgtaacgttaccgttacgtttaccgtttaccgttacgttaccccgg

SEQ ID NO: 65987 - DNA, 770 bp, Homo sapiens
  misc_feature: GYAE6OF02I6QYD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagacctccctggctgtgtctcgtgggcgaggacgggcccaaccatcaactgacaagtccagccagtgttgttttattcggacccccacaaataacaacttacttacgcttacggtaaccagtaccaaggtaaagtacggaacacgtccctaaccgtaacctcctagtactttacggtcgggtccttaccgtaccccggtctaacggttcccggggttacctaaccgtattcctagttcggacgtacgggtccgggtacgtcggggtaacctacgtttccaccttcctacccaacctacgttaccacgtaccacgtcctacggccgtacgggacctagggtaaacgtgttacgggtacggtactttaacggttttaaacttaccgttgtaccgaacgtaacctaaacgtttaactttaacctttacctttttacccgttttaccgttacccgttaaccgggttttaccggggaaccgggtaacggtaaaccggtaagggtagggtaacgtaacgttaaacccggaaacggttacggtacgggtacggtaccgttacggtacctaacccgttagttacccgttgtttaccctaccttacccg

SEQ ID NO: 65988 - DNA, 645 bp, Homo sapiens
  misc_feature: GYAE6OF02HXQ0Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagagggccaccatcaactgacaacgtccagccagtagttgttttattcggaccccacaataacctaactacttagcttaggtaccagcaaggaaagtaggactacgcctacctaaactcctagtatttacgtcgggtcttccgtacccgggctacgttcccggggttacctaaccgtattcagttcggacacggtcgggtcgtcgggacccgtatttccaacgttcgtaccaccatccacgcacgtcctagcgtaggacgtaggaagtagtggttacggacttaagtttacttacgtacgtcaaagtacctaactatttacttactttccgtttcgtacttacggtttcgggacgggtaacggtacgtaagggtggagtacgtaaccgaaacggttacgtaggtacggtctcgacctaccgtacgttcgtacgttcttacctaccg

SEQ ID NO: 65989 - DNA, 790 bp, Homo sapiens
  misc_feature: GYAE6OF02JSZNP.31.78.H01.1.454.CMB.1.raw
  modified_base (122)..(122): a, c, t, g, unknown or other
  misc_feature (122)..(122): n is a, c, g, or t
  modified_base (151)..(151): a, c, t, g, unknown or other
  misc_feature (151)..(151): n is a, c, g, or t
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (410)..(410): a, c, t, g, unknown or other
  misc_feature (410)..(410): n is a, c, g, or t
tcagcagtagacgtcacgaccggtgctcgatttagtgtgagtagtttgggtttgggggagctacaacaggcaggcaggggcagcaagatggtgttgcagacccaggtcttcattctctgttnctctggatctctggtcgcctacggggacntcggtgatggacgcctaggtttccagtacctcccgtggctgtgtctcgtggacgagacggccaccatcaatcgcaacgtccagccagtagttgtttaatcgaccctacaaataacacgttactagcgttagtaccagtcaaagaaagtacggacaacgtccctaacccgtaaacttcccgtagtaacgttttaaccgngggttacctacccggtaacccgggnttaaccggtaccccgggggtttaccctaaaacggtnttaccggtaagttcgggacctagggccggggttaaccttaggggaaccccttgttttacccaacttcccgtaaccgaacccgtaagtcccgtaaggccctaccgtaccggtacggtaccgtaacggtaccggtaagtaacggaacgttgggtacgtacgttaaggtttaaccgtacgttacgacgtaacgtacgtaaacctaacgtttattacccggttattttccgaacgtttaccggttacgggttacgggaaaccgggttaacgtaacggggtaccgtacggttaataaccccggtaaaacggttaccttaggggtccggtaacgttacggtacccgttaacgtacgtttcccgttaagtttccctaacgttcccgg

SEQ ID NO: 65990 - DNA, 770 bp, Homo sapiens
  misc_feature: GYAE6OF02HDTQQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggccccacaataacaactacttagcttaggtaccagcagaaagtagacagcctacctaaactcctagtactttacgtgggtcttccgtacccgggctacgtcccgggggttaccctaaacccggtacttcagtttcggactacggtcggggtccgtacggggtacccgtaattttccgaccttaccttacccaaccctacgttaccgaacgaccgaacgtcccgtaggaccgaacgggtactacggtaaaggtacttagggtacggaccgtttaaggtttttaacctttacgttacggttactaaacggtaccttaaaacgttatttaaccgtttaaccgttttcgttttacccgtaaccgtttaccggttttaccggggaaccgggtaaacgggtaacccgtaaacgggggttacggaacggtaacgttaacccggaaaaacggttaaccgttacggggttacggtaaccgtaggaccctaaaccgtacgtttacccggtttacggttacctttaccgttaacccg

SEQ ID NO: 65991 - DNA, 729 bp, Homo sapiens
  misc_feature: GYAE6OF02H3F1X.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagagttgtttttacttcggaccccctaacaaataaccaacttacttaacgcttaggtaccagacaaggaaagtaggacacggtacctaccttaaactcctagtactttaccgtgggtacttccgtacccggggctacggttcccggggttacctaaccggtacttcagtttcggcctaggtccgggtcgtacgggaccgtatttccacttcaccacgatcagcagcctgcgacggtctaggaagtcgtgtacggtacttaagtttacgtaacgttcgacgtaacgtacctaaacttattttaaccttaaccgttttaccgttttaccggttaaccttaccgggtttttacccggggaccggggtaaacgggtaacccgtaaaggggttacggtaacgtaaccgtaaaccggtaaaaccgggtaaccgttgggtaaccggtaccgtacggtaacctaaccgtaaccgtttccgtttaccggttacctttaccgttaacccg

SEQ ID NO: 65992 - DNA, 635 bp, Homo sapiens
  misc_feature: GYAE6OF02HRW74.31.78.H01.1.454.CMB.1.raw
  modified_base (459)..(459): a, c, t, g, unknown or other
  misc_feature (459)..(459): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggacgagacgggcccaccatccaacgtgaccaacgtccagccaagtagttgttttacttcggaccccaacaaataaaccaacttacttacgcttcgtaacagcaaggaaagtacggacacgcctaccctaaactcctagtactttacgtcggtcttccgtacccgggctaccggttcccggggttacctaaccgtgttacacgttcggctacgggcgggtcgtgggtacccgtattccgacttctacccactactcgacgtacncgtcctgcgacgtcgtagaagtctggcgtagttagtttacttactcgtacagtactactattacttaccttctttacgtcttaccgttcgaccgggaggaacctagggtcgacgtacgtaagtaaccgcgtggacgttcgacgtactacgtcgttacgttccgttactacgttccg

SEQ ID NO: 65993 - DNA, 642 bp, Homo sapiens
  misc_feature: GYAE6OF02JMJ5P.31.78.H01.1.454.CMB.1.raw
  modified_base (242)..(242): a, c, t, g, unknown or other
  misc_feature (242)..(242): n is a, c, g, or t
  modified_base (524)..(524): a, c, t, g, unknown or other
  misc_feature (524)..(524): n is a, c, g, or t
  modified_base (585)..(585): a, c, t, g, unknown or other
  misc_feature (585)..(585): n is a, c, g, or t
tcagcagtagacgtcacgaccggtgctcgatttagtgtgagtagtttgggtttgggggaggcgtacaacaggcaggcaggggcagcaagatggtgttgcagacccaggtcttcatttctctgttgctctggatctctggtgcctacggggacatcgtgatgagcctagtttccagacctccctggctgtgtctcgtgggcgagagggccaccatccaactgacaacggtccagccagagttnttttacttcggaccccaacaataacaacttactagcttggaaccagcaaggaaacgtaggacacgaccctacctaaacctcctagtaactttacggtggtacctttccgaacccgggtactacggttccccggggttaccctaaaccggtactttcgtaacgttcgggctaaccgggtcgggtacgttacgggtaccctagttttccacgtccctacgaccatcgagcgaccgtcctggacgcgtactagaaacgtgtacggtcgtactagtttacttacgngtcacgtacactattactcgtttcttctctacgttcggacggtacggtaacgtggtagtanacgtacgtaaacgtacgttggcgtacttcgacctactactcgttacgtctactaccg

SEQ ID NO: 65994 - DNA, 804 bp, Homo sapiens
  misc_feature: GYAE6OF02IK860.31.78.H01.1.454.CMB.1.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagcagtagacgtcacgaccggtgctcgatttagtgtgagtagtttgggtttgggggagctacaacaggcaggcaggggcagcaagatgggtgttgcaggacccaggtcttcatttctctgttgctctggatctctggtcgccgtacggggacatcgtgatgacgcctagtttccagacctcccgtggctgtgtctcgtgggcgaggacggccaccatccaatgacaagtccagcagtagttgttttacttcggaccccacaaataaccaacctattagtacttacggtaaccngacaaggtaaagtacggacncgtacctacctaactcctagtattacgtcggtaccttaccgacccgggtatacggttcccgggttaacctaaccgtattacctagttcggaccgaggtccgggtctacggggtactactttaccgaccttactaccacctataccacgacgacggtcctaggacgtaacggtcgtaaggtaacggtacgtacggttcgggtacgtttaacggttttacgtttaaccgtcggttaaccgtaaagtacccggtaaactttaacgtttaacccgttttaacgtttttaccgttttacccgggtttaacccgtttaacgggttttacccggggaaccggggttaaaccgggtaaacccggttaaagggggttacccggtaaagggttaacccggttaacgtaaaaccgggttaaccggttagggttaccggtaaccgttcccgaaccggtacccgttaacgttcccgtttacgggtttaccttacgtacccgg

SEQ ID NO: 65995 - DNA, 673 bp, Homo sapiens
  misc_feature: GYAE6OF02H3H24.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggcccacataccaactcgacaacgtccagccaagtagttagtttttacttcggacccccaactaaactaactaactacgttagtcttacggtaccagacgaagaaagtaggactacgacctaccctaaactcctagtattacgtcggtaccttccgtacccggtctacggttcccggggttacctaaccgtattacgtagttcggaccgtagggtccgggttcgtaccggggtaccgttactttaccgacctcgtaccaccatacgacgcctacgtcctgacgtaacggctaagtaacgtagttggcggtacgtaagtttattaccgtgtactaacgactaactatttacttacgtttcttacgttaccgttacgttcggtaacgggacggtaacgtacggtaggtacgtacgtacgaacggtaacgtcggtgtacgcgtaccgactacttacgtcttcctctacccg

SEQ ID NO: 65996 - DNA, 779 bp, Homo sapiens
  misc_feature: GYAE6OF02FG1SB.31.78.H01.1.454.CMB.1.raw
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccacatcaactgcaagtccagccagtagttgttttattccggcccctaaccaataacaactacttagcttggactagcaagaagtacgacacgcctacctaactcctgtaactttcgnggtccttacgtacccgggctacggttcccggggttaccctaaacccggtatttaccgtaagtttcggaccgtacgggtccgggttaccgttacgggggaacccgttacttttacccgaacgttcccttaccctaacccgtagttaccgaacgtccgtaacggtcccttacgggaccgaacggggttaccgtaaggtaaacggttacggtcgggttacggtaaccgttaagggtttttaacttacgttacggtacgtaacgtacctaaacgttactttaacttaccgttttaccttttcggttaccgtttaacggttttaccgggacgggttaaccggtaaccgggtaacgggttcgggaagtaaccgtaacggtaaaccggtacggttacgggtaccggttcgaacgttacccgaaccgttaccgttccgtacggtttacccttaccgttaaccccg

SEQ ID NO: 65997 - DNA, 701 bp, Homo sapiens
  misc_feature: GYAE6OF02I5NKY.31.78.H01.1.454.CMB.1.raw
  modified_base (355)..(355): a, c, t, g, unknown or other
  misc_feature (355)..(355): n is a, c, g, or t
tcagcagtagacgtcacgaccggtgctcgatttagtgtgagtagtttgggtttgggggagctacaacaggcaggcaggggcagcaagatggtgttgcatacccaggtcttcatttctctgttgctctggatctctggtgcctacggggacatcgtgatggagccagtttccagacctccctggctgtgtctcgtgggcgaggacgggccaccatccaactgacaacgtccacgccagtacgttgttttacttcggcccccaacaataaccaactacttagcgttcggtaccagtccagaagtaggacagcctacctaaactcctagtatttacgtgggtccttccgtacccgggnacgttcccggggttacctaaccgacttcgaattcggcaggtccgggtcgtagggaccgtatttccacgttctcaccctagttccgaacgcacggtccctggaccgacgggtctaggaaagtagttcggtacggtacttaacggtttttactacgttacgtacgtacgtacctaaacgtactttaacgttaccttttccgtttacgttccgttaaccgtttcgggggaacgggtacgggtaaccgtaggggttacggtacgtacgtaacggaaacggttaacgttcgggtacggtaccgttcgacccgtaccgttacgttcggttaccgttccgttaccgttaaccg

SEQ ID NO: 65998 - DNA, 663 bp, Homo sapiens
  misc_feature: GYAE6OF02GF0IJ.31.78.H01.1.454.CMB.1.raw
  modified_base (324)..(324): a, c, t, g, unknown or other
  misc_feature (324)..(324): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggcccaccatcaactgcaagtccagccagagttgttttattcggaccccacaataacaactacttagcttggtaccagcaagaaagtagacacgccctaccctaaactcctagactttacgnggtccttccgtacccgggctacgtccgggttacctaaccgnttcattcggacnggtcgggtcgtcgggtaaccgtactttcgaaccttcctaccgaacctacttccgaacgaccgtacgtaccctgacggtacggcgtaggaaacgtagtcggtaggtcgttaaggtttttacgtaacgttcggtacacgtactaaactactttactttacctttcgtttacgtccttacgtttccggggacggtacgggtaacgtagggtcggacgtactaacgaaacgtacgtcgggtaggaccttaggcctaaccgttacgttacctcgttaccttccttaacccg

SEQ ID NO: 65999 - DNA, 641 bp, Homo sapiens
  misc_feature: GYAE6OF02GA469.31.78.H01.1.454.CMB.1.raw
  modified_base (321)..(321): a, c, t, g, unknown or other
  misc_feature (321)..(321): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaagtccagccagagttgttttattcggccccacaataacaactactagcttggaccagcagaaagtaggacagccctacctaaactcctagtactttacgngggtccttccgtacccgggctacgttcccggggttacctaaccgtattcgtaagttcggacagggtccgggtcgtacggggacccgtatttccgactcctaccaacctatccagccacgtccgtgcgaggctagaagtagtgtcggacttaagtttacttacgtcgtacacgtactaactatttacttactttcctttacgtacgttacgtttcggacggacggtaaccgtaagggtacggtacgtacgtaacgtaaacggtacgttaggtcggtacttacggaccgtaacgtacgttccgttacgtttcctacgtaccc

SEQ ID NO: 66000 - DNA, 709 bp, Homo sapiens
  misc_feature: GYAE6OF02JPJS1.31.78.H01.1.454.CMB.1.raw
  modified_base (246)..(246): a, c, t, g, unknown or other
  misc_feature (246)..(246): n is a, c, g, or t
tcagcagtagacgtcacgaccggtgctcgatttagtgtgagtagtttgggtttgggggtaggcgtacaacaggcaggcaggggcagcaagatggtgttgcagacccaggtcttcatttctctgttgctctggatctctggtgccgtacggggacagtcgtgatgagccagtttccagtacctccctggctgtgtctcgtgggcgaggacgggccaccatcaactgcgaacgtccagccagacgttnttttagtcggccccaacaataacaacttacttagcttggtaccagacaagaaagtacggacagcctacctaactcctagtattacgtcggccttaccgacccgggctacgttccgggttaacctaaccggacttcagttcggacacggtcgggttcgtacggggtacctagtttccgacttctaccgactactcgaacgcgtacgtccgtagcgtacggtactaggtaaagtcgtggtacgtacgttaacggttttacgttactagttaccaacggtacctaaacgtttacgttaaacctttacccgttttccgtttaccggttaccttaccgggtttaccggggacgggtaaaccgggtaaccgtaaggggtacggtacgtaaacggtaaccgtaaaccggtacgttacggttcggaccgttagacctacccggtattccggttacttcgttaacctaccgg

SEQ ID NO: 66001 - DNA, 716 bp, Homo sapiens
  misc_feature: GYAE6OF02J0873.31.78.H01.1.454.CMB.1.raw
tcagcagtagacgtcacgaccggtgctcgatttagtgtgagtagtttgggtttgggggagctacaacaggcaggcgaggggcagcaagatggtgttgcagacccaggtcttcatttctctgttgctctggatctctggtgccgtacgggacatcgtgatgacgcctagtttccagtacctccctggctgtgtctcgtgggcgagacggccaccgatcaactgacctaagtccagtccgaagtagttagttttacgttccggcccccaaactaataaaccaacttacttacgcttacggtaaccaggaacaaaggaaaaggttcggaacacgtccctaacctaaaccgtcctagttacttacgtcggtaccttccgaacccgggtctaacgggttcccgggtacctaaccgtattcgagttcggcctaaggtccgggttacgtacggggtaacctatttcccgaactcctacctaacctagtaccgagtaccgacgtcctacgacgtacggacgtagaacgtagtgtacgtacgttatttaacgtagtagtaccgactaacgtaactaacgtttacttacgtttccttacgttacctacgtttaccgggacggaaacggtaacgtaagggttaccgacgtaactaaccggaaacgtacgttggtacccgttaccgagtaccctacgtaacgttccgttacttacccttacgtacccg

SEQ ID NO: 66002 - DNA, 725 bp, Homo sapiens
  misc_feature: GYAE6OF02F33FX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccagtcaactgcaagtccagccagagttgttttattcggccccaacaataacaactacttagtcttaggtaccagcaagaagtacggacacgcctacctaaactcctagtactttaccgtgggtccttaccgtacccgggctaacggttcccggggttacctaaccgtattaccgaagtttcgggacctacgggtccggggtacccgtaggggaaccccgttacttttaccaaccgttccttacccgaaccctaacgttcctaacggacctacggtaccccgttcggacccgtacgggtcgtacggtaaacgggtacgttacgggtaggtaccggttaagttttacgttacttcgggttaccacgtacctaacgttatttaacgttacttttcgttaccgttccgtacgtttcgggacggtaacgggtaccaaggggtgacgacgttaccgaaacggtaacgttacggtggaccgttagaccctaccgtaacgtcctttacggtacctttcgtaaccc

SEQ ID NO: 66003 - DNA, 675 bp, Homo sapiens
  misc_feature: GYAE6OF02GFV9T.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctctgggcgagaggccaaccatcaactgcaagtccagccagtagtgttttattcggacccaccaataacaactactagcttggtaaccagcaagaaagtacggacagtcctaccgtaaactcctagtaactttacgtgggcctttaccgtaacccgggctaacgttccccggggttacctaaaccggtattccgaagttcggacaggtcgggtctggggaccctaagtttccaacttccgtaccaacccgtatccaagcactccgtacgcgtaggacgtacggaaagagtggtacggacgttaagtttaacgttacgttcgtactaacgactaaaacgtactttaattaaccgtttctttacgttaccttaacgttccggacgggtaacggtaaccgaagggttacgagtaacgtacgtaaaacggtaacgttacggtcggacttcgacctaaccgagttaccgttacgttacccgttacgtaaccg

SEQ ID NO: 66004 - DNA, 722 bp, Homo sapiens
  misc_feature: GYAE6OF02IQOEZ.31.78.H01.1.454.CMB.1.raw
  modified_base (468)..(468): a, c, t, g, unknown or other
  misc_feature (468)..(468): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacgggccaccatcaactgacaagtccagccagtagttgttttacgttcggacccccaacgtaataaaccaactacttacgacttacggtaccagtacaaggaaacggtaggacagtaccctacctaaaccttcctagtactttacgtgggtccttccgtacccgggctacggttccccggggttacctaaccgtattctagttcggtacgacggccgggtcgtaggggtaccctatttaccgacttccctccgtacctagtaccgngacctaacggtcccgtagtaccgtacgggtacgtagaaaggtcgtagggtcgggtacgttagttttaacttacgttacgtaccgtacgtaactaacgttattttaacgttcctttacgttttaccgtaccgtttaccgtttacggggtaccgggtaacggtaaccggtagggttacggaacgtacggttaaccgaaacggtaccgtaggtccggcgtacgaccgtacctaccgttcgttccttcgtacttcccg

SEQ ID NO: 66005 - DNA, 781 bp, Homo sapiens
  misc_feature: GYAE6OF02F1SVZ.31.78.H01.1.454.CMB.1.raw
  modified_base (373)..(373): a, c, t, g, unknown or other
  misc_feature (373)..(373): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccacatcaactgcaagtccagccagtagttgttttattcggccccaacaataacaactacttagcttacggaccagcaagaagtaggacacgcctacctaaactcctagtactttacgtcggtctttaccgtaccccgggctacgttcccgggggttacctaaacccggtntttaccagttcggaccgtaacgggtccgggttaccgtacggggtaaccctacttttaccaaccgttcctaccgaccctaagttaccaacgtcctacgtcccgtcgtaccgtacgggacttaggaaacgtacgttacggtacgggtaccttaacggttttaacgttaccgttacggtaaccgaacgtaaccctaaacgttaacctttttaacgttaacccttttaccgttttaacccgttaaccgttaaccggtttttacccggggaacggggttaaccgggtaaacccgttaaacggggtacggttaacgttaaacgttaaaccggtaaaccgtaacggttaacgggtaccggtaccgttacggaccctaaccgtacggttccgtttacgttaccgttacttaacccg

SEQ ID NO: 66006 - DNA, 173 bp, Homo sapiens
  misc_feature: GYAE6OF02F4QRM.31.78.H01.1.454.CMB.1.raw
  modified_base (167)..(173): a, c, t, g, unknown or other
  misc_feature (167)..(173): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccgtannnnnnn

SEQ ID NO: 66007 - DNA, 676 bp, Homo sapiens
  misc_feature: GYAE6OF02HPZ81.31.78.H01.1.454.CMB.1.raw
  modified_base (376)..(376): a, c, t, g, unknown or other
  misc_feature (376)..(376): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcagacgggccaaccatcaactgacaagtccagccagagttgttttattcggccccaacaataacaactacttagcttggtaaccagcaagaaagtaggacacgtccctacctaaactcctagactttacgtgggacttccgacccgggctaacggttcccggggtttaccctaaaccggtnttaccaagtttcggaccaacgggtcggggtaccttgggggaaccccgtaagttttccacttcctacaccctaagtccaagcacgcctgacgaggacgtagaaagagtggtagtacgttaagtttacttactgtacacgactaaactacttaattactttacgtttaccgttactacgttttaccgggacgggtaacgggtaacgtaacgggtcggtaagaacgttaaccgaaaacgtaaccgttaggtacggtacctacggaacccgtacctaacgttccttagttaccttactaacccg

SEQ ID NO: 66008 - DNA, 838 bp, Homo sapiens
  misc_feature: GYAE6OF02H3IIO.31.78.H01.1.454.CMB.1.raw
tcagcagtagacgtccacgaccggtgctcgatttagtgtgagtagtttgggtttgggggatctacaacaggcaggcaggggcagcaagatggtgttgcagacccaggtcttcatttctctgttgctctggatctctggtcgccgtacggggacatcgtgatgagcctagtttccagactccctggcttgtgtctcgtgggcgaggacgggccaccatcaaacgtgacgaacgtccaagcccgagtaggttgttttttagttcggaccccctaacaaataacctaaacttacttagtcgttcggtaaccaggacaacgaaaaggtaggaccagtcccttaacccttaaaactcccgtaagttactttaccggtcggttccttaccgtacccgggctacggtccccggggtttacctaacgtacttcacgttcggctacgggtcgggtacgtcgggtaacccgtattttccgaaccttcctacccgtaacccttaagtccgaaacggtccgaaccggttcccgttacgggaccgtaacgggtaccgttaacgggaaacggtaacggttagggtaccgggttaacgtttaacggtttttaaagtttaaacccggttcgttaccaaaggaacccttaaaccgttaatttttaaacccttaccggttttttaccgttttacccggtttaacccgtttaaccgggttttaccgggggaccggggttaaacgggtaaaccgttaaacgggggttcggtaacggtaaccgtaacggtaaaaccggtaccggttagggacgtaccgtactaccgtaccgtacgttccgtacggttccttacgtaccc

SEQ ID NO: 66009 - DNA, 703 bp, Homo sapiens
  misc_feature: GYAE6OF02JLSKP.31.78.H01.1.454.CMB.1.raw
  modified_base (282)..(282): a, c, t, g, unknown or other
  misc_feature (282)..(282): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatccaactgcaagtccagccagagttgttttagttcggccccaaccaactaacactacttagcttaggtaccanacgaagaaagtacggacacgacctacctaaactcctaggtactttacgtcgggtcttaccggtacccgggactacggttcccggggttaccctaaccgtacttacgtagtttcggcgtacggcgggtccgtacggggtaccgtacgttttacccacttccgtaccaaccgtactccgagccaccggtcctacgcgacgggtacgtaggaaagtacggtgtcggttacgttacggttaactttacgtcgttaacctacgtaactaactactttaccgtttacttttaccgtttacgtaccgtttacgtttaccgggtacgggaacgggtaaccgaggggttaagaccggtataacccggaaaggtacgttcggtacgcgtaacgtcctaacgttacgttccttacgttccgttcctaacccg

SEQ ID NO: 66010 - DNA, 599 bp, Homo sapiens
  misc_feature: GYAE6OF02FVHVB.31.78.H01.1.454.CMB.1.raw
  modified_base (406)..(406): a, c, t, g, unknown or other
  misc_feature (406)..(406): n is a, c, g, or t
  modified_base (465)..(465): a, c, t, g, unknown or other
  misc_feature (465)..(465): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagacgggccacatcaactgcaagtccagccagagttgttttattcggcccacaataacactacttagcttagtaccagcagaaagtacgacagcctacctaaactcctgtatttacgtcgggcttcctacccgggcacgttcccggggttacctaaccggtattacgagttcgcacggtcgggttctgggacccgtactttcgactccncaacctatccagtcacgcctagctaacggcgtagaagtcgtggtcggcttagtttactntgtcagacaatattacttccttagtttccgttcgttaaccgtttcgggtacggtaccgggaaccgtaagggtcgtacgactaaccgtaaacgtacgtacggtaggtcgtacgcaccgtatcgtattcctatccc

SEQ ID NO: 66011 - DNA, 731 bp, Homo sapiens
  misc_feature: GYAE6OF02FI774.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtcgtctcgtgggcgagagggccaccgatcaactgacaagtccagccagagttgttttattcggccccaacaataacaactacttagcttaggtaccagtcaagtaaagtaggacacgcctacctaaacgtcctagactttacgtgggtccttcgtaccccgggctacggttacccggggttaccctaaacccggtatttaccgaacgtttcgggacctaacggggtccggggttcgtacgggggtacccctagttttcccgactttccctaccgaccctattaccgaacgccacgtccgtggtaccgacggtaccgtaggaaacgtagtacggtcggtacttaagtttacgttacgttcgtaccgtaacgacctaaacgttactttaacgttacctttacgttttaccgttaccgttaccgttttaccggacggtaccggtaaccggtaagggttagggacgtaacgtaaccgtaaaacggtaaccgttaggtacggtaccgtacggtacctaaccgtacgtaccgttacgttaccgtacttaccg

SEQ ID NO: 66012 - DNA, 731 bp, Homo sapiens
  misc_feature: GYAE6OF02JT7PI.31.78.H01.1.454.CMB.1.raw
  modified_base (259)..(259): a, c, t, g, unknown or other
  misc_feature (259)..(259): n is a, c, g, or t
  modified_base (503)..(503): a, c, t, g, unknown or other
  misc_feature (503)..(503): n is a, c, g, or t
tcagcagtagacgtcacgaccggtgctcgatttagtgtgagtagtttgggtttgggggtaggctacaacaaggcaggcaggggcgagcaagatggtgttgcagaccaggtcttcatttctctgttgctctggatctctggtgcccgtacggggacattcgtgatgacgacctacggttttccaggccttcccgtcgggtgtgtacgtctcgtggggacgaggacgggaccaccatacaactcgacaacgtccacgaccngtacgtttgttttacgttaccggaccccaactaactaaactaacttaccgttagtcttacggtaaccaggactaaggaaacgtacgaccgtacaccttaaccctaagtcctaggttaacttacgtcggggccttaccggtacccgggattaccgggttacccggggttacctaaacgttactacgttagtcggacgtacggtcggggttactaccggggtacttacctttacgactccgtaccngaccgttagccacgtacgtccgtagtaccgtacggtacgtagtaacgtacggtcggttagtaccgtttagttaagttacccgtttaggccttaacggtacctaaacgtttatttaccttacgtttcctttcgttaccgttacggttacggtcggacggtacgtaggtagactacgtaacgtaccggtataggtcgtacgtacgccgtatcggtctcgttacttcctcg

SEQ ID NO: 66013 - DNA, 828 bp, Homo sapiens
  misc_feature: GYAE6OF02JZSPA.31.78.H01.1.454.CMB.1.raw
  modified_base (395)..(395): a, c, t, g, unknown or other
  misc_feature (395)..(395): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgacgcctagtttccagactcccgtggctgtgtctcgtgggcgagcggccacatacacgtgacaacgtccagccagtagttcgttttagttcggacccctaacaaataaaccaacttacttagcttacggacctagacgaacgtaaagtacggacacgtaccttaactaaacgtcctagtaactttaccgtcggtccttaccgtacccgggatacggtccggggttacctaaaccggtnttcgtaagttcggactacgggtcgggttcgtaccggggaccttacgtttacactttccaccgtaaccgtacgttacgaaccggtccgtaaccggttcccgtacggtaaccggtacgggtacctaagggtaaaacgttagttacggggttacggtaccgttttaaggttttaaccgtttaaccgttcggtaaaccgtacggttaaccttaaaaccgtttactttaaccgtttaacccgttttccggttttaaccgttacgtttaacccgggttttaacccgggaggggttaaacccgggaaacccgttaagggtaaccgggtaacgtaaccgttaaaccgggaaaaccggttaacggttacgggtaccgtaaccggttaccgaaccgtttaacccgacgtttacccggtttacgttacccttaccgttaacccg

SEQ ID NO: 66014 - DNA, 736 bp, Homo sapiens
  misc_feature: GYAE6OF02JCMM5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtcgtctcgtgggcgagacgggcccaccagtcaactgcaacgtccagcccagaggtttcgttttagttcggaccccctaacaaacttaaacaaaccttacgttacgcgttacgggtaaccagaccaaggtaaaagtacgggaccacgtccctaccctaaaacctcctagtactttacgcggtccttccgtacccgggctacggttcccggggttacctaaccgatttcgaagttcggactaggcgggtcgtacggggtaccgtactttcgaccttcctaccgaacctacttccgaacgcctacgtcccgtacgccgtaggtcgttaggaacgtattcgggtcggtacgttaacgtttaacgtttacgtcggttaccgaacgacttaaaccttaacgttttaacttaaccgtttttccgtttaccgttaccgttaaccgttttccggggtaccggtaaacgggtaccgaaggggttacggacgtaacgtaacgtaaacggtacttagggtacgtcgttaggacctacgtaccttcgtacgttcttacgtccg

SEQ ID NO: 66015 - DNA, 651 bp, Homo sapiens
  misc_feature: GYAE6OF02IWHFR.31.78.H01.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (405)..(405): a, c, t, g, unknown or other
  misc_feature (405)..(405): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgcctacggggacatcggtgatgagtcctagtttccagtacctcccgtggctgtntctcgtgggcaggngggcccacatcaatnacaagtccagccagtattntttatcggaccccaanaataacatactagcttgaccagacaagaagtagcagccctactaaactctagtactttacgcggtccttcacccgggntacgttcccgggttaccaacgtnttccagttgacgngcgggtctagggacctnttaccacttcaccaacctntaccagcctacgccgtagctaggtcgtaggaagcgtcggtgtacgttagtttacttacgtagttcccagtacctaacttagtttaaccgttacttttaccggtttacgtaccgttaccgtttaccggggaccgggtacggaacccggtaagggttacggtacgttaacgtacggtaaacgtacggttacggtccggtacgttacggtaccaccgttacctccggtttacttaccgttacctaaccg

SEQ ID NO: 66016 - DNA, 701 bp, Homo sapiens
  misc_feature: GYAE6OF02FO2C3.31.78.H01.1.454.CMB.1.raw
  modified_base (686)..(686): a, c, t, g, unknown or other
  misc_feature (686)..(686): n is a, c, g, or t
tcagcagtagacgtcacgaccggtgctcgatttagtgtgagtagtttgggtttggggggacgcgtaacgaacagggcaggctaggggcagcaagatggtgttgcagaccaggtcttcatttctctgttgctcgtggattctctggtgcctacggggacatcgtagatgacgcctagtttccagactcccgtaggctgtgtctcgtgggcgaggacgggccacgatccaactgcaacgtccaagaccgaggtagtttcgtttttagttcggaccccaacgtaaacgtaaccaaacttacttaacgtctttaggtaaccctagtcgaacgaaaggttaacggaccgacgtacccgttacctaaaccctccacgtacttttacctcgggactttccgtaccgggcctacgtttccccggggtttacctaaccggtacttccgattcggacgacgtccgggtcgtagggggaccctattccgacgttcctcgaccgtacgtccgagtccgaacggtcccttacggacgacgggtaccgtacggaaacgtcgttaggtcgggacggttagttttaacgttacgttacggtcaacgtactaaacgtatttaacttactttcctttcgtcttacgtttgggacggtacgacgaaggtgagatacgaaacgtacgtcggtacgcttagcgtacnctctcgttctctacc

SEQ ID NO: 66017 - DNA, 696 bp, Homo sapiens
  misc_feature: GYAE6OF02FSITD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggaggccacagtcaactgcaagtccagccagtagttgttttattcggccccacaataacaactacttagcttggtaccagcaagaagtagacagcctactaaactcctagtactttacgtgggaccttaccgtacccgggctacgttcccgggggttaccctaaaccgtattccagtttcgggctaggtccggggtcgttacggggtaccctattttccgacttacgtacccaccgtaatccgaagtccctaaggtcccgttcgaccgagggtaccttaggaaaggtacgttgggtacggtactttaaggtttaacttaccgttgtccaaacgtcctaaacgtactttaacgttacctttcgtttaccgtacgttaacgtttccggggaacggtaacgggtacctaacgggttagggaacgtacgtaccggtaaaactacggttaggttacggccgttaggaccctacgtactttaccgttggttacccttaccgtacg

SEQ ID NO: 66018 - DNA, 795 bp, Homo sapiens
  misc_feature: GYAE6OF02IP2ZW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtagatgacgtcctagtttccagacctcccgtggctgtgtctcgtgggcgaggacggccacatccaactcgacaacgtccagccaagtagttcgttttaacgttccggacccccaacgtaaactaaacgtaaacttaaccgttagtccgttacggtaaccagtacgaaagaaaaggtcggaacacgtacctacctaactcgtagtattacggcggtcttccggtacccgggctacggttccgggttacctaaccgtattccgtagttcggaccgtagggtccgggttcgtacgggtacccgttactttaccgtactaccctaccgaacctacgtaccgacgtaccgacgtcccgtacggtcgaacgggtcgtaagggtaagacgtgggttacggaaccgttttaaggttttaacttaccgttcgttaaccgagtaaaccacgttttaacgtttaaccttttacccgttttccgtttaccgtttacccgttaaccggtttccggggtaaaccgggtacggggtaaacccgtaagggttacgggaacgttaaccgaacgtaaaacccgggtttaacgcgggttacgttaaccggacggtcccctaaacgggttcctccggtttacgtttccgtactaccccgg

SEQ ID NO: 66019 - DNA, 679 bp, Homo sapiens
  misc_feature: GYAE6OF02FMIO2.31.78.H01.1.454.CMB.1.raw
  modified_base (405)..(405): a, c, t, g, unknown or other
  misc_feature (405)..(405): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtcgtctcgtgggcgaggacgggccaaccatcaacgtgacaagtccagccagtagttgttttagttcggacccccaacctaataaccaacttaccgttagtctttacggtaccagacgtaaggtaaagtacggacacgtacctacctaaactcctagtactttacgtcggtcttccgacccggctacgttccgggtcctaacgcttcatcggcagcggtcncgggactattcactctaccactgtcagcgacgtcctcggacgtcgggactaggaaggtctagggtcggtacctttaaggttttactacgttacgtacgagtacctaagttactttattacctttcgttttaccgtccgttacgtttccgggacggggtaaccggtaaccgtagggttcggaactaccgtaacgaaacccgggtaagttccgggtacggttacctaacgggtccctaacggttacccttaggtccgtttaccttaccgttacccg

SEQ ID NO: 66020 - DNA, 744 bp, Homo sapiens
  misc_feature: GYAE6OF02HUMPY.31.78.H01.1.454.CMB.1.raw
  modified_base (161)..(161): a, c, t, g, unknown or other
  misc_feature (161)..(161): n is a, c, g, or t
  modified_base (218)..(218): a, c, t, g, unknown or other
  misc_feature (218)..(218): n is a, c, g, or t
  modified_base (262)..(262): a, c, t, g, unknown or other
  misc_feature (262)..(262): n is a, c, g, or t
  modified_base (390)..(390): a, c, t, g, unknown or other
  misc_feature (390)..(390): n is a, c, g, or t
  modified_base (463)..(463): a, c, t, g, unknown or other
  misc_feature (463)..(463): n is a, c, g, or t
  modified_base (500)..(500): a, c, t, g, unknown or other
  misc_feature (500)..(500): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatganccagtttccagactcctggctgtgtctcgtgggcgagagggcccacgatcaactganaacggtccagtaccagaggttggttttacttacggacccccaanaaacgtaacaaaccgttaacttacgtcgttaggtaccaagtacgaaggtaaacggttacggaactacgtaccctacccgttaaaactcccttaaggtacttttaacgtcggtccttacgtacccgggntaacgtcccggggttacctaaccgattcgatggtcaggcggtctacgggacctagtttcacctcgtactaccntcgactcacggtctaggcctaggacgttacgaaaggngttacgggcggttactaaggttttaacgttacgtacggtttaccgaaagtacgtaaaccctaagttttaaccgtaaccgttttccctttttaccggtaacctttacccggttttacggggacccggtaacggggtaaaccgtaacgggggtttggaacggtactaccggtaaaacgacgtttacggtaggttacccgtgtacccgtaaccctagtttacccggtacgttacctttcctaaccgg

SEQ ID NO: 66021 - DNA, 842 bp, Homo sapiens
  misc_feature: GYAE6OF02J0OK5.31.78.H01.1.454.CMB.1.raw
  modified_base (806)..(806): a, c, t, g, unknown or other
  misc_feature (806)..(806): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatggagtcctagtttccagtacctccgtggtctgtcgtctcgtcgggcgacggacgggacccaccgacgtcaaacgtcgacgaacgttcccagcccgaggtacgttgtttttaactccgggacccccaactaaacttaaaacctaaccgttacttacggtacgtttacggaacccctagaccgtaaaggaaaaggttaccggacgtaaccggtacccttaaacccgtaacccgttacccttaaggtaacgttttaaccggtccgggttaccctttaccgggtaaccccggtaccgtaacccggttttaccccggggggttaaccccttaaaaccggtacttttacggtaaacgttacgggtcctaccggggtaccgggttaacccggtacgggggtaacccttaaccgttttaaccctaccgtttccgtaaaccctaacccgtaagttacccacggtaccgtaaccgtcccgtaacggtacgtaaccgggacgtaaaccgggtaagtaacggtcggtacgtaccgttaagttttacgttaacggtcgtacgtaagtacctaacgtttaacgttacttaccgtttcttaccgttaccgttacgttaccggtacggaacggtaacgagggtacgatacgtacgaaccgtancggtgtcacgtcgactagtcctacgtcttatacccg

SEQ ID NO: 66022 - DNA, 722 bp, Homo sapiens
  misc_feature: GYAE6OF02IA2F4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggcccacatcaactgacaagtccagccagtagttgttttacgttcggacccccaactaactaacaaaccttactagtcttacggtaccagacaagaaagtggacacgtacctacctaaactcctagtactttacgtcggtccttaccgtacccgggtctacggtcccggggttacctaaccgtacttcgtagttcggccgtaggtccgggtcgtacgggtacccgttattacctaccgtctaccgactactcgacgccgtacgcccgtgaccgtggacgtaggaaagtgttcggtaggtacttaagttttaacgttacgttcgtactaacgtaacctaaacgtttacttttaactttaccgtttttccgtttaccgttaccgtttaaccggtttccggggacgggtaaacgggtaaccgtaaggggtacggtaacgtaacgtaaccggtaaacggtacggttaggtaccggtactacgtacctaccgtattacccgtcggttttaccctacttacccg

SEQ ID NO: 66023 - DNA, 700 bp, Homo sapiens
  misc_feature: GYAE6OF02IDIV8.31.78.H01.1.454.CMB.1.raw
  modified_base (84)..(84): a, c, t, g, unknown or other
  misc_feature (84)..(84): n is a, c, g, or t
  modified_base (191)..(191): a, c, t, g, unknown or other
  misc_feature (191)..(191): n is a, c, g, or t
  modified_base (246)..(246): a, c, t, g, unknown or other
  misc_feature (246)..(246): n is a, c, g, or t
  modified_base (373)..(373): a, c, t, g, unknown or other
  misc_feature (373)..(373): n is a, c, g, or t
tcagcagtagacgtcacgaccggtgctcgatttagtgtgagtagtttgggtttgggggagctacaacaggcaggcaggggcagnaagatggtgttgcagacccaggtcttcatttctctgttgctctggatctcgtggtgccgtacggggacatcgtgatggagcctagtttccaagcctccctggctgtntctcgtgggcgtaggacggcccactatccaactgacaacgtccagccagtagttnttttacgttccggacccctaacaaactaacaacttacttaggtcttacggtacagacaaggtaaacgtggacacgtcctaccctaaactcctagtaacgtttacgtcggcctttaccgacccgggtntacggttcccgggttaacctaaacgtcgttacaacgttggaccgtaggggccggttcgtacggacccgtttatacccggtccttactaccgaccttacgcgacgtacgtacgccgtcgacgtaggtccgtaagtaaacgtgttacggtacggacctttaagttacgttacgtcgtacgacgtaactacgtactttaacttctttacgtcgttacctaccggtttcggaccgggttaacggaaccgtagggtaaacgtcgtaacgtaccgaaaccgtacgttacggtcgaccgttacgcctacgtacttcgtacgttcacgtttaccg

SEQ ID NO: 66024 - DNA, 808 bp, Homo sapiens
  misc_feature: GYAE6OF02INOK8.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatggacgcctagtttccagacctcccgtggctgtgtctcgtgggacgagacgggccaccatccaatcgctaacgtccagccgagagttgttttactcggacccctaactaataacacttactacgcttacggtaccaggacaaggtaaacgtaggacacgtccctacctaaactcctagtactttaccgngggtacctttaccggaccccgggtactaacggttccccggggttacctaaaccgtagttccgtaagtttccggcgtaacggtccgggggttctaccgggggtaacccttattttccgaaccttccgtaccaaacccgtgttacgacggtacgtaccgtcccgttagaccgtaacggtacttaggaaacgttacgtcgggtacggtacttaacgttttagttaccgttacgtaacgacgtaacctaaacgttaacgtttaccgtttaacctttccgttttaccgtaaccgtttacccgtttacgggggaacccgggtaacgggtaaacccgtaaggggttacggaaccggttaacgtaaccggtaaaaacccggttaggttacgggttaccgggtacccgtaaccggtaccggttaacccgtaggtttaccctacgggtttcccttaaccgttaccccgg

SEQ ID NO: 66025 - DNA, 704 bp, Homo sapiens
  misc_feature: GYAE6OF02H3R45.31.78.H01.1.454.CMB.1.raw
  modified_base (281)..(281): a, c, t, g, unknown or other
  misc_feature (281)..(281): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggactctcgtggtgccgtacggggacatcgtgatgagcctagtttccagtactcctggctgtgtctgtgggcgaggcggccacatcaatgcaacgtcacgacagtagtttgttttactcgacccccaataataacaacttcttagcttcggacngacaagaagtcgactacgcctaccctaactcttagtattcgtcgggtccttccggtacccggctacggttcccgggttacctaacgtattccgtagttcgacgacggtcgggtcgtacgggtacctactttctccgtacctaccaaaccgtacgtcgtaacgtaccacggtcctaccggacgtaccggtacgtaacggtaacggtacgttggtacggttactttaacgtttacgtttacgcgttacgtactaacgaactttactttactttactttactttccgtacgttaccgggttcggacgggtaacggtaaccgaagggttacgacgttaacgtaccggtaaacggtaccttagggtacggaccgtacggacccgttaacgttacccgttacggttaccgtttccttacccttacccgg

SEQ ID NO: 66026 - DNA, 633 bp, Homo sapiens
  misc_feature: GYAE6OF02GP1BK.31.78.H01.1.454.CMB.1.raw
  modified_base (361)..(361): a, c, t, g, unknown or other
  misc_feature (361)..(361): n is a, c, g, or t
  modified_base (439)..(439): a, c, t, g, unknown or other
  misc_feature (439)..(439): n is a, c, g, or t
  modified_base (470)..(470): a, c, t, g, unknown or other
  misc_feature (470)..(470): n is a, c, g, or t
  modified_base (627)..(627): a, c, t, g, unknown or other
  misc_feature (627)..(627): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggagggcccaccatccaagtgacaagtccagccagtagttgttttagttcggacccccaacaataacaacttacgttagcttaggtacccagacgaagtaaagtaggacacgccctacctaaacctccgtagtactttacgtgggccttaccgtacccgggnaccgttccggggttaccctaaccggtattctagttggctacggtcgggtctggggacctattccactcctccgaaccntccgagcacgcctgacgaggtcgtagaagtntgcgtctagtttacttactcgtcgagtacaactattacttactttcgtttactcgtaccgtttcgggaggtacggtacgtaagggtggtaacgtacaaccggtaaacgtaccggttgtacggtaccgtacgcctacggtacttcgtacgtttacctntacccg

SEQ ID NO: 66027 - DNA, 797 bp, Homo sapiens
  misc_feature: GYAE6OF02JKFKH.31.78.H01.1.454.CMB.1.raw
  modified_base (565)..(565): a, c, t, g, unknown or other
  misc_feature (565)..(565): n is a, c, g, or t
tcagcagtagacgtcacgaccggtgctcgatttagtgtgagtagtttgggtttgggggagctacaacaggcaggcaggggcagcaagatggtgttgcagacccaggtcttcagtttctctgttgctctggatctctggtcgccgtacgggacatcggtgatgagtcctagtttccagcctccctggcctgtcgtctcgtgggcgagacgggaccaccgtatctaaacgtcgacgtaacgtccgacgaccgtaggtacgtttcgtttttacgttaccggacccctaacctaaacttaacaaccgttacttaacggtccgttaccggttaaccgacgaccgtaaggtaaacggttacggaacgtacgttacccttaacccgttaaaccgttcccgtaagttaacgttttaaccggtccggggttacctttaccccggtaacccggggtctaacccgggttcccgggggtttaacccttaaaccggttgttaccgtacggttcggaccgtcggtacgggccggtacggtacttagttcctactcctacgtactactctacgcggtacncgtagcgtacgagtacgaaggtcgtgcggacgttactttacgttaaccgtcggtacagtacgtaacttcgtttacgtttacctttaccgtacgtttacccgttaccggttcgggtaaccggacggttaaaccgggtacggggtacgtacggtacgttaaccggtaaccggtaacgttcggtaaccgccgtacgttaaccgcttaacctgtttacgttaccgtaccttaccgg

SEQ ID NO: 66028 - DNA, 711 bp, Homo sapiens
  misc_feature: GYAE6OF02HJL8T.31.78.H01.1.454.CMB.1.raw
  modified_base (322)..(322): a, c, t, g, unknown or other
  misc_feature (322)..(322): n is a, c, g, or t
  modified_base (686)..(686): a, c, t, g, unknown or other
  misc_feature (686)..(686): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgaggagggccaccatcaactgacaagtccagccagagttgttttattcggaccccaacaataacaactacttagcttggtaccagcaagaaagtaggacagcctacctaaactcctagtattacgngggtcttaccgacccgggactacggttacccggggttacctaaccggtacttcgtagttcggacgtacgggtcggggtactacggggtaaccgtacttttaccgaaccttcgtacccaaccgtaactccgaagccacgtccctacggaccgtacggacgttaaggaaacgtacgtgggttacggtacgttaggttttaacgtttacgtagtaccaagtaacctaaacgttaatttaacgttaccttttccgtttaccgttaccgttaccgtttccgggacgggtaacgggtaaccgtaagggttaggacgtaacgtaaccgaaaacggtaccgtagggtacggtaccgtacggacctaaccgtnttaccgtcgttaccgttactacccg

SEQ ID NO: 66029 - DNA, 1055 bp, Homo sapiens
  misc_feature: GYAE6OF02H88SN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagcctcctggctgtgtctcgtgggcgaggacgggcccaccgatacaactcgacaaacgtccaagaccgaggtacggttgttttttacgtttccgggaacccccctaacctaaaacttaaaccctaaacctttaaccgtttaacggtacccgttttacggggtaaccctaggaccgtaaagggtaaaaacggtacgggtaaccgtaaccggacccctttaacccgttaaaacccttccccgttaacggttaacgttttaaccggttcggggtttcccgtttaaccccggttaacccccgggggttaccgtaccgggttttacccccggggggttttaccccttaaaaccccggtacgttttaccgtaacggttttcgggaaccgtacggggttaccgggggttaccggttacgggggtaaccccttacgttttaacccgtcccgtttaccttacccgtaaccctaagtacccgtaccggtacctacccggtccccgttaggcccgaagggtacccgttacgggaaaaggttacgttcggggttacgggtaacgttttaaaggttttttaccgtttaaccgttcggttaacccgtaactaacccggtaaaaccttttattttaaaccgtttttacccgttttaccgtttttacccgtttaaccgttttaccgggttttacccgggggaccgggggttaaacccgggttaaaacccgggttacgggggggttaattaacccgggttaaacggttaaaaccccggttaaaaaccgggttacccgggttaacggggtttaacccgggtcggtaacccggtaccccgtaaaacccggttacttttaccggtttaacccggtttttacccgtttaactttaaccccccgg

SEQ ID NO: 66030 - DNA, 957 bp, Homo sapiens
  misc_feature: GYAE6OF02JX579.31.78.H01.1.454.CMB.1.raw
  modified_base (391)..(391): a, c, t, g, unknown or other
  misc_feature (391)..(391): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagccagtttccagacctccctggctgtgtctcgtgggcgaggacgggccaccatccaactgcaacgtccacgccgagagttgtttttaattcggacccccaacaaataaccaacttacttacgacttacgggtaccagacaaaggtaaaacggtacgggaacacgtaccctacccgtaaaactcccgtagtaacgtttacgtcgggtacctttcccggtaaccccggggnttaaccgggttaccccgggggtttacccgtaaaacccgttgtttaaccgtagtttaccggggccgtaacggggttaccggggttccgttaaccggggggttaaccccgttaacgttttaccgaacccctttcttaacccctaaccccggtacgttaccgaacggtacccgtaaccggtttcccggtaggtaacccgggtaacgggtaccgttaacgggtaaaacggttcggtttacggggtacggggttaacctttaagggtttttttaacccgttaacggtttccggtaccgttaaacggtaccctaaaattttaccgttttaaacggttttaccccttttaccgtttttaccggtacccggtttaccggggtttttacccgggggaaccgggggttaaaccgggttaacccgggttaaagggggttccggggttaaacgttaacccggttaaacccggtaaaaccgggttaaaccgggtttacggggttaacggtaccccgtttacggaacccgttaccgtaaccgttttcccggtttaggtttacccttaaccggtttccccg

SEQ ID NO: 66031 - DNA, 768 bp, Homo sapiens
  misc_feature: GYAE6OF02GZLKY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggagggccaccatcaactgacaagtccagccagtagttgttttattcggccccacaataacaactactagcttggtaccagcaagaaagtaggacacgccctacctaaacctccttagtactttacgcgggtcctttaccgtaccccgggactacggttcccggggttacctaaccgtatttccaaggtttcggcgtacgggtcgggttaccgttacggggacccgtattttcccgaaccttccgtaccaaccctataccgaacgcctaacggtccctcggaccgacggtacttaagggaaacgtaggtcgggttcggtaccgtttaaggtttttaaccgttacgttcggtaccgaacggttaactaaccttaagtttaacctttacccgttttcgttttacccttccggtttaacggtttaccggggaccggggtaaacgggtaaccggtaaggggtttacggaagttaaccttaaccggtaaaaccggttacggtttggggtaccgtaccggttacgtaccccgtaaccgttaccgtttacccggttagtttccccttagtaccccg

SEQ ID NO: 66032 - DNA, 722 bp, Homo sapiens
  misc_feature: GYAE6OF02GZZSQ.31.78.H01.1.454.CMB.1.raw
  modified_base (386)..(386): a, c, t, g, unknown or other
  misc_feature (386)..(386): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcccgtacggggacatcgtgatgacgcctagtttccagacctccctggcttgtgtctcgtgggcgaggacgggccacctatccgaacgtcgactaacgtccacgccagtagtttgtttttacgttccggaccccaactaataaaccaacgttaacttacgtcttaggtaccaaggacaaggtaaagtaggaccacgtaccctacctaaacgtcctagtactttacgtcgggtacttccgaacccggtntaacggttccgggttacctaaccgtgttacaggttcggacgtacggtcggttccgtacgggtacccttagtccctaacgttcctacgaccctatccagtccgtacgcgtgacgtaggtctacgagtagtcgtaggtacgttagtttaattacgttacgtacgaactacgtaacgttaattaacgttaaccttttcctttacgtacctttccgggttacggtcgggtaaaccggtaacccggtaggtacgggtagtaccggttaaacgaaacccggttaggttacggtacggtcgtacgtactaccggttacttcgttacttaccggttcttacccg

SEQ ID NO: 66033 - DNA, 778 bp, Homo sapiens
  misc_feature: GYAE6OF02I1290.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacgggccaccatcaactgacaacgtccagccagtagttgttttactcggaccccaacctaaactaactaactacttagtacttacggtaccagacaagaaagtacggacacgacctacctaaacctccgtagtactttacgtcgggtccttaccgtacccgggtactaccggttacccgggttacccgtaaccgtacgttacgtacgttacggcgtagggtccgggtacggtacggggtaacccttacgtttaccgtaccttccgtaccctaaccctagtacccgacggactaccggtcccgtaggaaccgtacgggtacgtaacggaaaggtacggttcgggtacggtacgtttaaacgttttacgttacgtacgttaccgtaacgtaccgtaaacttaacgtttaacgttaccttttacccgtttacgttacctttaccgggttaccgggtaacggggttaacggtaacggttaagggttacggtaacgtaacggtaaccggtaaacgtacgtacgggttaccgacgttacggacttacccggtatccggttactttacctacgttacccg

SEQ ID NO: 66034 - DNA, 658 bp, Homo sapiens
  misc_feature: GYAE6OF02FW0Q7.31.78.H01.1.454.CMB.1.raw
  modified_base (457)..(457): a, c, t, g, unknown or other
  misc_feature (457)..(457): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctcgtgggcgagagggccaccatcaactgcaagtccagccagtagttgttttatttcggaccccaaccaaataaccaactacttagcttaggaccagcaagaaagtagacacgcctacctaactcctagtactttacgtggtccttcgtaccccgggactacggttcccggggttacctaaccggtattacgagttcggcctacgggtcgggtccgtacgggtaaccgtatttccgacctcctacaccctatccacgcacgtccgtgacgnggctagaagagttaggtcgtacgttaagtttacttacttacgtccgagtaactaactaactttacttactttccttacgttcgtaccgttttccgggacggtacgggtaaccgtaacgggtagtacgtaacgtaaccgaaacggtaacgtacggtcgttaccgtgtaccctacgtacgttaccgtcgttcgtaccttaccg

SEQ ID NO: 66035 - DNA, 793 bp, Homo sapiens
  misc_feature: GYAE6OF02F0YRA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggacgggccacctatacgaactgacaacgtcccagccaagtagttcgttttagttccggacccccaacgaaactaaacctaacttaaccttaagtccgtttacggtaacctagacgaaagtaaaacggtaaggacctaacggtacccttaacccttaaaaccgtcccgttaggtaacttttaaccggtagggtcccgtttacggtaccccgggtctaaccggtttcccgggggttaaccctaacccgtagtttccaacggtttcggacgtacggtccgggtcgttacggggtaaccctagtttacaccttactaccgacctattcgacgtcacgtccacggtcgacggtctaacgaacgtaggttacggtacggtacgtttaagtttttacgtacgtttcgtaaaccgacggtaacctaacgtttaactttaacgttacccttttcggttttacgtacctttacgggtttccgggaaccggttaaacggggtaaccgtaacgggttaggaacgttaacgtaacgtaaaacggttacggttagggtcgtaacggtacgtcccgtaagttcctcggtacctttctacccggtaacc

SEQ ID NO: 66036 - DNA, 703 bp, Homo sapiens
  misc_feature: GYAE6OF02HGDXQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacgggccaccatcaactgacaagtccagccgagagtttgttttacgttccgaccccaactaaataactaaacttactagtcttcgaaccagacaagaagtagacagcctaccaaactccgtagtactttacgtcgggtccttaccgacccggctacggttcccgggttaccctaaaccgtacttcacgttggcgtacgggcggttcgtaccgggtaccgtactttccgacttccgtcctacctatccgagtcgaaccgtcctacggaccggtagtaccgtagtaacggtagttcgggtaccgtacgtttaagtttacgtacgttcgtactacgtaactacgttattaacttaccgttttcgtttaccgttaccgttcgttttcccggggaacggttaacgggaacccgtaaggttacggaacgtaacgttaccgtaaaccgtacgtacggtacgtacgttaccgacgtaccgtacgttccgttacgtttacttaccgtaccg

SEQ ID NO: 66037 - DNA, 628 bp, Homo sapiens
  misc_feature: GYAE6OF02IDM3K.31.78.H01.1.454.CMB.1.raw
  modified_base (468)..(468): a, c, t, g, unknown or other
  misc_feature (468)..(468): n is a, c, g, or t
  modified_base (623)..(623): a, c, t, g, unknown or other
  misc_feature (623)..(623): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggagggccaccgatcaactgacaacgtccagccagtagttgttttacttcggccccacaataacaactacttacgcttggtaccagacaaggaaagtagacgacgtcctaccctaaaactccgttagtactttacgtgggtccttaccggtacccgggctacgtcccggggttacctaaccgtacttacgagttcggctaggtcgggtctcggggaaccttattccgactcctacaccagtccacgcacgcctgacgaggctagaagngtagtggtacttagtttactacgtcgtacagtacaactattacttactttcgttacgttccgtacgtttacggacgggtaggtaccgtaagggtgagtactacgaaacgtaacgtacggtcggtacgtacgtacacgtacttcgtcgttaccgtntaccg

SEQ ID NO: 66038 - DNA, 870 bp, Homo sapiens
  misc_feature: GYAE6OF02I1FDM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaacgtccagccagtagttgttttacttcggccccaacaaataaccaactacttagcttaggtaccagcaagaaagtaggacacgacctacctaaaccttcctagtaactttacgtcgggtcttacccgtacccggggactaacggttcccggggttaccctaacccggtactttaccaacgtttcggaccgtaacggggtcccggggttccgttacgggggtaaccccggttacgtttttacccgaacccgtttccttacccgtaaacccctaaatttacccgaaacgggtacccgtaacggtccccgttaacgggaccgtaaacggggtcccgtttaaagggaaaacggtaacggttgggtaaccgggttacgtttaaacgggtttttaaactttaccgttacggtttacccgaaacggtaacctaaaacgttaacttttaaactttaacccgttttttacccgttttaccgttaccgtttaaaccgggtttttccggggtaaccggggtaaacggggtaaccgtaaacgggggttaaggtacgttaacgttaaacccggtaaaacggttaaaccggttgggtaaccgggtacccgttaacgacccgtaacccttagtttacccgttacggtttaccgtttaccgtaaccccg

SEQ ID NO: 66039 - DNA, 742 bp, Homo sapiens
  misc_feature: GYAE6OF02JDXDE.31.78.H01.1.454.CMB.1.raw
  modified_base (553)..(553): a, c, t, g, unknown or other
  misc_feature (553)..(553): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgaccgtacggggacagtcgtgatgacgcctagtttccagtacctcctggctgtgtctcgtgggcaggacggcccaccataccaactcgacaacggtccaggcccaaggtacgtttgtttttacgttacccggaccccctaactaaacgttaacctaaaccgttaaccttaaggtcgtttaccggtaacccaggaaccaaggtaaaaggtcgggaacctagtcccttaccgtaaactccgtagtactttaccggcggtcctttaccgacccggtacgtaccgttcccggggttacctaaaccgtgttacgtaacgttcggaacgacgggttccggtacgtacgggtacctaatttccgacctacgtacccactatcgaacgtcgtaccgcccttaggcgtacgtcaggtaaccgnttcgggtacggtactacggttttactaccgtgtacccaggtaccaaccgttatttacctcgttttactcgttacctaccggtttacgggcggtaacggtaaccgaagggttcgaacgtacgtaacggtaaacccggatacggtcctacgtacgtaccgtacctaaggttctaacggttcctacttcccg

SEQ ID NO: 66040 - DNA, 785 bp, Homo sapiens
  misc_feature: GYAE6OF02JAX7U.31.78.H01.1.454.CMB.1.raw
  modified_base (493)..(493): a, c, t, g, unknown or other
  misc_feature (493)..(493): n is a, c, g, or t
tcagcagtagacgtcacgaccggtgctcgatttagtgtgagtagtttgggtttggggggaggctacaacaggcaggcaggggcagcaagatggtgttgcagacccaggtcttcatttctctgttgctctggatctctggtcgccgtacggggacagtccgtagatgacgtcctagtttccacgtcctccctggtcctgtcgtctcgtgggcgaggacgggccaccatacaactcgacaacgtccacgccgagtacgttgtttattcgaccccaacaataaccaacttacttagcttacgtaccagacgagaaacgtaggaccacgtccctacctaaacctccgtacgtacgtttaccgtcggtaccttaccggtaccccgggacctacgggttacccggggttaccctaaccggtacgttctaacgttcggacgtacgggtccgggtcggttacggggtaaccttacgttccgtaactccgtaccaaaccgtntaccgacgctacgtccgtcgccgacgtcgtaggaacgtcggtcggtaccggtagtttacgtttacgttacctacggtctaacgtactaacggtaatttacctttacgttttaccggtttccttaccggttaccggtttaccggggtaccgggtaacggaaaccggtttaaacgggtccgggtagttaaaccgtaacccgggtaaacggttaccgttagggtaccccgggtttacaacccggttaaccgtacgttaccggtttaccggtttaccgtttacccttacgtacccg

SEQ ID NO: 66041 - DNA, 587 bp, Homo sapiens
  misc_feature: GYAE6OF02IIWKV.31.78.H01.1.454.CMB.1.raw
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggaccaccatcaactgacaagtccagccagagttgttttattcggccccacaaataacaactacttagcttggtacagcagaaagtaggacagacctcctaaactcctgtatttactgggtccttcgtacccgggcacgtaccggggttcctaaccgtattcattggcagtcgggtctgggacctagttcactctcacatcagcagctcgcagctagaagagtgtcggntagtttacttactcgtacagtacaactattaacttactttctttcgtactacgttttcgggacggtagggaacccgtaagggtacggagtacgtaacgtaaaacgtaaccgttaggtacggtcctaggaccgacctagttcgtacgttccttactaccg

SEQ ID NO: 66042 - DNA, 739 bp, Homo sapiens
  misc_feature: GYAE6OF02I0JT8.31.78.H01.1.454.CMB.1.raw
  modified_base (542)..(542): a, c, t, g, unknown or other
  misc_feature (542)..(542): n is a, c, g, or t
  modified_base (701)..(701): a, c, t, g, unknown or other
  misc_feature (701)..(701): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggattctcgtggtcgcctaacggggactattcggtgatgacgccgagtttccgagacctcctggctgtgtctcgtggacgagcggccacatacaactgacaagtccagaccagtacggttgtttttaactccggacccctaaacctaattaaaacctaaccgttaactttacgacgtttaccggaaccgtacgaccgaaaggtaaaaggtacgggaaccacgtaacccttaacccttaaaacctccgttaggttaacgtttaccggtcgggtacctttacccgtaccccgggtcgaaccggtttcccggggtttaaccctaacgttacttacgtacggtttggaccgtaagggtcggttcgtacgggacgttacttcgaacgtcctaccgacctaagtccgagtacaccgtccgngtaacgacggtgtaaagagtacgtgtcggtacttagtttaacgttctaggttcaaacggtactaaacgtaactttacgtttacgttttctttaccgtactttaccggttgggtaaccggtagggtaacagggtacgagtaactaacgaacgttaaccgngttacgcgtcaactcctacgttatcgttactcgtaccg

SEQ ID NO: 66043 - DNA, 758 bp, Homo sapiens
  misc_feature: GYAE6OF02HSYOC.31.78.H01.1.454.CMB.1.raw
tcagcagtagacgtcacgaccggtgctcgatttagtgtgagtagttgggtttgggggagctacaacaggcaggcaggggcagcaaggatgggtgttgcagacccaggtcttcatttctctgttgctctggatctctggtgccgtacggggacagtcgtcgatgagccagtttccagactccctggctgtgtctcgtgggcgagacgggcccaccgatccaactgactaacgtccagtccgaagtagtttgtttttacttcgggccccctaacaaataacctaaaccttacgttacgtacgttacggtaaccaggacgtaaaggaaaaggttaacggacgaacggacccttaacccgtaaaaccttccctagttaactttaccgttgggtccttccggtaacccgggtctaacggttaccccggggtttaccttaaacccggtatttaccagttcggaccgtacgggtcggggttactcgggggtaacctacgttttacacttcgtacctacctactcgacgtctacgccgtacgacggacggtacgtaacggtacgtagtaggtcggtacgtagtttaacgttctagtccgtaacgactaaactacgtttaacttaccttttacgtttccgtaccgttacgtttaccgggaccgggtagggaaccgttaacgggtacggtacggtaccgtaacgaaaccggttcgtcgggtacgtaccgttcggaccctagtaccgttccgttataccgtttactccg

SEQ ID NO: 66044 - DNA, 735 bp, Homo sapiens
  misc_feature: GYAE6OF02GG60B.31.78.H01.1.454.CMB.1.raw
  modified_base (243)..(243): a, c, t, g, unknown or other
  misc_feature (243)..(243): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatggagcctagtttccagacctccctgggctgtcgtctcgtgggcgaggacggcccacgatcaacgtgaccaacgtccaagccaagngtttagttttacttccggacccccaacgaaataaacctaacttacgttaacgtcgttacggtaacctagaccgaaagtaaaggttaacggaacacggtccctaaacccgttaaacctccgttacgtaacttttaccggtagggtccttaccggtaccccgggtctacggttacccggggttacctaaccggtatttccgagttcggacgtacgtcgggtcgtacgggtaccgtagttccacgtcgtaccaacctactacgagcgtaccgtactcggacgtcgacgttagacgtgtaggtcggactttaagttacttacgtctacgacgtactaacgttaccttattaccgttccgtttaaccgttcgttaacggttccgggagtacgggaaacggtacggtacgtacgtaacgtaaccgtaaaccggtaacgtgggttaccgacgtaccggtaccgaacttaacgttcgttaccgtttacctcgtttacccg

SEQ ID NO: 66045 - DNA, 752 bp, Homo sapiens
  misc_feature: GYAE6OF02IEB28.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggcttgtgtctcgtgggcgagagggcccacatcaacgtgacaacgtccaagccaagtagttgttttacgttcggcccccaacgtaaataacaaacttacttaagtcgttacggtaccagacgaagtaaaagtaggaacacgtacctaccctaaaacctccttacgtaactttacgtggtaccttacgtacccgggtctacggttcccgggttaacctaaccggtacttactagttacggccgtaggtccgggtacgtacgggtacccgttactttccgtaacctcctactaaccctagtaccgtaagccgtaacgtcccgtacggaccgtagggtacctaggaaacgtggtacgggttacggtaacgtttaagttttaaacgttacgttacgtaccgtaacgaactaaaccgttatttaacgtttaccgtttctttaccgttaccgttaccggtttaccggggaacgggtaacgggtaaccgtaagggttacggaagtaacgttaaccgaaacgtaacgtcggtacgtccgttacgaccgtacctattccggtattccgtattacccg

SEQ ID NO: 66046 - DNA, 595 bp, Homo sapiens
  misc_feature: GYAE6OF02IFHE6.31.78.H01.1.454.CMB.1.raw
  modified_base (546)..(546): a, c, t, g, unknown or other
  misc_feature (546)..(546): n is a, c, g, or t
  modified_base (588)..(588): a, c, t, g, unknown or other
  misc_feature (588)..(588): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacggccacatcaactgacaagtccagccagtacgttgttttacttcggaccccacaaataacaactacgttagcttggtaaccagacagaaagtagacagcctacctaaactctagtattacgtgggtccttccgacccggctacgtccggggttacctaaccgattcagttcggacgaggtcgggtcgtagggacccttattccaactctaccacactcacgcacgtcctagcaggtctaggaaatagtggtagtactaagttttaactacgtgtaccagtaccaaacttattaacttactttcgttccgttactacgtttcgggacggacgggtaacagggtganacgtacgaaactcgtgtgcctagcacgtagttcctgtacctntaacccg

SEQ ID NO: 66047 - DNA, 884 bp, Homo sapiens
  misc_feature: GYAE6OF02JU23V.31.78.H01.1.454.CMB.1.raw
tcagcagtagacgtcacgaccggtgctcgatttagtgtgagtagtttgggtttgggggagctacgaacaggcaggcaggggcagcaagatggtgttgcagacccaggtcttcattctctgttgctctggatctctggtgccgtacgggacagtccgtgactgagcctagtttccaagcctccctggctgtgtctcgtcgggcgagaggccctacagaccgaactgacctaacggtcccaaggccaaggtagtttacggtttttacgttccgggaacccccctaacgtaaacttaaccgtaaaccgttaacgttacggtaccgttttacgggaacccacggttaccgaaaacggtaaacggttaacggaacctaaccgtaccccgtaaccccgtaaacgttcccgtttcggtaaccttttaaccggcgggttaccctttacccgggtacccccggggtatacccgggttaccccggggtttaacccctaaaaccggtcgttacctaacggttcggtacccgtaacgggttcccggggttaccgtacgggggtaaaccccttcttttacccgggtaccttacccgttacccgtaaaccccggtattacccgaacgggtcccgtaacggtcccgttaccggaccggtaacgggtacccggttaaacggtaacggtaccggttaggttacccgggtaacttaaccggtttacgttaaccgtgtaccgtacgtaactaccttaacgttattaacccgtttcgtttaccgtacgttaccggttacggtcggtaacggtaaccgtagggtacgtacgtacgtaacgtaaacggtaccgttaggtccgtacgtacgtacctacgtacgttcgtaacggttctacgttacccg

SEQ ID NO: 66048 - DNA, 906 bp, Homo sapiens
  misc_feature: GYAE6OF02I7TB4.31.78.H01.1.454.CMB.1.raw
  modified_base (118)..(118): a, c, t, g, unknown or other
  misc_feature (118)..(118): n is a, c, g, or t
  modified_base (124)..(124): a, c, t, g, unknown or other
  misc_feature (124)..(124): n is a, c, g, or t
  modified_base (169)..(169): a, c, t, g, unknown or other
  misc_feature (169)..(169): n is a, c, g, or t
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
tcagcagtagacgtcacgaccggtgctcgatttagtgtgagtagtttgggtttgggggagctacaacaggcaggcaggggcagcaagatggtgttgcagacccgtgtcttctattctnttgtcnctcgtagtcttctcgtggtccgtaccggtacgggactgttcggtntagtggaccgtaccgttacgtttaccaacgtacccttccggtcggtctgttctcgttcgggnggacggacggccggaccctaacctactaacctacgcgaccgtacgtaccgaccgaacggtagttacggttttntttttaaccggttcccgaaccccaaaccttaaactaaacccgttaactttacgttaccgttcgttaaccggaccgaagtaacgtaaacggtaaagggtaccacgtacctacccgttaaacctaaccttcgttaacggtttaactttaccgggtcggtttaaccgttaccccgggaccggttaaccgtttacccgggggtttacccccgggtttaaaccttaaccgggtctttaacccggaggttacccggggtaacctccgggggttacccgggttacggttaccgggtaaccctttacgttacccgtccttaaccggtacccaaaggtcctaacgccggttacaccgtccgtacgacggtacgtacgtacggtaatcggtaggtacgttacgtttaagttaacttcggtactaacggtctaaacttaacgtttaacgttacctttaccgttttacgttaccttccggtttaacgggttcgggaaccggtaacggtaaacggttagggtagtacgttaaacgtaaaccggtaagtacggttacgtaccggtacctacggtaaccttaccgttacttaccggtttactaccgtttacgtcccg

SEQ ID NO: 66049 - DNA, 743 bp, Homo sapiens
  misc_feature: GYAE6OF02G71QY.31.78.H01.1.454.CMB.1.raw
  modified_base (233)..(233): a, c, t, g, unknown or other
  misc_feature (233)..(233): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagacgggccacctatcaactgccaagtccagccagngttgttttacttcggccccacaataaccaactacttagcttggtaccagcaagaaagtagacagccctacctaaactcctagtactttacgtgggtccttccgtaccccgggctacggttcccgggggttaccctaaccggtattccgagtttcgggacgtacgggtcgggttacgacgggtaccgttacgttttaccaccttcctaccacctactaccgacgcgacgtcccgtagacgtacggtcggtaacgaagtcggttaggtacggtacgtttaacgtttacgtttacggtacgttacaccgtaaccttaaacgtactttaaaccgtttaccttttccgtttaccgttacccgttaacgggtttacccgggaacgggttaaacccgggaacgtaacggggttaacgggacgtaaccgtaaaccggttaaaccggtacggtttcgggtaccggtaccgtaccgtaacccgaccggttaactcccgtttcttacccgttattaccccg

SEQ ID NO: 66050 - DNA, 596 bp, Homo sapiens
  misc_feature: GYAE6OF02F5Q8O.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaaataacaactacttagcttggtaccagacagaaagtagacacgcctacctaactcctagtatttacgtgggtccttaccgtacccgggtctaacgttcccggggttacctaaccggtacttcgtagttcggcctagggtccgggtacgtggggacccttacttttcaaccttctacacctatcagcacgcctgcgaggctgaatagtggtgtacttagtttaatacgtcgtacacgactaaactattactactttctttccgtctacgtttccggaggtacggaacgtaaggtgagactacgaaacggtactgtagctcgacaccgtatcgtacgttcttactcg

SEQ ID NO: 66051 - DNA, 808 bp, Homo sapiens
  misc_feature: GYAE6OF02IO6TP.31.78.H01.1.454.CMB.1.raw
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgccgtacggggacatcgtgatgagcctagtttccagacctccctggctgtgtctcgtgggcgaggacgggccaccataccaactcgactaacgtccacgccagtagttgttttacgttcggacccccaactaaactaaacctaaaccttacgttacgtacgtttacggtaaccaagtaccgaaaggtaaaaggtacggaaccaaccggtacccttacctaaaaccttccgttagttacttttaaccggtcgggtaccttccggtaacccgggtccgtaacgggttccccggggtttaaccctaacccggtactttaccgtaggttcggaccgtaacggggtccggggttaccggtacggggtaacccgttactttaccgtaccgttccctaccgacctacgtacgacgtcgaaccgtcccgtagaccgacgggtctaaggtaacgtagttcggtaggtacgttagtttactttacgtcgtacctagtaactaaacttacgtttactttacccgtttacgtttccgtaaccgttaccgggttaccgggtacggggtaacgtaccggggtaaaggtacggtactaacgtaacggtaaaaccgtacggttcggtaacggtcggtacgtacctaccggttacgttccgttacggtttccgttacttaccccgg

SEQ ID NO: 66052 - DNA, 680 bp, Homo sapiens
  misc_feature: GYAE6OF02IU2TM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagtagttgttttattcggcccccacaataacaactacttagcttggtaccagacaagaaagtagggacacgaccctacctaaaacctccttagtacttttacgtcgggtacctttccgtaccccggggctacggttcccgggggttaccctaaaccggatttccaagtttcggctaggtccggggtactcggggacccgtactttccgaacttctaccacctatccagtcacgcctcgcgtacggcgtagaagagttcggtggtacttaggttttaattaccgtgttaccaacgtacaactaatttacttacttttccgtttaccgttacgtttaccggttccgggtacggtaacgggaccgtaaggggtacggagtaactaccggaaaacgtaccgttagggtccgtacgtccggactacccgtacgttcgttacttccttaccgtacccg

SEQ ID NO: 66053 - DNA, 719 bp, Homo sapiens
  misc_feature: GYAE6OF02F81HE.31.78.H01.1.454.CMB.1.raw
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagccagtttccagtacctccctggctgtgtctcgtgggcgagacgggccacatcaactgcaagtccagccagtagttgttttacttcggaccccaacaataacaactacttagcttaggtaccagacaagaaagtagacacgcctactaactctagtattacgnggtaccttcgtacccggnacgttccgggttacctaacgtattacgtagttcggactacgggtccgggtcgttcgggaacccgttatttccgaaccttccgtacccaacctattaccgagtccgtacgtccgtacggcgtaacggctaggaaagtacgttggtacggtacgttaagttttacgttaacgttcgtactacgtaactaagtactttaacgttaccttttccgtttacgttaccttaccggtttaccgggaccgggtaacgggtaaacccgtaaggggttacgtaacggttaacgtaaccggtaaaaccgttaaccggttagggttacggaccgttaccggaccctacccggttaacgttctacccggtttaccttaccgttaacccg

SEQ ID NO: 66054 - DNA, 813 bp, Homo sapiens
  misc_feature: GYAE6OF02JM0LD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaagtccagccagagttgttttattcggcccccaacaataacaactactagcttggtaccagcaagaaagtacggacagccctacctaaactcctagtatttaccgtggtcttaccgtacccgggtactacggttcccggggttacccttaaccgtacttaccagtttacggcgaacggtcgggttccgtacgggacccgttacgtttccaaccgttcctttacccgaacctacgtaccgtaacggtacccgtaacggtccccgtacggtacccggtaacgggtaccgttacgggtaaaacgggtacgtttcgggttaaccggggttacctttaaacggggttttttaaacctttaacccgttcgggtttaacccggaacgttaaccctaaaacctttagttttaaaccctttacccgtttttcccgttttttaaccgttacccggtttaaccggttttacccggggacgggtaccgggtaaaccggtacgggtaaggtacggtaaccgtaccggtaaaaccggtacggttacggttcgggtacgttaccggaccttaaccgtcgttccgtttcggttaccgttaccttaaccccgg

SEQ ID NO: 66055 - DNA, 805 bp, Homo sapiens
  misc_feature: GYAE6OF02JGO5V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtcgtctcgtgggcgagacgggccaccagtccaactcgacaagtccagccagacgttgttttagttcggaccccctaaccgaaattaaccaaaccttacgttaagtccgtttaggtaacccgagacctaaggtaaaacgtaacgggaactacgtacccttaaccctaaaacctccgtacgtacttttaccgtacgggtcctttacccggtaccccgggtctaaccggtttccccgggggttaacccttaaaccccggtagtttaccgtagtttaccggaccgtaacgggtccggggttaccgtacggggtaacccgtagttttacccgtaacgtccttaccgaacccgtaactccgaacgtccgtacgtacccgtaggaccgtacgggtacctggtaaacggtattacgggtacggtactttaaggttttacgttacgtcgttaaccacggtactaaacgtaagtttacttaccgtttacgttttaccgtaccgttacggtttaccgggtagggtaaccggtaaccgtaagggtttaccgggagtaactaaccgtaaaccggtaaacgtggtaccggtcgtaacgacgttaacctagttacgtacctttcgtacgttaaccg

SEQ ID NO: 66056 - DNA, 954 bp, Homo sapiens
  misc_feature: GYAE6OF02HI8WG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggactatcgtgatgagcctagtttccagacctcccgtgctgtcgtctcgtgggcgaggacggccaccatacaactgactaacgtccagacctaaggtacgtttagtttttacgttaccggaccccctaaacgtaaaacttaaacctaaaccttaaccgttaacgtcgttaaccgggtaaccacggtaccgaaaaggtaaaacggtacggaacccgtaacgaccccgtttaaaccctaaaaccgttcccgttaggtttaaccgttttacccggcggggttaccctttacccgggtaaccccgggtacgttaccgggtttaccccggggttaaccctaaccgtacgttttccaaggtttaccggacgtacgggtccgggttacggttaccggggtacccttacgtttacccgtaccgttccttaacccgtaccgtaacccgtaccgtaaccggtaccggtaaccggtccccgttacggacccggtaacgggtaacccggttaaggtaaaaccggtaacgggttggttaaccggttacgtttaaaggttttaacccgttaaccgttaccggttaaccgaaaccgttaaccttaaaaccgtttaacgtttaacctttaacccgtttttacccggtttaacccgtttacccggtttaaccgggttttaccccggggaaccggggttaaaccggtaaacccggttaggggtaacggtacgttaacgtaaaccggttaaacgtaacgttagggtaccggtacgtaccgtaaccgtaccgtaccgtttaccgtcgttacccttccgttaaccccg

SEQ ID NO: 66057 - DNA, 627 bp, Homo sapiens
  misc_feature: GYAE6OF02IE4O6.31.78.H01.1.454.CMB.1.raw
  modified_base (509)..(509): a, c, t, g, unknown or other
  misc_feature (509)..(509): n is a, c, g, or t
  modified_base (607)..(607): a, c, t, g, unknown or other
  misc_feature (607)..(607): n is a, c, g, or t
  modified_base (621)..(621): a, c, t, g, unknown or other
  misc_feature (621)..(621): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgaccaagtccagaccagtagttgttttacttcggaccccaactaataacaacttacttagcttggaaccagacaagaaagtaggaacacgcctaccctaaaacttccgtagtaatttaccgtgggtaccttccgtacccgggctacgttcccggggttacctaaccgtcttcagtttgcgagcgggtactcgggacgtatttccactctaccacacgtacacgcaacgcctcgcaaggtcctagaaagtgtcggtaggtctaacgttttatacgttgcaacggtactaaatnttacttaccttctttacgttctacgttttccggacgggaacggtaccagggtcggataaccctagaaaccgtatcgggtagtcctagcctaaccggtntacgttcgtacctntacccg

SEQ ID NO: 66058 - DNA, 810 bp, Homo sapiens
  misc_feature: GYAE6OF02F1GLU.31.78.H01.1.454.CMB.1.raw
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
tcagcagtagacgtcacgaccggtgctcgatttagtgtgagtagtttgggtttgggggagctacgaacaggcaggcagggcagcaagatggtgttgcagacccaggtcttcatttctctgttgctcgtgatctcgtggtgccgtacgggacatccgtgagtgagccagttttccagacctccctggtctggtgtcgtcgtgggccgagacgggccacatccgaactgcaaggtccagccagngttgttttattcggccccaacgtaanaacctactacttaggcttggtaccagcaaagaacgtacggacacgccttaacctaaactcccgtagtagttttaaccgtcggctttacccggtacccgggtagaccggtttaccccgggggttaccttaaacccggtacgttacgtacgtttcgggaccgaacgggtccgggtcgtaccggggtaacccgttaacggtttccaaccgtacctttaccgaacccggttactaccgaacgtaccgtaccgtacccgtaggccgaccggtacgttacggaacgttacgttcgggacggtacgttaacggtttacttaccgtaggtaccttaacgaccttaaacggtactttaacttacccggttaccgtttttacggacccgttttaacgggtttaccggtaccccgggtaaaggttacccgggaacgggttacggaccggggttaaactaccgggtaaaaacgttcccgggtaaggtcccggtaacgttacggaacccgttaaccgttaccgtacggtttaccggttacccttggttaaccccg

SEQ ID NO: 66059 - DNA, 849 bp, Homo sapiens
  misc_feature: GYAE6OF02GTGWD.31.78.H01.1.454.CMB.1.raw
  modified_base (365)..(365): a, c, t, g, unknown or other
  misc_feature (365)..(365): n is a, c, g, or t
tcagcagtagacgtcacgaccggtgctcgatttagtgtgagtagtttgggtttgggggagggctacaacaggcaggcaggggcagcaagatggtgttgcagacccaggtcttcatttctctgttgctctggatctcgtggtgccgtacggggacactcgtgatcgagccagtttccagacctccctggcctgtcgtctctgggcgagagggccaccatcaactgacaagtccagccagacgttgttttagttcggaccccctaacgtaattaaccgaaccttaccttaggccttacgggtaaccacgtacaaggtaaaacgtacggaaccacgtaccgtacctaaaactcctgtaacttttacgngggtaccttccgtacccggggctaaccggttcccggggttacctaaccggtattccgtaacgtttcgggacctacgggtccggggttaccttcgggggaacccgtacttttacccgaaccgttcccttacccgacccgtaaacgttcccgaacggtcccgtaacgccccgtttggacccggtaagggtaccgttagggtaaacggtacgttagggttacgggtaacctttaagggtttttaaacttaccggttacggttacctaaccggtacctaaacggttaacttttaccgtttaaacccgtttccgttttaccgtaaccttaccggttttaccgggggacgggtaaccgggttaaaccggtaaagggggtacgggtaacgtaaccggttaaccgtaaaacgggttaaccttcggggtacggtaccgtcggtaacccggaacctacggtttacccgtacgggtttccccttagttaaccccg

SEQ ID NO: 66060 - DNA, 663 bp, Homo sapiens
  misc_feature: GYAE6OF02JN7SP.31.78.H01.1.454.CMB.1.raw
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctctgggcgagagggccaccatcaatgcaagtccagccagagttgttttattcggccccaacaactaacaactacttagcttggtacagcaagaaagaggacacgtacctactaaacctcctagtactttaccgtggtccttccgtacccgggntacgtcccggggttacctaaccgtnttctacgttcgacgaggtccggtcgtacgggacctattcgactcgtccacctactccgacgtcgtaccgtcctagacgtcggtactaaggtaagtacgttggcggtacgttacgtttacttaacgtcgtacgtacgtaccaacgtttactacgttttaccttccgtttaccgttaaccgttaccggtttaccgggaccgggtaaccggtaaccgtaacggttgaacgtacgtacgaaacggttacgtgggtaacgcccgttagcctaacgttaccgtcgttattacgtcttacccg

SEQ ID NO: 66061 - DNA, 638 bp, Homo sapiens
  misc_feature: GYAE6OF02IQB39.31.78.H01.1.454.CMB.1.raw
  modified_base (236)..(236): a, c, t, g, unknown or other
  misc_feature (236)..(236): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagacggccaccatcaactgacaagtccagccagagttnttttattcggaccccaccaataacaactacttagcttaggtaccagacaagaaagtaggacacgaccctacctaaactcctgtaactttcgtcggtcttccgtacccgggctacggttcccgggttacctaacgtattctagttcggcacggtccgggttcgtacgggtaccgtactttcactcctacacctatacacgctacgccctgacgaggctaggacgtagttggtggtactaggttttaacgttacgtcgttacacgtactaacgtactttaatttcctttctttaccgtacctaccggttttcgggaccgggtaacggaccgtaagggtacgagtaagtaccgaaacgtacgttggcgtacgtacgccaacttgtccttaggttccttactcccg

SEQ ID NO: 66062 - DNA, 596 bp, Homo sapiens
  misc_feature: GYAE6OF02GN66F.31.78.H01.1.454.CMB.1.raw
  modified_base (470)..(470): a, c, t, g, unknown or other
  misc_feature (470)..(470): n is a, c, g, or t
  modified_base (481)..(481): a, c, t, g, unknown or other
  misc_feature (481)..(481): n is a, c, g, or t
  modified_base (534)..(534): a, c, t, g, unknown or other
  misc_feature (534)..(534): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagctccctggctgtgtctcgtgggcgaggacgggccaccatcaactgcaacgtccagccagtagttgtttttattcggccccaccaataaccaactacttagcttggtaccagcaagaaagtaggacagaccctcctaaactcctgtatttacgtcgggtctttccgtacccgggctacgttcccggggttacctaaccgtattcagtttggctacggcgggtcgtcgggaccgtatttcacttctacacctatcagcagtcctgcgagcgtagagtagtggtagcttagtttatacgtntcagactaatntttattacctttctttcgtcctacgtttcgggcggtaacggaccgttaagggnggtagactacgaaacgtacgtcggacgtcgtacgactaccgtattcgtcgttccttactccg

SEQ ID NO: 66063 - DNA, 747 bp, Homo sapiens
  misc_feature: GYAE6OF02ILGP5.31.78.H01.1.454.CMB.1.raw
tcagcagtagacgtcacgaccggtgctcgatttagtgtgagtagtttgggtttgggggagctacaacaggcaggcaggggcagcaagactggtgttgcagacccaggtcttcatttctctgttgctctgatctctggtgcctacggggacagtccgtgatgagcctagtttccagactccctggtctgtgtctcgtggacgagagggccaaccatccaatcgcaacgtccaagccgagtagttgttttattccggaccccaaccgaattaaccaacttacgttacgcgtttacggtaaccagtacgagtaaagtaggaccagtaccctacctaaactcctaagtactttaacgtcgggtacctttccggaacccgggtctaaccggttacccggggttacctaaccgtacgttttaccgaggtttacggacggtacggtccgggttaccggtacgggtaacccgttacttttaccgtaaccgttccctaccgaacccgtagttacccgaacggtccgtaacggtcccgtttaacggacccgtaacgggtaccgttaacggtaaacgtacgttcggttacggtacgttaacgttttacgtaaccgttgtacgtaaccgtacgtaacttacgttagttacctttctttacgttcttaccggttcgggacggtaacggactagggtacgataccgtaacgaaacggtcgtcgtacgtctacgactccgtatccgttacgttctctaaccg

SEQ ID NO: 66064 - DNA, 636 bp, Homo sapiens
  misc_feature: GYAE6OF02GV3Q1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagaggccaccatcaactgcaagtccagccagagttgttttattcggccccaacaataacaactacttagcttaggaccagcaagaagtaggacagcctacctaactcctagtacttacgtgggtcttaccgtacccgggctacgtcccggggttacctaaccgattcagttcggctagggtccgggtcgtacgggtacctactttccacctctccacctataccacgcacgccctggccgacggctagaagtagtggtcggtacttaagtttactacgtgtactagactaagtatttacttaccttttcgtttaccgtacgtttacgttacggggtacgggaacgggtaaccgtaggggtagacgtaacgtaccgaaacggtacgtagggtccggtactaccggactaccgtagttccgtcgtttacctcgttacccg

SEQ ID NO: 66065 - DNA, 769 bp, Homo sapiens
  misc_feature: GYAE6OF02J13RQ.31.78.H01.1.454.CMB.1.raw
tcagcagtagacgtcacgaccggtgctcgatttagtgtgagtagtttgggtttgggggagctacaacaggcaggcagggcagcaagatggtgttgcagacccaggtcttcatttctctgttgctcgtggatctcgtggtcgccgtacgggacatcgtgagtgagcctagtttccagcctcccgtgcgtgtgtctcgtggcgaggacggccacatacgactgacacgtccacgccgagtagtttagttttacgtccgacccctaataaacgtaaactaaccttacgttcgtaccgttggtaacccagaccgtaaggtaaaaggacgtaccgaccgtaccctaaccgtaacctaccggttagttaccttacggtcggttaccgttaccggtaccggtcgtacggtccccgggttaacctaacggtcttacgttaggtccgacggtacgggtcgggtccgttaacggtcgtacgttcctaccgtaccgtcaaacccgtatacctacgccgtaccgtacgtcgtacgacggtacgtacggtagtacgtcggtacggtacgttacgtttaacgttacgttacgtacgtacgtaactaaccgttaacgttacgtttacgtttaccgttacgttaccgttaccggttccgggtacgggtaaccggtaacggtaacgggtacggtacgtaacgtaacggtcggtaaaaaaaaaacggtcggtacgtaccgtacgtacccgtacgttacgttacgttacgttaccttacgttaacccg

SEQ ID NO: 66066 - DNA, 677 bp, Homo sapiens
  misc_feature: GYAE6OF02FZ0FG.31.78.H01.1.454.CMB.1.raw
  modified_base (322)..(322): a, c, t, g, unknown or other
  misc_feature (322)..(322): n is a, c, g, or t
  modified_base (341)..(341): a, c, t, g, unknown or other
  misc_feature (341)..(341): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacagtcgtgatgagccagtttccagacctccctggctgtgtctctgggcgagagggccacatcaactgcaagtccagccagagtgttttattcggcccctacaataacaactacttagcttggtaccagcaagaaagtaggacaggccctacctaaacgtcctagtatttacnggggctttcgtacccgggntacgttccggggttcctaaaccggtnttcgtaattcgggacacggtcggggttcctaggggtacccgtagttttccacttccgtaccgaaccattccaacggtccaacggccctcgccgtaacggcgttacgtaaacggtgttacgtcgggactaaggttttaacgtccgtttggtactaacggacttaaacgtactttacgttaacttttccgtttaccgtttacgtaccgttttaccgggaccggtaagggtaacctaacgggtggtacgtagtaccgtaaacggacgttcgtggtaccaggtccacgttaacgtcgtacgttccgtataaccg

SEQ ID NO: 66067 - DNA, 727 bp, Homo sapiens
  misc_feature: GYAE6OF02FWIGG.31.78.H01.1.454.CMB.1.raw
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
  modified_base (478)..(478): a, c, t, g, unknown or other
  misc_feature (478)..(478): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcggtgatgagcctagtttccagacctccctggctgtcgtctcgtgggcgagacgggcccaccatacaactgaccaagtccaacggccaaggtagttcgttttttaagttccgggaccccctaacctaaataaaccaacttaccttagtcttacggtaccagaccaaggaaagtaggacacgccctacctaaacctcctagatttacgnggccttacgaccccggntaccgttccgggttacctaacgtnttcgacgttggactaggtccgggtctcgggacccgttatttcccgactcctacgacctagtcagaccgtacgccncggacgacggtcgtacgaaatcggtggttacggacgtttaagtttaactcgttacgtactacggaaccttaacctaacttttacgttaccttttaccgtttcccgtaactttaccggggtttccgggacgggtaccgggtaacgtaacgggggtcgtacaacggttaaccgtaaacggttacccttaggggtcggttaaccacggtacctaaccttcgttcccgttacctttactaccgttaacccccg

SEQ ID NO: 66068 - DNA, 767 bp, Homo sapiens
  misc_feature: GYAE6OF02GJWK5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctctgggcgagacgggccaccatcaactgacaagtccagccagagttgttttattcggccccacaataacaactactagcttggtaccagcaagaagtaggacagcctacctaactctagtatttaacgtcgggtccttcgtaccccgggctacggttacccggggtttacctaaacccggtattacgtagtttacggcctagggtccggggttcgttacggggacccgttaattttccgaaccgttcccttaccgaaccctacgttaccgaacggccgtaacggtcccctaggtacccgacgggtacttagggaaaacggtagttacgggttacgggtacctttaaggttttttaacgttaaccttacggttaccaaagggtaaccctaaacgttaaatttttaacgttaacctttttccgtttaccgttaccgtttaaccgttttaccggggacgggttaaacgggaaccgtaaaggggttacggaacgtaacgtaaccgaaaaccggttaacgttgggtacggtacccgtagtaccaaccgttaacgttcgtttacggtttccttaccgttaaccg

SEQ ID NO: 66069 - DNA, 676 bp, Homo sapiens
  misc_feature: GYAE6OF02H97VL.31.78.H01.1.454.CMB.1.raw
  modified_base (669)..(669): a, c, t, g, unknown or other
  misc_feature (669)..(669): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatagagcctagtttccagacctccctggctgtgtctcgtgggcgagagggccacatcaactgcaagtccagccagtagtgttttacttcggccccaacaataacaactacttacgtcttggtaccagcgaagaagtaggacagtcctacctaaactccttagtactttacgtagggtccttaccgtacccgggacgtacgtcccggggtttacctaacccgtagttccgtagttcggccgtaggccggggtctacggggtaccctagtttccaccgttctacaccacgtcacgcacgccgtgcgacggctagaacgtagtggtcggtacttaagttttaacgtacgtcgttaccgagtaacctaacgttaactttacgttaccttttcgtttaccgttacttaccggttttaccgggacgggttacgggaaaccggtagggtaggtaacgtaacgtaaccgtaaacgtacggtgtacggactcggaccctaacgtacttcctggtttcccttntaacccg

SEQ ID NO: 66070 - DNA, 890 bp, Homo sapiens
  misc_feature: GYAE6OF02F40AH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgacaagtccagccaaggtacgttagtttttacttccggaccccctaaacctaaacttaaaccgtaaaccttaaccgtttaaggaccgttttagggtaaccccaaggtaccaaaggtaaaaaggttaacggaacctaacggtaccccttaaacccttaaaaccgttcccttaggttaaccttttaaccggtcggggtaccttttacccggtaacccccggggtacctaaccgggtttccccgggggtttaaccccttaaaccgggtatttaccgaagtttcggaccgtacggggtacccgggttcgtacggggtaacccgttagttttaccaacgttccgttacctaaccgtaagtacccgtaagtacccacgcccttaggaaccggtagtacccggttaaggaaagtacggttacggtcggaaccttttaaaggttttaactacggtttacgacgtaaacgctaaaacgttattttaaccgttaccttttacgttttacctaacccgtttacggtttaccggggtaccgggtaaacgggttaacggtaaacggttcggggtaactaaccgtaaaccggttaaaaccggtaacgttacgggttacggggttaactacccggtaaccctaaccggttaaccgttcctttacgtttacccgttaccttaaacccg

SEQ ID NO: 66071 - DNA, 763 bp, Homo sapiens
  misc_feature: GYAE6OF02GXYZ9.31.78.H01.1.454.CMB.1.raw
tcagcagtagacgtcacgaccggtgctcgatttagtgtgagtagtttgggtttgggggatctacaacaggcaggcaggggcagcaagatggtgttgcagacccaggtcttcatttctctgttgctctgatctctggtgccgtacggggacatcgtgatgagcctagtttccagacctccctggctgttgtctcgtgggcgagacggccaccgatacaactgcaacgtccgagccaagtacgtttgtttttaagttccggacccccaactaaactaaacctaaaccttacttagccttaggtaaccagacaaagaaaggtacggaccacgtacccttacctaaactcctagtactttacgtcggtccttccgaccgggctacggttcccgggttacctaaccggtatttcgacgttcggactacgggtccgggtcgtacgggtaccgttaatttccaccgttcctaccgaacctcgtaccacgtaccgacgtcccgtagccggaaggtccgaaggtaacggtagtcgggtacgttacgtttaacgttttacgttaaccgttgttaccgaagtacctaatttaacctttagtttaccgttttccgttttaccgtaccggtttaccggttcggggtaccgggtaacgggtaaaccgggtaggttacgtaggtaaccgttaaccgaaacggttaaccggttcggtacggttcccttaacgggtaccctaacccggtttacgtccgttactttcccgtaacttccccg

SEQ ID NO: 66072 - DNA, 728 bp, Homo sapiens
  misc_feature: GYAE6OF02I6NXU.31.78.H01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactcccgtggctgtgtctcgtgggcgagngggccaccntacaactgacaagtcagccagtagttgttttattcggccccacaatacaactactagcttgtaccagcagaagtaggacagaccctactaacctctacgtactttacgtcggtacttaccgtacccgggctacggttcccggggttacctaaccggtnttaccgtgttacggacacgggtccgggtcgtacggggtaccctagtttaccacttccgtaccaaccgtatcgaacgtacgaccgtacccgtacggcggtacgggtccgtaaggaacgtacgttggtacggtaccgttagttttaaacttccgttcgtaccgtacgtaaccctaaattactttaacgttaccttttccgtttacctaccggtttaccgttttacggggaccgggtaaacggtaaccggttaggggtacggtacgttaacgtaaccggtaaacggtaacgttacggggttacgaccgtttccggaaccgacccgttaagttcccgttttacggtacctttccgtacccgg

SEQ ID NO: 66073 - DNA, 697 bp, Homo sapiens
  misc_feature: GYAE6OF02HRVSV.31.78.H01.1.454.CMB.1.raw
  modified_base (530)..(530): a, c, t, g, unknown or other
  misc_feature (530)..(530): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttcccagacctcccgtggctgtgtctcgtgggcgagagggcccacactcaactgacaacgtccagccaagtagttagtttttacgttcggacccccaactaaataacctaacttaaccttagtcttcggtaaccagacaagaaaacgtaggacacgcccttacctaaacctccttagtatttacgtggtccttaccgacccgggctacggttcccgggtacctaaccgtattacagttcggacagggtccggtcgttcgggaccttagttttccaacgttccctaccaccgacttaccgagtccacgtccctaggaccgaaggtcgtagaaagtagtggtacggcttaaggtttacttacgngtacacgactaaacttatttaacttacctttcgtttacctacgttaccgtttaccgggacgggtaacggtaccgtaagggtaggtacgtacgtaaccgaaacgtaccggttaggtaccggtcgttaccgacctaccgtacgttcgttaacgttccttacgtaacccg

SEQ ID NO: 66074 - DNA, 694 bp, Homo sapiens
  misc_feature: GYAE6OF02IWYY3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggacgggcccacctatcaactgcaagtccagccagagttgttttattcggccccaacaataacactacttagcttggaccagcaagaaagtagacacgtccttacctaaactcctgtaactttacgtgggtcctttccggacccgggctaccggttcccggggtttaccctaaaccgtcttctagttcggacgtacggtcgggttcgtcggggaaccgtatttccgacttcctaccacctatccacgccacgtccctcggacgacggtcgtaaggaacgtagttcggtagtaccttaaggttttaactcgttacgtcgaacgtacctaaacttacttttaacttacctttcgtttaccttcgttaccggtttaccgggtaccgggtaacggtaaccgtaaggggttaccggagttaacgaaccgtaaacggtaacgttcgggtacgtacgtaaccgtaccgaccgttaacgtcgtttccgttacttaccgttacccg

SEQ ID NO: 66075 - DNA, 737 bp, Homo sapiens
  misc_feature: GYAE6OF02HKPWB.31.78.H01.1.454.CMB.1.raw
  modified_base (237)..(237): a, c, t, g, unknown or other
  misc_feature (237)..(237): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaagtccagccagtgttnttttattcggccccaacaataacaactacttagcttggaccagcaagaaagtgacngcctacaaactcctagtactttacgnggtcttccgacccgggctacgtcccgggttacctaaccgtattactagttcggcgtaggccggttcgtacggggaccttagtttccgaacttcgtaccacctatcaacgtcgacgtccgtcgaccgtaacggtacgttaacggaaagtaacggttggtaaccggtacgtttaacggttttaacgtttaccgtacggttacctaggtaacctaaaccttacgttttaaacgtttaccttttaccgtttttaccgttaacccgttaaccggttttaccgggtaaccgggtaaacgggttaacccggtaaagggttcggtaacggtaacgttaaccgtaaaaccggttccgttacgggttaccggtcgttaccggtacccgtaccgtaccgttccgttacgtttaccgttaccttacccgg

SEQ ID NO: 66076 - DNA, 693 bp, Homo sapiens
  misc_feature: GYAE6OF02G3PJD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagtttccacgactccctggctgtgtctcgtgggcgagacgggccactactcaactgacaacgtccacgccagtacgttgttttacttccggaccccctaaccaaactaaacctaaccttaacgttacgtccttacggtaaccagacaagaaaggtacggacacgaccctaccctaaacgtcctagtactttacgtcggtccttccgtacccgggcgtacgttacccgggttaccctaaccgtcttacgtagttcggacgacgggtcggtacgtacggggtaccttagtttccactcctaccacctactcacgcacgccgtcgcgtacggactagaacgtgtcggtacggtacttagtttaacgtcttcgtacgaacacctaaattactttacgttaccctttcgtttaccgttcttaccgggtttcgggaacgggtaacgggtaaccggaaggtacggagtacgtaacggtaaacgtacgtcggtacgtcgtacacgtacgttccttaggtccgttacctactaccg

SEQ ID NO: 66077 - DNA, 669 bp, Homo sapiens
  misc_feature: GYAE6OF02G8MW2.31.78.H01.1.454.CMB.1.raw
  modified_base (635)..(635): a, c, t, g, unknown or other
  misc_feature (635)..(635): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagtacctccctggctggtcgtctcgtgggcaggacggccaccatcaactgacacgtccagccaagtagttgttttagtccgaccccaacaataacctaacttacttagcttacggtaccagacaaggaaagtagacacgtacctacgtaaacctcgtagtactttgcggtaccttccggacccggctacggtcccgggttacctaccgtattcgtagttcggacgtacggtcgggtaccgtacggggtacccttaacgtttccacgttacctaccgaaccgtacttaccgaacgtaccaccggtccctggaaccgtaacggtcgtaaggtaaacgtaggtcggtacggtacttaaggtttacttcgtacgtacgagtaactaactattacttactttcttacgttactcgttacgcgggtacgacgtaggtacgagtactaacggtaacgtacgtggtaccgngtactacgtactacgttacgtcttcgtcctaccg

SEQ ID NO: 66078 - DNA, 822 bp, Homo sapiens
  misc_feature: GYAE6OF02GTBJ5.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgccgtacggggacagtcgtgatgagcctagttccagacctccctggctgtgtctcgtgggcgaggaggccaccatcaactgcaagtccagccagtagttgttttacttcggaccccctaacaaataaccaacttactagtccttaggtaccagacaagaaaggtacggacacgtccctaacctaaacctccgtagtactttaccgtgggtccttaccgtaaccccgggctacggttccccggggttaccctaaccggtacttcgacgttacggccgtacggtcgggtaccgtcggggtaacccttacgtttccgaaccttccgtacctaaccctagtcccaacgtcgtaccgacctgggaccgtaacggaccgtaaggtaaggtagttcgggtacgggttacttaacggttttacgttacgtttacgtaccgtaacgtaacttaaacgttaactttaaaccgttttacctttaccggttttaccgttaccgtttaaccgggtttaccggggaaaccggggtaaccgggttaaaacgggttaacggggtaaccgggtaacggtaaaccgttaacccgggtaaaaaccggtttaaccggttacggggttaaccggtaccgttaccggtacccggtaaaccgttaccgtttacggtttccggtttaccccgttaacgttacccccg

SEQ ID NO: 66079 - DNA, 791 bp, Homo sapiens
  misc_feature: GYAE6OF02JH6KK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggactatcgtgatggagcctagtttccagcctcccgtggtctgtgtctcgtgggcgaggacgggccaccatacaacgtgacaacgtccacgaccagtagtttgttttacttccggaccccctaactaaacgtaaacctaaccttaacgttacgtaccgtttacggtaaccaacggaccgaaaggtaaaaggtacgggaacaccggtacccctaacccgttaaaacctccgtaggttaactttaccggtcggggtaccctttacccggtaccccgggtactacgggttccccgggttaccctaaccggtacttacgtacggttcggaccgtacgggtccgggttacgtacggggtaacccgttatttacccgacttacctacccgtaaccgtactacggacgtaccgacgtcccctagcggtaacggtacgtaaggtaaggtacgttagggtccggtacgtttaacgttttaacgtttaccgttacggtaccaacgtaacctaaacgttactttaacgtttacctttccgtttaccggtacgttaaccggtttccgggacggtaacggtaaccgtaaggtcggtatacgtaaccgtaacgtacgtggtacgcgtacgacctacgtactcgtcgtctacctaccg

SEQ ID NO: 66080 - DNA, 717 bp, Homo sapiens
  misc_feature: GYAE6OF02GIGEX.31.78.H01.1.454.CMB.1.raw
  modified_base (461)..(461): a, c, t, g, unknown or other
  misc_feature (461)..(461): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggtctggtgtctcgtggcgaggacggccaccgatcgaacgtgacaacgtccgagccgagtagtttacgtttttacgttccggacccctaactaaactaacctaacttaccttaggtcttacggtaaccagtaccgaaagtaaaggtaggaccctacggtacccttaaccgtaaacctcgtacgtaactttacggtcgggtcctttaccggacccggctacggtcccgggttacctaaccgattcgagttcgcgacggtcggtacgtacgggtacctnttaccacttccgacacctagtacacgcgacgtcctaggcgacgtacgacggaagtacgttacggtcgtacttaaggtttaactacgttgtacgtaacgtactaacttacgttaacttaccgttttcgtttaccgttaacttcggttaccggagggtaacggtaacgtagggtaccgtagtacgtaacgtaaaccggtaacgtcgggtacgtaccgtcgtaccgtaactccgttacgtaccgtttctacgttacccg

SEQ ID NO: 66081 - DNA, 810 bp, Homo sapiens
  misc_feature: GYAE6OF02HV4NX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagttccagtcctccctggctgtgtctcgtggcgagacggccaccataccaacgtcgacgtaacgtccagacctaggtagttttcgtttttacgttccggaccccctaactaaaacttaaacctaacctttaacgttaacgtccgtttacgggtaacccaaggtaccgaaaaggtaaaacgggtaccggaaccgtaaccggtacccctttaaccccgttaaaaccgttcccgttaaggttaaccgtttttaaccggtcggggtttacccctttacccggggtaaccccggggtccttaaccggggtttcccccggggttttaaccctaaaccggttactttaccgaggtttccggaccgtacggggtcgggttaccgtacggggtaacccttacttaccgtaccgtcctaccgacctagtccgaacgtccgacgccgtggaccgtacggtactacggaagtagttcggtacgtacgtttatttacgtacgtacgtcagtactaacgttactttacttacctttaccgttccgtacgttacggttcgggaacgggtacggaacgtacgggtagacgtacgtaaccgaaacggtcgtacggtcggtacctacgacctaccgtacgttcgtacttacctactacccg

SEQ ID NO: 66082 - DNA, 790 bp, Homo sapiens
  misc_feature: GYAE6OF02JNRFW.31.78.H01.1.454.CMB.1.raw
  modified_base (143)..(143): a, c, t, g, unknown or other
  misc_feature (143)..(143): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggtactctctggtcnccgtacggggacattcgtgatggagccgtagtttccagtccttcccgtggtctgttgtctccggtgggcgaggaccggccacctatccaaacgtgaccgtaacgtccaacggcctaaggtgttttgttttaccgttccggaaccccctaaaccaaatttaaaccaaacgttaccgttacgtccgtttacggtaaccaagaccgtaaaggtaaacgggtacggaacctacgtcccctaaacctaaccgtccttagtaactttaccgtcggggtacctttccggacccggtcgttaccggtttaccccgggtacctaaccggtattcgtaacgttggcgtacggtcggtccggacggtaccttacgttncccgttanccccgaactgtaccgacgtcacgtaccgtcgcgtagtacgtagtaacgtagttcggtacggttacgtaacgtttcgtaacgttcgtacctaaggtactaacgttctttaactttaccgtttccgtttaccgttccgttaaccggtttcggccgggttaaacggtacgtacggtaaggtaaccggtaacgttaaccgtaaacgggttacgttaccggtacggtcgttaccaccggttactaccggttactaccgttaccgttacccttacccg

SEQ ID NO: 66083 - DNA, 916 bp, Homo sapiens
  misc_feature: GYAE6OF02HMWZH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagacgggccaccatcaactgacaagtccagccagagttgttttattcggccccaacaataaccaactacttacgcttggtaccagcaagaaagtaggacacgccctacctaaactcctagtatttacgtgggtccttccgtacccgggtctacgttcccgggggttaccctaaacccggtatttccgtaagttcgggacctaacggggtccgggggttaccgttacggggggtaacccgttaacgttttcccgaaaccgtttcccttaacccaacccgtaaacgtttcccgaaacggtccgtaccggttacccctcggtaaccggttaacgggtccgttaaaggaaaccggtaaggttacgggttaacgggtaccgtttaaacgggtttttaaacgttttaccggttacgtttaaccgaaccggtaaacgttaaacccgttaaattttaacccgttttaaacctttttacccgtttttacccgttaaccgtttaacccggtttttaccgggggaaaccgggggttaaaccgggttaaaccgggttaaacgggggtttaaccggggaaacgggtttaaacccggttaaacccgaaaaaacccggggttaacggttacccggggttaacggggtaccccgtttaacgggaaccccgttaaacccggttacccgttaccggttttaacggtttaccccgtttacccggtttaacccccgg

SEQ ID NO: 66084 - DNA, 784 bp, Homo sapiens
  misc_feature: GYAE6OF02HZOL2.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgcctacggggacatcgtgatgagccagtttccagacctccgtggctgtgtctcgtggcgagcgggccaccatcaactgacaacgtccaggcctaaggtacgtttgttttacgttccggaccccctaacctaaattaaacctaacgtttacttaacgtccgttacggtaaccaggacgtaacggaaaggtacggactacgacccttacctaaacctccttaggtactttacggtacgggtccttaccggtaccccgggtcgtacggtttacccggggtacccttaaccggtcttacacgtttacggccgttagggtccggggtccgttacggggaacccgttatttaccgaccttacccgtctaacccgtattacgacgtacctaccgtccgtacgtaccggacggtaccgtaggtaaacgtgtacgggttcggtacgtttaactttacggtttagttaccggtactacggtaacctaaaccgttaattttaccttaccgtttccgtttacgtccgttaaccggttcgggtacggggaaccgtaacgggtaacgggttaggtacgtaacgttaaccggtaaaagtaccgtagggtcgtaccgttacggacccttaccgtaacttccgttagttcccttgtaacccg

SEQ ID NO: 66085 - DNA, 673 bp, Homo sapiens
  misc_feature: GYAE6OF02GR9Z1.31.78.H01.1.454.CMB.1.raw
  modified_base (347)..(347): a, c, t, g, unknown or other
  misc_feature (347)..(347): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctccctggctgtgtctcgtgggcgaggcggccaccatcaactgacaagtccagccagtagttgttttagttccgacccccaacaataactaacgtactagtcttggaaccagtcgaagtaaagtagacacgtcctacctaactctagtacttacgtggccttccgacccggntaccggttccgggtacctaacgtattcagttcggctacggtcgggtacgtcgggaacctattccgaaccttcacccaacctactcgacgtactcgccctagcgtaacggtcgtaagacgtacgtggtacgtactaagttttacaacgttgtacgactactaacgttactttaacttccgttttacgtctttaccgttacccgggttacggtaccggggaacgtaaacggttaagggtacgtaacgtcgtaaaccggtaacgacgttaggtaaccgtctaccggtaaccaacgttcgttcccgttagttacctttaccggtaacccg

SEQ ID NO: 66086 - DNA, 672 bp, Homo sapiens
  misc_feature: GYAE6OF02FV3A6.31.78.H01.1.454.CMB.1.raw
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagccagtttccagacctcccgtggctgtgtctcgtggcgagacgggccacatccaactgacaagtccagccagagtttgttttattcggacccctaacaataacaactacttagcttagtaccagacaagaaagtaggacacgacccttacctaaactcctagttattacgtgggccttaccgacccgggctacggttcccgggtaccttaaccgnttcgtatcggtacacggtcgggtcgtacgggaccgttntttcgactcgtaccacctntaccgagtccacgcctcgcgtagactaggaacgtcgtcggtaggtacttagtttactacgttgtaccagtaccaacttaactttacttacgtttacttaccgttacgtttaccggttaccgggacgggtacggtaaaccgtaaggggttcggtaacgtaaccgttacggaaaacgttaacgtgggtacggtaccgttaggaccctaacgttcctacggttcgttaccttacctaccgg

SEQ ID NO: 66087 - DNA, 644 bp, Homo sapiens
  misc_feature: GYAE6OF02GYM85.31.78.H01.1.454.CMB.1.raw
  modified_base (231)..(231): a, c, t, g, unknown or other
  misc_feature (231)..(231): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactcctggctgtgtctcgtgggcgagaggccaccatcaactgcaagtccagccagtagtntttattcgccccaacaataacaactacttagcttgtaccagcaagaagtaggacagcctactaaactccgtagatttacgtgggtaccttccgtacccgggctacgttccggggttaccaaccggtattccgaagttcggtccaggtcgggtccgtggggtacccgtatttccgaacttctcaccatccgtagccacgtcctgcgacgcgtacgaagtcgtggtacggactaggttttaacgtacgttggactaacgtactaacgtaatttaacgttactttactttccgtaccgtacgtttcggacgggtaacggaccgtaacggtaggtacggtaactaccggtaaacgtaaccggttggtacggtaccgttagaccgtacctaccgttcttacggttaccttcgtaaccg

SEQ ID NO: 66088 - DNA, 834 bp, Homo sapiens
  misc_feature: GYAE6OF02IPRA0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttcgctctggatctcgtggtcgccgtacggggacactcggtgatgacgcctacgtttccacgacctcccgtggcttgttcgtcgttcggtgggcgaaggcgggacccaaccacgtccaacgtcgaccgaacgtaccgacgaccgtaaggtacgttttcgtttttacgttccggacccccaaacctaaacttaaaccaaacgttaactttacgtacctttacggaaccagacctaaggtaaaggtacggacacgtacccttaacctaaacctcttagttaacgtttaccggtcgggttccgttacccggtacccgggaccgtaccgggttacccgggtttacctaaaccggtctttacgtacggttcggacgtacgggtcgggttccgtacggggtaccctatttaccgactccctactaacctaatccgaacgtccgacgtccttaacggcgtacgggtaccgtaagtaacgggtcgtaggtccggtacgtttaagttttaaccttacggttacgttacgaaaccgtaccgttaaccttaattttacggtttaacccttttcgtttaccgttacctttaccggggttaacccgggtacggggaacccgttaaaccgggtaggtacggtacgtaacgttaaacccgaaacggttacggtacgttcggaaccgtacacttacccgtacgttccgtttacgttaccctagttccccg

SEQ ID NO: 66089 - DNA, 771 bp, Homo sapiens
  misc_feature: GYAE6OF02HVK0O.31.78.H01.1.454.CMB.1.raw
  modified_base (389)..(389): a, c, t, g, unknown or other
  misc_feature (389)..(389): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgaccgtacggggacatcgtgatgacgcctagttccaagacctccctggctggtctctcgtgggcgaggacgggccacctataccaactgacaacgtccagcctaagtagtttcgttttaagttccggaccccctaacctaaataacctaacttacttacgtcttacggtaccagactaaggaaacgtacggaacacgtaccctacctaaacgtccctagtaattaccgtggtccttaccgtaacccgggntaccgttcccggggttaacctacgtactctaagttcgccgtaagggtccgggtgtaccgggtaacctacgttacctactccgtactaccgtagtaccgagtaccgacgtccgtcggaccgtacggtacctaaggtaacgtaacggtcggttcgggtacttaggtttaacttaggttaccgtcgtaacgtacctaactaacgtttaacctttacttccgttttacccgtaacgttacccgggttacggttaaccggggaaccggttaaacgggtaacgggtacggtacgtaaccgtaaacggtaaaccggtaacgttcggtacggtacccttacggaccccgttacgtacgttaccgtttcggttacccttacttaaccccgg

SEQ ID NO: 66090 - DNA, 790 bp, Homo sapiens
  misc_feature: GYAE6OF02HU5LM.31.78.H01.1.454.CMB.1.raw
  modified_base (428)..(428): a, c, t, g, unknown or other
  misc_feature (428)..(428): n is a, c, g, or t
  modified_base (595)..(595): a, c, t, g, unknown or other
  misc_feature (595)..(595): n is a, c, g, or t
  modified_base (720)..(720): a, c, t, g, unknown or other
  misc_feature (720)..(720): n is a, c, g, or t
tcagcagtagacgtccacgaccggtgctcgatttagtgtgagtagtttgggtttgggggatctacaacaggcaggcaggggcagcaagatggtgttgcagacccaggtcttcatttctctgttgaaaactctggatctctggtcgccgtacggggacagtcgtgatgacgcctagtttccagtacctccctggctgtgtctcgtgggcgaggcggccaccatacaactgacaacgtccagaccaggtagtttcgtttttacgttccggcccccaaactaaactaacctaaccttacgttaacgtcgttcggaaccagacgtaaggaaacggtacggacctacgtcccttaacctaaacctcgttacgtaactttacgtcggtccttaccggacccgggtctacggttccccgggttacctaaccgttnttacgtacgttacggcgtacggtaccggggtcgtacggggtacctttacttaccgtacttacctaccgtaaccgtacgttacgaccgacgttaaccggccttcggacgtaacgtcgtaggtaaatcggtacgttaggtaaccctttaggtttaacttccgtacgtanaaaccgtaaccttaagtactttttaaccgttaaccgtttttccgttacccggtatttcccgggttaccgggaacgggtacggtaaaccgttaggtaccggaattaaccggtaaaccggtaaacgnggttacggttaccgtaccgttagaacccgttcttaacggttcccttaggtttccttaacccgttccccgg

SEQ ID NO: 66091 - DNA, 709 bp, Homo sapiens
  misc_feature: GYAE6OF02H8O59.31.78.H01.1.454.CMB.1.raw
  modified_base (702)..(702): a, c, t, g, unknown or other
  misc_feature (702)..(702): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctctggtgcctacggggacatcgtgatgacgcctagtttccagactccctggctgtgtctcgtgggcgagacgggccaccatcaactgcaagtccagccagtagttgtttttacttcggcccccaactaataaccaacttacgttagccttggtaacccaggacctaaggaaagtaggacacgtacctaccctaaactcctagtactttacgtcgggcctttccggaccccgggtctacggttccccggggttacctaaccgtattccagtttcggcgtaggcgggtcgtcggggaaccgttatttccaccgttacctaccgtaccctaatccgtaacggaccgtacgcccgtcggaccgagggtccttaggaaagtcgttacggtcgggtacttaacggtttaactttacgtacgtacaacgtacctaaacttacttacttacctttctttccgttacgtacggtttacgggccgggtaaacggtaccctaagggtcggaactaacgtaaccgaaacgtaacgttcgggtcgaccgttagccaaccgttacttccgttcgttacccttnttacccg

SEQ ID NO: 66092 - DNA, 729 bp, Homo sapiens
  misc_feature: GYAE6OF02JYX9L.31.78.H01.1.454.CMB.1.raw
tcagcagtagacgtcacgaccggtgctcgatttagtgtgagtagtttgggtttgggggaggctacaacaggcaggcagggcagcaagatggtgttgcagacccaggtcttcatttctctgttgctctggatctctggtgacctacggggacatcgtgatgagccagtttccagacctccctggctgtgtcctcgtggcgagacgggccaccatcaacgtgacaagtccagccagagttcgttttagtcggccccacaataacactactagcttaggtaccagcaagaagtaggacagacccttaccaaacttcctagtaactttaccgtggggtacctttccgtaaccccgggtcaacggttaccccgggggtttacctaaacccggtattaccgtaagtttcggaccgtacgggtcgggttccgtacgggacccgtatttccacgtctaccgacctagtactagaccacgccgtgaccgacggtccttaggaagtacgttacggttggaccgttttaagtttactttacgacgttaccaaggtaccctaaattactttaacgtttacctttcgttttaccgtaccgttaccggttttaccgggacgggtacgggtaaaccgtaacgggttacgggaacgttacgtaaaccggtaaacggttaacgttcggtaacggtaccgttacggacccttacgtacgttccgttaacgttccttaacttacccgg

SEQ ID NO: 66093 - DNA, 951 bp, Homo sapiens
  misc_feature: GYAE6OF02FX2KY.31.78.H01.1.454.CMB.1.raw
tcagcagtagacgtcacgaccggtgctcgatttagtgtgagtagtttgggtttgggggagctacaacaggcaggcaggggcagcaagatgggtgttgcagacccaggtcttcatttctctgttgctctggatctcgtggtgaccgtacggggacatcgtgatgacgccagtttcccagtacctcccgtgggtccttggttcgtcttccggtggggaccgagggacggggacccaaccgtacgttaccgaacgtcggacctaaacggtcccaacggtaccctaaggggttaacgttttacggttttttagttaccccgggacccccctaaaccgtaaaactaaaaccctaaaccgttaaccgtttaaaggtccgtttaacgggaaacccctaaggtaaccgtaaagggtaaaacggttaacgggaacccgtaaccgtaccccgttaaacccgtaaaaccgttccgtacggttaaccgtttaaccggtccggggttaccgtttaccccggtaaccccggggtcttaacccgggtttaccccgggggtttaaccctaaaccggttcttaccgtaacggttccggtacggtaaccgggtcggggtaccggtaccggggtaaccgttacgtttttaacgaacccgtttccacccgtaaccgtacgtacccggtaacgacccggtaaccgtcccggtacggtaccggtaacggtcggtaaacggtaaaggtacgttacggtaacggtacgtttaaacggtttacttacgttacgacgtaacgtaaacttaacgttaagtttactttacgtttacgtttcgttaacccggttcggttacgggaccgtaaacgggtacgttaaggggttagtacgtactaaccgtaaacggtacttacggggtccggtaacgttaccgaacctacgttaccgttacgtccggttacctacggttacccg

SEQ ID NO: 66094 - DNA, 631 bp, Homo sapiens
  misc_feature: GYAE6OF02GITZA.31.78.H01.1.454.CMB.1.raw
  modified_base (199)..(199): a, c, t, g, unknown or other
  misc_feature (199)..(199): n is a, c, g, or t
  modified_base (339)..(339): a, c, t, g, unknown or other
  misc_feature (339)..(339): n is a, c, g, or t
  modified_base (405)..(405): a, c, t, g, unknown or other
  misc_feature (405)..(405): n is a, c, g, or t
  modified_base (444)..(444): a, c, t, g, unknown or other
  misc_feature (444)..(444): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagngggccacatcaactgcaagtccagccagtgtgttttattcggccccacaataacactacttagcttggtaccagcaagaaagtggacagaccctacctaaactccgtagtactttaccgtgggtccttccgtacccgggntacggttcccgggggttacctaaccggtacttcagtttcggcagggcgggtacgtcggggaccgtntttcactctaccacatcagcacgcctgcaggctaggagntggtcggcttagttttactacgttgtcacgactaaactatttacttaccttttctttaccgtcttaccgttttacgggaccgggtagggtaacctaaggggttacggactacgtaccggtaaaccgttaacggtcggttcggaccttacgaccgttactaacgttcttcggttaccttcgttaaccg

SEQ ID NO: 66095 - DNA, 899 bp, Homo sapiens
  misc_feature: GYAE6OF02JIPSF.31.78.H01.1.454.CMB.1.raw
  modified_base (863)..(863): a, c, t, g, unknown or other
  misc_feature (863)..(863): n is a, c, g, or t
  modified_base (865)..(866): a, c, t, g, unknown or other
  misc_feature (865)..(866): n is a, c, g, or t
  modified_base (872)..(872): a, c, t, g, unknown or other
  misc_feature (872)..(872): n is a, c, g, or t
  modified_base (874)..(874): a, c, t, g, unknown or other
  misc_feature (874)..(874): n is a, c, g, or t
  modified_base (877)..(877): a, c, t, g, unknown or other
  misc_feature (877)..(877): n is a, c, g, or t
  modified_base (879)..(882): a, c, t, g, unknown or other
  misc_feature (879)..(882): n is a, c, g, or t
  modified_base (884)..(885): a, c, t, g, unknown or other
  misc_feature (884)..(885): n is a, c, g, or t
  modified_base (887)..(889): a, c, t, g, unknown or other
  misc_feature (887)..(889): n is a, c, g, or t
  modified_base (891)..(892): a, c, t, g, unknown or other
  misc_feature (891)..(892): n is a, c, g, or t
  modified_base (894)..(896): a, c, t, g, unknown or other
  misc_feature (894)..(896): n is a, c, g, or t
  modified_base (898)..(898): a, c, t, g, unknown or other
  misc_feature (898)..(898): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagacctccctggctgtgtctcgtgggcgaggacgggcccaccgatcaactgcaagtccagccagagttgttttattcggacccctaacaataacactactagcttacggtaccagacaagaaagtagacagccctacctaaactcctagtactttacgtcggtcttaccgtacccgggctacggttcccggggttaccctaaaccggtactttacgtaggtttcggaccgtaacgggtccggggttaccggttaccggggtaccccgtttacgtttaccgtaacccgttcccgttaaccctaaaccccgtaacgttacccggaacggtacccgtaaacccgggttacccccgttaccggggtaacccgggtaaaccgggggttacccgtttaaacccggggtaaaaacggggtttaacccgggtttacccggggggtttaaaccccggggggtttaaaaccccggggttttttttaaaaccgggggtttttttttaaaacccgttttttaaaaaccccccggggggttttaccggggttttaaaaacccccccggggttttaaaaaccccgggggggtttaaaaaaaacccccctttttaaaaaaaacccccgggtttttttttaaaaaaccccgggtttttttttttaaaaaaaccccccggggggttttttttttaaaaaccccccccctntnntcgtgngngcngnnnnanngnnncnntnnntnc

SEQ ID NO: 66096 - DNA, 714 bp, Homo sapiens
  misc_feature: GYAE6OF02GDHPV.31.78.H01.1.454.CMB.1.raw
  modified_base (317)..(317): a, c, t, g, unknown or other
  misc_feature (317)..(317): n is a, c, g, or t
  modified_base (361)..(361): a, c, t, g, unknown or other
  misc_feature (361)..(361): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatccaactgcaagtccagccagagttgttttattcggaccccaactaataacaactactagcttggaccagcaagaagtaggacagcctacctaactctgtattcgngggtccttcgtacccgggctacgttcccggggttcctaaccgtnttcagttcggcgagggtcgggttctacggggaccgttatttccacgttcctaccaaccgtataccacgtcaccgtcctcggaccgtagggtacctaggtaacgtagtacgggttacggtacgttaaggttttaacttacgttacgtaccgtaagtacctaaacgttaatttaacgttaccgtttaccgttttaccgtaccttacccggttttaccggggaacgggtaaaccgggtaaccgtaaggggtacggtacgtaacgtaaccggtaaaacggtaacggttacggttacggtaccgttacgtacccgtaaccgttaccgttaccgttacgtttacccttaccgttaaccg

SEQ ID NO: 66097 - DNA, 631 bp, Homo sapiens
  misc_feature: GYAE6OF02ILNUW.31.78.H01.1.454.CMB.1.raw
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaggggacatcgtgatgagccagtttccagactccctggctgtgtctcgtgggcgagagggccaccatcaactgcaagtccagccagagttgttttattggccccacaataacaatacttagcttggtaccagcagaaagtaggacagcctctaaactccngtacttacnggcttcaccggcagtccgggtacaacgatcatgcagcggtntgggacatttcgactctacacctagtacagtacacgcctacgcgtaacggcgttagaaaagtaattaccggtaggtaccgttagttttaaacgtttaaccgtgttacgaacgtacaaacgttaattaataacctttcgtttacgtacctacgttttaccggacgggtaacgggtaacccgtaaagggtcggacgtaaagtccgtaaaaacgtaaaccgtgttaacgggaccgttacgtaccgaacccgtaagttaccgtacgttaccgttactaacccg

SEQ ID NO: 66098 - DNA, 640 bp, Homo sapiens
  misc_feature: GYAE6OF02F21UN.31.78.H01.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
  modified_base (423)..(423): a, c, t, g, unknown or other
  misc_feature (423)..(423): n is a, c, g, or t
tcagcagtagacgtcacgaccggtgctcgatttagtgtgagtagtttgggtttggggagctacacaggcaggcagggcagcaagatggtgttgcagacccaggtcttcatttctctgttgctctggatctcgtggtgccgtacgggacatcgtgatgagcccagtttcccagacctcccctggctgtgtctcgtgggcgagacgggccaccatccacctgccaacgtcccacgccagngttgttttacttcggacccccaccataaccaactacgttagctttcggacccaggccaggaaacgtacggacctancccttacctaaacctctagtattacgtgggtccttccggaccccgggtcaacgttccccgggttccctaaccgtaattccgtaagttcggactagggccgggttaacgnggggtaaccctagttttccaactcctaccacccatcacgtcacgcctgccagcctaggaacgagttcgtcggactacgttttactacgttacgtacacgtaccaactaacttacttactttccgttacgtacctacggtttaccgggacgtacgggacctagggtgacgactacgaaacggtacctagtgcgtgaccactatcacggtctctacccg

SEQ ID NO: 66099 - DNA, 642 bp, Homo sapiens
  misc_feature: GYAE6OF02GV72K.31.78.H01.1.454.CMB.1.raw
  modified_base (200)..(200): a, c, t, g, unknown or other
  misc_feature (200)..(200): n is a, c, g, or t
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
tcagcagtagacgtcacgaccggtgctcgatttagtgtgagtagtttgggtttgggggagctacaacaggcaggcaggggcagcaagatggtgttgccagacccaggtcttcatttctctgttgctctggatctctggtgcctacggggacatcgtgatgagctagttccagactcctggctgtgtctacgtgggcgagnggccacgatcaactgcaagtccagccaagtgttagttttagttcgccccagaatacaacttactagcttagtacagctaaggaagtacggacacgtccctacctaaactctagtactttcgngggtccttacgaccggntacggtccgggttacctaaccgtcttcgagtttggactaggtccgggtctacgggtacctattacgacctcgtacaccgtatcgacgcgtacgccgtagccgaagtcgtagaagtcgtgtcggtacgttaagtttactacgtcgaacgtacgtaacgtaactactttagttaacccgtttcgtttaccgttacttaccgggttcgtacgggtacggtacggtagtacggacgtaagtaccgaaaacgtcggtaacggtacgtcgtacgtacctacgtacgttccgtacttcgttacttacccg

SEQ ID NO: 66100 - DNA, 852 bp, Homo sapiens
  misc_feature: GYAE6OF02HF3KT.31.78.H01.1.454.CMB.1.raw
  modified_base (191)..(191): a, c, t, g, unknown or other
  misc_feature (191)..(191): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatgagcctagtttccagactccctggctgtntctcgtgggcgaggacgggccaccataccaactgacaacgtccaacgccgaagtacgtttggtttttacgttaccgggaccccctaactaaactaaacctaacttacttacgtcgttacggtaaccagacaagaaaaggtacggacacgaccttacctaactcctacgtattaccgtcgggtacttccggtacccggtacgtaccggttacccggggttacctaaccggtacttacgtacggttcggacgtacgggtaccgggttcgtacggggtacccgtacgttttaccgacctttacgaccctaaccgtactaccggacgtaccgtaccgggtaccctacgggaccggtaacggtacgtaacggtaaacggaacggtttcgggtacgggtaacgtttacggttttaacgttaaccgtacgtaaccgaacgttaacctaaacgttaacttttaccttttaaccgtttacccttttaaccggtttacggtttaccgggtttaccggggtaaaccgggttaacgggtaaacccgttaacgggggttggtaaacgttaaccggtaaccggtaaaaccggttaccggttacgggtaacggttaccggtccggtaacctaaccgttaccgttaccggttaccgttttacccgtacgttaccccg

SEQ ID NO: 66101 - DNA, 679 bp, Homo sapiens
  misc_feature: GYAE6OF02IBMX2.31.78.H01.1.454.CMB.1.raw
  modified_base (484)..(484): a, c, t, g, unknown or other
  misc_feature (484)..(484): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggctgtgtctcgtgggcgaggacggccaccatcaactgcaacgtccagccagtagttgttttattcggccccaacaagtaacaactacttagccttaggtaccagccaaggtaaagtggaactggtaccctaccgttaaaactccgttagtactttacgtggtctttaccgaccgggtcctacgtcccggggttacctaaccgtattcgagttcggcacggtcggtcgtgggtacctacttacacgtctaccacgactacaggtacccaggtccctgaccgaacggtcttaacggaaaggtnttcggtaacgggtccttaagttttaaccttacgttcgggtaccgaacgtacctaaacttacgtttaacttaccgttttcctttacggttacctttacgttccgggaccggtacggtacgtaagtggacgtaactcgaaacgtacgttcggagtaccttacgacgtaacctgttcccgtagttcccttactacccg

SEQ ID NO: 66102 - DNA, 699 bp, Homo sapiens
  misc_feature: GYAE6OF02GCAXH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgacgcctagtttccagtacctcccgtggctgtgtctcgtgggcgaggacggaccaccataccaactgacaacgtccagccgaggtaggtttgtttttaacgttccggaccccaacaaacttaaaccaacttaacttagtcgttacggtaaccagacaagtaaaggtacggacacgacctacctaactcctagtactttacgtcgggtccttacggtacccggctacggttcccgggttacctaaccgtacgttactagttacggacgtacgggtcgggttcgtacgggtacccgttactttaccacgttacctaccgaacctacgtaccgacgaccgtacgccgtcgaccggacgtacgtagtaagtagtcggtaggtacgttagtttacgttacgtagtacacgtactaagttacttacgttctttacgttcgttcgttacggttcgggacggtacggaacgtagtagacgtacgtaaccggaaacgtacggtacggtacgtcgtacgaccgtaactcgttcgtctaccttgtacccg

SEQ ID NO: 66103 - DNA, 830 bp, Homo sapiens
  misc_feature: GYAE6OF02J2DHY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgcctacggggacatcgtgatgagccagtttccagactccctggctgtgtctcgtgggcgagacgggccaccatcaactgcaagtccagccagacgttgttttattcggcccccaacaataacaactacttagcttggtaccagcaagaaagtaggacacgcctaccgtaaactcctagtacttaacgtcggtacttccgtacccgggcacggttcccggggttacctaaccggtattcgtacgttcggactacgggacgggttctaaccggggtaccgtacttttacgaccgttacctcccgtaacccgtaacgttccgtaacggtacctaaccgggtcccgtacggacccggttaaacgggtaccgttaacgggtaaaacggttaacggttcggttaccggggtaacctttaggtttttaaaccgtttaccggttacgttaaccgacgggtaaacctaaacggttacttttaaaccgtttacccttttaccggtttaccgttaccttaaaccgggtttttacgggacccggggttaaacgggtaacccgttaaagggggttaccggtaacgtaaccgttaaaccgggtaaaacccggttaacgtttcggggtacccgggttaaccgttacggacccttaaccccgggttaaatttcccgggttaccttttaccggttaccttaaccccgg

SEQ ID NO: 66104 - DNA, 603 bp, Homo sapiens
  misc_feature: GYAE6OF02GSLLI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataaccaactacttagcttggtaccagcagaaagtaggacagcctctaaactcctagatttacgtgggcttccgtacccgggcacgttcccggggttacctaaccggtattcattcggctaggcggggtctggggacccgtattttccaactctaccacctatccagccacgtcctgcgaggctagaagactgtggactagtttattacgtgtcagacaactattactactttcgtttcgtactacgtttcgggacggtacgggtaaccgaagggtggagacgtacgtaaacggtaacgttcggtacggtaccgtgaccaaccgtacgttaccgtacgttccttacgtacccg

SEQ ID NO: 66105 - DNA, 699 bp, Homo sapiens
  misc_feature: GYAE6OF02G0J5O.31.78.H01.1.454.CMB.1.raw
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (426)..(426): a, c, t, g, unknown or other
  misc_feature (426)..(426): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtaggggacatcgtgatgagccagtttccagacctccctggcttgtgtctcgtgggcgaggacgggccaaccagtcaactgacaacgtccagccaggtagttagtttttattccggaccccaactaataactaaccttacttagcttaggaaccagacaagaaagtagacacgccctaacctaactcctagtactttacgtcggtccttaccggacccgggtnaccggttcccgggttaacctaaccgtnttactagttcggacaggtccgggtgtcgggactnttcactccacaccgtactcgacgtccacgtccgtcgaccgaggtcgtaacgaagtagtacgggtcgtacgttaggtttacttacgtcgtacgagtacctaaacgttatttacgttacctttaccgtttaccgtccgttaacggtttccggggaacggtaaccgggtaacgtaacggtaggtaacgtaacgtaaccggtaaaacggtacgtacgggtacggttaccgacgtacctaaccgtagttacccgttacgttaccgttacctaaccccg

SEQ ID NO: 66106 - DNA, 778 bp, Homo sapiens
  misc_feature: GYAE6OF02F66T0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagcctagtttccagacctccctggctgtgtctcgtggacgaggacggccacactcaactgacaagtccagccaagtacgttagttttacttccggaccccaactaaataacctaacttacttagcgttagtaaccagacaaagaacgtaggaacacgtaccctacctaaactccgtagtactttaacgtcggtcttaccgtacccgggctacgttacccggggttacctaaccggtattacgtagttcggacgtacgggtcgggttccgtacggggaccttacgtttaccacgttccgtacctaacccgtacgttaccgaacgtaccgtacgtacccgtacggccgtaacggtccgttagaaacggtagttcgggtacggtacgtttaacggtttacgtaccgttacgtaccgtagtaacccgtaaattacttaaccgtttaccttttacgttaccgtttccgttaacggtttccgggtaaccgggtaaacgggtaccgttaagggtaccggtaacgttaacggttaaccgtaaacgggtaccggtttaaggccggtaccgttaccgtaaccgtaaccgttaggttacccggttacgttcccgtttacgttaccccg

SEQ ID NO: 66107 - DNA, 687 bp, Homo sapiens
  misc_feature: GYAE6OF02G9T6G.31.78.H01.1.454.CMB.1.raw
  modified_base (459)..(459): a, c, t, g, unknown or other
  misc_feature (459)..(459): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagcctagttccagactccctggctgtcgtctcgtgggcgaggacggccaccatacaactgacaacgtccagccaagtagttacgttttattccggaccccaacctaaactaaacctaaacttaacttacgtacttacggtaaccagactaaagaaaggtaggaacacgtacctacctaactctagtactttacgtcggtcttacgtacccggtacgtacggtacccgggttacctaccgacttcgacgttcggacgaggtcgggtcgtagggtaccttattcactctaccacactcacnctacgtctcgcacgctagaagtagtcgtcgacttaagtttatacgtgtactaacgtactaagtactttaacgttacctttcgtttacgtaccgttacgttaccgggtaacgggaaccgggtaacggaagggtttacgggaacggtagtaaccggtaaaccggtaacgttgggtacgtaccgtaccggtaccaaccttacgttccgttacgtttaccttacgttacccc

SEQ ID NO: 66108 - DNA, 757 bp, Homo sapiens
  misc_feature: GYAE6OF02F88X0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaacgtccagccagtagttgttttattcggccccaacaataaccaactactagcttaggtaccagcaagaaagtacggacacgacccttacctaaacctccgtagtaacttttaccgtcgggtacctttaccggtaccccggggacttaaccgggttccccggggtttaccctaaacccggtattttccgaaggtttcggaccgtaacgggtccggggttacgtaccggggggtaacccttacttttacccgaacctttacccgtaccaaacccgtagtaccgaacgccgtaaccgtcccgtagaccgtaacggtccgtaaaggaacgtacggtggtacggtaccgttaagtttacttacgtcgttacacgtaacctaattacgtttacttacccgttttcgtttaccgtaccgttacggttttccgggaacggtaacgggtaaccgtaaggggtgtacgaacttaaccggaaacggtaccgttggtcggtacctcggtaactaccgtacgttccgtacggtttacctacgttacccg

SEQ ID NO: 66109 - DNA, 701 bp, Homo sapiens
  misc_feature: GYAE6OF02JCMJ6.31.78.H01.1.454.CMB.1.raw
  modified_base (560)..(560): a, c, t, g, unknown or other
  misc_feature (560)..(560): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagccagtttccagcctccctggctgtgtctcgtcgggacgaggacgggtcccacacttcaacgtgacaacgtccaagccagtagtttgtttacttccggaccccaacctaactaaactaacgtacttaacgtcgttacggtaccagaccgaaggtaaaagtacgggaacacgtaccctaacctaaaaccgtccttacgtaactttcggtcggttaccgttaccgacccgggtacttaccggttaccccggggttacctaaacggtactcgttaacgtcggagtaaccgggtcggtcgtacggggaccttacgttccactttcaccgacctagtccgaacgcgtaccgccgtacgcggtacgcgtagaagtctaggtcggtacttagtttacgttacgtntaccgagtacctaactatttaacgttacctttagtttccgtcgtaccgtttccgggaacgggtccgtaacggtaacgaggagtacacgtaaaccgtacgtaggtcgtacggtacacgttacgacctggtctacttctaccg

SEQ ID NO: 66110 - DNA, 714 bp, Homo sapiens
  misc_feature: GYAE6OF02JI37A.31.78.H01.1.454.CMB.1.raw
  modified_base (189)..(189): a, c, t, g, unknown or other
  misc_feature (189)..(189): n is a, c, g, or t
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtntctcgtgggacgaggcggccaccatcaactgacaagtccagccagtagttgtttatcggccctaacaataacactactagcttacggtacagacaagaagtagacacgtccctactaaactccgtatacttacgtcggtccttccggtaacccgggntaacggttccggggttacccttaaccggacttacgtacgtcggaccagggtccgggttcgtacgggacccgtatttaccgactccgttaccaactacgtccaacggtccacgtccgtcgacgtaacggcgtacgaagtacgtggtacgcttaagtttacgttacgtacgttaccgaacgtactaaccgttagtttaacgttaacccgttttccgtttacgttaccggttaacccgtttcggggaaccgggtaccggtaaaccggaagggttacgggtagttaaccgtaacggtaaaccggtaacgttgggtaaccgtcgtaaccgaccgttaccctaggtttacctacgttaccgtttacccgtaacg

SEQ ID NO: 66111 - DNA, 910 bp, Homo sapiens
  misc_feature: GYAE6OF02F43CL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccacggtcttcatttctctgttgctctggatctctggtgccgtacggggacatcgtgatgagcctagtttccgacgactccctcgggtctcggtgttcgtcgtgggacggaggagggacccacccagtacaacgtgacctaacggtaccacggacctaggtaggtttaggtttttacgttttaccgggaccccctaaacctaaaacttaaaacctaaaccgttaacgtttacggtaccgttacgggtaaaccctacggacctaaagggaaaacggttaacgggacctaacgggtaccccttaacccttaaaacccgttccgtacggttacgttttaaccggtcggggttcctttaccccggtacccggggaccgtaacggtttccccgggggtttacccttaaacccgttattaccgtacggtttaccggtacggacggggtccggggttccggtaacggggttacccggtacttttccgtaacccttccgtaccgtaacccgagttacccacggtcccaccgttacccggtccggacggtaaccggcggttaaggaaacgttacgtacgggtacggtacttaacgttttaacgtacgtttcgtacgtacgtacttaacgttaacttaacgtttacctttccgtttaccgttaccgttttaccgggtttaccgggtaccgggtaaacgggtaccgggttaaggggtaaccgtacgtaaactaaccgggtaaaacgtacggtttacggtcggttaccgtaaccgtcggttaacccttaggtccgtttaaccggttaccttaccgttaccc

SEQ ID NO: 66112 - DNA, 707 bp, Homo sapiens
  misc_feature: GYAE6OF02JGABY.31.78.H01.1.454.CMB.1.raw
  modified_base (245)..(245): a, c, t, g, unknown or other
  misc_feature (245)..(245): n is a, c, g, or t
  modified_base (376)..(376): a, c, t, g, unknown or other
  misc_feature (376)..(376): n is a, c, g, or t
tcagcagtagacgtcacgaccggtgctcgatttagtgtgagtagtttgggtttgggggaggcgtacaacaggcaggcgaggggcaggcaagatggtgttgcagacccaggtcttcattctctgttgctctggatctctggtgccgtacgggacacgtcgtgatgagcctagttccagtactcccgtggctgtgtctcgtgggcgaggcgggaccaccataccaacgtgcaacgtccagccgaagngttgttttattcggccccaacaataactactactagcttggaccagacagaaatggacgtacctaacctactcctagtacttcgtagggtccttacgacccgggtaccggttccgggttacctaaaccgtnttcgattcggccgtaagggcccggggttctacgggggtaccctacttttccgacttcctccaacgtcgtacacggtccagcctacggacgtacggcctacggaagtacgttggacgtacgtaacgttttagacgttaggtcaggtacctaacggtatttacttaacgtttccgtttacgttaccggtacgtttaccgggcggggtaaacggtaaccgggtagggtacggtaagtaccgttaaccgtaaaccgggttaaccttcgggtcgggtaacccgtttggacccctaagtcccgttttaccgtaaccgggtttccttaccggttaccc

SEQ ID NO: 66113 - DNA, 666 bp, Homo sapiens
  misc_feature: GYAE6OF02G7JQU.31.78.H01.1.454.CMB.1.raw
  modified_base (338)..(338): a, c, t, g, unknown or other
  misc_feature (338)..(338): n is a, c, g, or t
  modified_base (471)..(471): a, c, t, g, unknown or other
  misc_feature (471)..(471): n is a, c, g, or t
  modified_base (652)..(652): a, c, t, g, unknown or other
  misc_feature (652)..(652): n is a, c, g, or t
  modified_base (660)..(660): a, c, t, g, unknown or other
  misc_feature (660)..(660): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagactccctggctgtgtctctgggcgaggagggccaccatcaactgacaagtccagccagtagttgttttagttccggaccccaccaaataacctaactacttagcttggtaaccagacaaggaaagtaggacacggaccctacctaaaccgtcctagtactttacgngggtccttaccgacccggtctacggttcccgggttaccctaacgtattcattcggactagggcgggtcgtagggtaccctagtttccacgttcctacaacctactcgacgtcgacgtcctacgacgacggtanagtaaaggcgttggtacggtgttaacgttttagtaacgttcgtacgacgtaacgtaacttatttaacgttccttttacctttcgttaccgttacgtttaccgggacggtaacggtaacggaggtaggacgaactaaccggtaaacgtacgtggtacggtctacgtacaccgttatccggtnttaccgtntacccg

SEQ ID NO: 66114 - DNA, 601 bp, Homo sapiens
  misc_feature: GYAE6OF02FW2S9.31.78.H01.1.454.CMB.1.raw
  modified_base (362)..(362): a, c, t, g, unknown or other
  misc_feature (362)..(362): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgcaagtccagccagagttgttttattcggccccacaataacaactactagcttggaccagcagaaacgtagacagcctacctaaacttcctgtatttacgtgggtccttacgtacccgggctacgttccggggttcctaaaccggtnttcagttggacaggtcgggtctgggacccgtatttccactcctcaccatcagacacgcctgcgaggctagaagagtcgtaggactagtttattacgtgtacgagacctaatacttatacctttctttcgtacgtacgtttcgggacggtacggaaccgtaaggtcggaagtacctaacgaaacggacgttaggtacggacttcggtaccaccgtacgtaccgtcgttacctcgttaacc

SEQ ID NO: 66115 - DNA, 726 bp, Homo sapiens
  misc_feature: GYAE6OF02FGX0R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggctgtgtctcgtgggcgagaggccaccatcaactgacaagtccaggccagtagttgtttttattccgaccccaacaaataaacaactacttagcttacggaaccagacgaagaaaggtaggaccagaccctacctaaacgtcctagtactttacgtcgggtcttaccggtacccgggcacggttacccggggttaccaaccgttattcgtacgttcgggacctacggggtcgggtcgtacggggtaccgttactttaccgacttcctaccaaccgtaatccgaagtccacgtccgtacggtcgaacggtacgtaaggaaacgtaggttacggtacggtacgttaaggttttaacttacgttacgtaccgtaacgtacgtaaactacgtttaacgttaccgtttaccgttttaccgttaccgttaccggtttacggacgggtaaacggtaccgtaagggtacggtacggtactaaccggtaaacggtacgtcggtagtaccgtacgacccgtaccgtacgtaccgttcgttaccttacgtaccg

SEQ ID NO: 66116 - DNA, 768 bp, Homo sapiens
  misc_feature: GYAE6OF02IC43Z.31.78.H01.1.454.CMB.1.raw
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
  modified_base (727)..(727): a, c, t, g, unknown or other
  misc_feature (727)..(727): n is a, c, g, or t
  modified_base (744)..(744): a, c, t, g, unknown or other
  misc_feature (744)..(744): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctcttgttgctctggatctctggtgccgtacggggacagtcgtgatgagcctacgtttccagacctcccgtggctggtgtccgtcgtgggacgaggacgggcccaccatacaacgngacaacgtccacgcagtagttgtttattccggccccaacaanaactaacttactacgacttcggaaccagcaaagtaaagtacggacacgtaccctctaaaaccgtcctagtacttagtccggtccttaccggaccggtcgtacgttacccggggtttaccaaaccggtcttaccgtaagttcggaccgtacggggtaccgggttaccgtaccggggttaaacccgttcttttacccggtaacgttacccgttacccaaacccggttagaccgtaagacccggtaacgtccccgtaaggacccgttaacgggccttaaacgggaaagtaaccggtgggttaacgggactttaacggtttaaccttaacgtcgttaacgacgtactaaccaagtttaacttaccctttcgttacccgtagttaaccggttcggaacggtacggaaccgttaaggtccggacgtaccgtaagaaaccggtaccggtggtaccgtacgngtaacccgaccgttaanccgttcggttaccctcttaacccg

SEQ ID NO: 66117 - DNA, 857 bp, Homo sapiens
  misc_feature: GYAE6OF02HCKS2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgcctacggggacagtcgtgagtgagccctagtttccagacctcccgtggctgtgtctcgtggcgaggacggccacatcaacgtgacaacgtccagccgagtacgttgttttacttcggccccaacctaataaacctaacttacgttagtcgttacggtaccagtacgaagtaaaacggtacggaactacgtacccttaaccgtaaacctccgtagtaactttaccggtacgggtcctttaccgggtacccggtcgtaaccggtttaccccgggttaccctaaccggtacttccgtacggtttacggaccgtacgggtccgggttacgtaccggggtaccgttaacttttaccgaccgtttaccctacgtaaaccctacgtaccggacgtaccgtaaccggcccgttaacggccggtaacggtaccgtacggtaaacggtaacggttcgggttaacgggtaccgtttaaacggttttaacgttaacgttacgtaaccgtaacgtaaccgtaattaacccgttttaacgtttaacccgttttaccgtttttaacccggttaaccgtttaaccggttttaaccggggaaccgggtaaacgggtaaacccggttaaggggtacggtaaccgtacgtaaaccgggaacgttaacggttcggtaaccggtaccgttacggtacctaccgttacgttaccgttaacgttcccgtttaacgtaccc

SEQ ID NO: 66118 - DNA, 643 bp, Homo sapiens
  misc_feature: GYAE6OF02F442Q.31.78.H01.1.454.CMB.1.raw
  modified_base (306)..(306): a, c, t, g, unknown or other
  misc_feature (306)..(306): n is a, c, g, or t
  modified_base (476)..(476): a, c, t, g, unknown or other
  misc_feature (476)..(476): n is a, c, g, or t
  modified_base (499)..(499): a, c, t, g, unknown or other
  misc_feature (499)..(499): n is a, c, g, or t
  modified_base (620)..(620): a, c, t, g, unknown or other
  misc_feature (620)..(620): n is a, c, g, or t
tcagcagtagacgtcacgaccggtgctcgatttagtgtgagtagtttgggtttgggggagctacaacaggcaggcaggggcagcaagatggtgttggcagacccaggtcttacattctctgttgctctggatctctggtgcctacggggacatcgtgatgagccagtttccagactcccgtggctgtgtctcgtgggcgagagggccacgactcgaactcgctaacgtccagccagacgttagttttacttcggcccctacctaactaacaactaccttagcttcggaccagacaagaagtagacncgacctactaacgtcctgtacttacgcggtcttaccgaccgggctacgttcccgggttacctaaccgtattcgtagttcggacgtacgggtcgggtcgtacgggtaacccgtatttaccgacgttcctaccaccctagtacgagcacgtcctggacgtaggctagaagtntggtcggtactagtttatacgtnacgagactaacttattacttactttcgttccgttactaccgtttcgggacggtacgggaacgtaagggtcggaagtacgtaaccgaaacgtacgttcgggtacgtccgtacgactaccgtnttaccgtctttaccgtctacccg

SEQ ID NO: 66119 - DNA, 865 bp, Homo sapiens
  misc_feature: GYAE6OF02JD1RC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccgtggctgtcgtactcgtgggcgaggacgggcccaaccgattccaaacttcggacctaaaggttcccagcccaaggtacgttcgttttttaattccgggaccccctaactaaataaccaaacttaccttaagtcgtttacgggtaaccaggccgtaaaggtaaaacggttacgggaactacggtacccttaaccgtaaaacgtcccgtagtaacttttacggtcggggacctttccggtaacccgggctaacggttaccccggggtttaccctaaaaccggtcttttaccgaaggtttcggaccgaacgggtttccggggtacgttacgggggtaacccttagttttacccgacctttccgtaaccgaaccgttaattaccgaagtccgtaacgttacccgttcggaccgtaacgggtaccttaggtaaacgtacgttacgggtacgtacgttaacgtttttacgtaacgttcgttaaccggaacgtaaacgtaaccttaacgtttaaactttccgttttaaccgttttaccgtaaccgttttaacccgggttttcgggaaccggggttaaacggtaacccgggttaaacggggttgacgtaagttaacccgaaacggtacgttacgggtacggtccgtaacggtaccggtaccttaaggttccgttaccgtttcgttaccgttaccg

SEQ ID NO: 66120 - DNA, 770 bp, Homo sapiens
  misc_feature: GYAE6OF02JZ9T6.31.78.H01.1.454.CMB.1.raw
  modified_base (124)..(124): a, c, t, g, unknown or other
  misc_feature (124)..(124): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (457)..(457): a, c, t, g, unknown or other
  misc_feature (457)..(457): n is a, c, g, or t
  modified_base (512)..(512): a, c, t, g, unknown or other
  misc_feature (512)..(512): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttnctctggatctctggtcgccgtacggggacatcgtgatgagcctagtttccagacctcccgtggcttgtgtctcgtgggcgaggacggaccaccatccgaactcgacaacgtccaagcccaaggtagttgtttttacgttccggaccccaacgtaaataaccaacttacttacgcttacggtaaccagactaagaaagtagaccacgtccctaaccgtaactccgtatatttacgnggtccttccgacccggntacgttaccgggtaccctaacgtnttacacgttcgcgtacggtcgggtacgtcgggtaaccctatttccaacgtttacccncaaaccctagtaccaacgcctacgtcccgttacgaccgtacggtcagggtaaacncggttacggtacggtaccttaggtttaaacttccgttaggtaccgacgaactaacgttaactttaactttaccgtttccgtttaccgttacgttaacccggtttacgggtaaccggggtaaccgggttaaaccgaacgggttacgggtaacgtaacgttaaacccgggaaaacggttaccggttacgggtacccgtagttacccgaacggttaacccgaagtttttccggaaccgtttttcgttaccccgttaaccgg

SEQ ID NO: 66121 - DNA, 624 bp, Homo sapiens
  misc_feature: GYAE6OF02HZ459.31.78.H01.1.454.CMB.1.raw
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (341)..(341): a, c, t, g, unknown or other
  misc_feature (341)..(341): n is a, c, g, or t
  modified_base (516)..(516): a, c, t, g, unknown or other
  misc_feature (516)..(516): n is a, c, g, or t
  modified_base (590)..(590): a, c, t, g, unknown or other
  misc_feature (590)..(590): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagngtgttttatgccccanaataacactacttgcttggtaccagtacagtaaaagtaggacacgaccttacctaaactcccgtagtatttaccgtgggtacttcggtacccggntacgttccggggttcctaaccggtattcagttcggcgaggtcggtcgtcggtaacccgtagtttaccgactcgtaccaccgactcgtagccgtaacggcccttgaccgaggtctagaacgtatggtggactagtttatactgtcaagcaacctattacctactttcttaccgttntacccgtttacgggacggtacggtaaccgtagggacgtagtggtaacgtaaacgacgtggttaacggcgttacncgttaaccagttcccgtacgttcgttacctaccg

SEQ ID NO: 66122 - DNA, 575 bp, Homo sapiens
  misc_feature: GYAE6OF02FV0UJ.31.78.H01.1.454.CMB.1.raw
  modified_base (312)..(312): a, c, t, g, unknown or other
  misc_feature (312)..(312): n is a, c, g, or t
  modified_base (354)..(354): a, c, t, g, unknown or other
  misc_feature (354)..(354): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatcggccccacaataacaactactagcttggtaccagcagaaacgtggacagcctcgtaaactcctagactttacngggcttctacccggggcaattcccggggttcctaaaccggtnttcattggcagcgggtctgggacgtatttcacgtctcaccatcagcagcctgcaggctagaagtatggtcgactagtttattactgttaccagacaatactttagtactttctttacgtcctacgtttcgggacggtagggtaaccaagggtcgagtactaccgtaaacggtacgttggtacggctaggtaccgaacctagtcctggttaccttacgtacc

SEQ ID NO: 66123 - DNA, 821 bp, Homo sapiens
  misc_feature: GYAE6OF02IKJ9X.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgcctacggggcatcgtgatgacgcctagtttccagacctcccgtggtcctgtgtctcgtcgggcgaggacgggcccaacactaccgaactgacgtaacgtcccacgacccgaggttacggtttgtttttaacgttcgggaccccctaaccgtaaaagttaaacctaaaccgtttaccttacgtaccgtttacgggtaaccccagaccgtaaaggtaaaacggtagtaacctacggtacccttaacccttaaaccttaccgttagttaacgttttaccgtaggggttaccctttaccggtaacccgggtcctaacgggtttccccgggtttaacctaaccgtacgtttccagtttaccgggtcaacgggtccgggttaccgtacgggtaacccttacgtttaccgaacctttccgttaacccaccgtacttacccgaacgtcctaccggtccgtacggaccgtacggtacgtagtaaagtcgttggtcggtacttaaggtttattaccgtgttacacgtaactaacttacgttaacttcgtttaccgtttcgttacgtttaccggttcgggtacgggtaacggtacccgtaagggttacggacgtaacgttaaccaaacggttaaccgtcggtaacggttaccgtacgtacccgacttagttacccgtttattcccgtctacccg

SEQ ID NO: 66124 - DNA, 665 bp, Homo sapiens
  misc_feature: GYAE6OF02I6AFZ.31.78.H01.1.454.CMB.1.raw
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
  modified_base (495)..(495): a, c, t, g, unknown or other
  misc_feature (495)..(495): n is a, c, g, or t
  modified_base (600)..(600): a, c, t, g, unknown or other
  misc_feature (600)..(600): n is a, c, g, or t
  modified_base (632)..(632): a, c, t, g, unknown or other
  misc_feature (632)..(632): n is a, c, g, or t
  modified_base (647)..(647): a, c, t, g, unknown or other
  misc_feature (647)..(647): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagaggccactatcaacgtgactaagtccagccaggacgttgttttaacgttccggacccctaacgaataaccgaacttacttaacggcttacggtaaccaggactaaggaaaacgtaggacacggtccctaccgtaacgtcctccgtaagtacgtttcgcggttcctaccgtaccgcgtacggttaccccggttacccaactattcgagttcggacgtcggtcggttacggacggtaaccgttnttccncgtaccactaccgaatccgagtcacgtcgagacgtcgcgtaagtaagngttcggtcgtatttgtttaaaccttggacacgtagtaacctaattacgtttaactttccgttacctttcggacctttagggttcccgggaaaggacgttaaccgngtacggaactacgtaaacgcgtaacgtacggntcgactacgtaccgntttacgtcgttactaccg

SEQ ID NO: 66125 - DNA, 745 bp, Homo sapiens
  misc_feature: GYAE6OF02FQV8F.31.78.H01.1.454.CMB.1.raw
  modified_base (350)..(350): a, c, t, g, unknown or other
  misc_feature (350)..(350): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggccacatcaacgtgcaacgtccacgccagtagttgttttacgttcggcccctatacaaactaactaacttacttagcttacggtaaccagacgaaggtaaacgtaggacacgtacctaccgtaaactccgtagtactttacgngggtcctttaccgtacccgggtctacggttcccggggttaaccctaaccggtacttccgtaagtttcggacgtacgggtaccggggtcggttacgggtaccttacgtttaccacccgttcctacctaacccgtagtccgaacggtccacgtccctacggaccgtacggtaccgtaggtaaacgtcgtggtacggtacttaaggttttaactcgttacggtactacgtactaacgttacttactttacctttccgtttacgttaccgttacggttccggaacgggtaacgggtaacgtaggggtacgtaacgtaacgtaaaccggaaacgttaccggttggtaccggtacgtaacggacccgtaaccgttacgttcgtttaccgttaccttacccg

SEQ ID NO: 66126 - DNA, 872 bp, Homo sapiens
  misc_feature: GYAE6OF02IKTRQ.31.78.H01.1.454.CMB.1.raw
  modified_base (718)..(718): a, c, t, g, unknown or other
  misc_feature (718)..(718): n is a, c, g, or t
  modified_base (853)..(853): a, c, t, g, unknown or other
  misc_feature (853)..(853): n is a, c, g, or t
tcagcagtagacgtcacgaccggtgctcgatttagtgtgagtagtttggggtttggggggagctacaacaggcagggcaggggcagcaagatggtgttgcagacccaggtcttctatttctctgttgctctggatctcgtggtcgccgtacggggacagtcgtgatggacgcctagtttccagtacctcccgtggctggtcgtctcgtgggcgaggtacgggccaaccgtactacgaacgtcgaccgtaacggtccgaaccggaccgtaaaggttacggttttacgttttttaaccgtttccgggaacccccctaaaaccgtaaaacgttaaaacctaaaaccgtttaaccgttaacggttaccctttaacgggtaaacccgaacggtaccgtaaagggtaaaacggttaacgggaacctaacggtaccccctttaaacccgttaaaacgtttcccgttaacggtttaacttttaaccgggtcggggtttaccctttaccccgggtaaccccggggtaccttaccggggtttaccccggggtttaacccctaaaccgtacgtttacgtacggttacggtaccggacgggttccgggttacggtacgggtacccgttattcccgacttcctaccgacctactaccgacgtaacctacgtcccgtacgtcggacgtacggtagaaacgtcggtggtaccggtacttagtttacgttacgngttacactacgtaacttaagtttcttacgtttccgttagtacgttaccggtcgggaacggacggtaacttagggtcgtaacgtacgtaaccggaagtacgtcgggtaacgtacggtacttaccggactttccggnttacgtaccctgtaccccg

SEQ ID NO: 66127 - DNA, 889 bp, Homo sapiens
  misc_feature: GYAE6OF02I5ORN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggaccagtcgtagactggaagccctaggtttccagtacctcccgtggtcgtgttgtcgtcgtgggcgaagacgggtcccaaccgatcgaacgtgcctaaggtccgactaccgaggtagtttgtttttacgttccggacccccacaaaattaaccgaacttaacgttacgtccgttacggtaaccacgacgtaaacgaaaggttacggaccacgtaccctaccgtaaaccttccgtagttaactttacggtacggtaccttaccgtacccggggtactacggttacccggggttaccttaaaccggtcgtttcctaacggttcggtacgtaaccggggttcgggttcggttacggggaaccccgttactttccgaacctttcccgaacctacccgtagtccgtaagcctacggtccgtacggcgtaacggtcgtaaaggtaccggtaggttacggtagggtacctttaacgggtttaacttacccgttagggtacccacggtaaccgtaaacgtaacgttttaaccttaccggttttccgttttaccggtaaccggttaccggtttaacgggtacccggggttaaaaccgggtacccgggtaagggtttacccgggtacgttaaacccgggtaaaaccgttaaccggttaaacggtttccggtaaccggtttaacggtacccgttaaaccgtacggttaaacccgtttccggttacggtttaccccgttaatttaaccccgg

SEQ ID NO: 66128 - DNA, 769 bp, Homo sapiens
  misc_feature: GYAE6OF02G0WVF.31.78.H01.1.454.CMB.1.raw
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccgatcaactgcaagtccagccagtagttgttttaacttcggccccaaccaataacaactacttagcttacggtacagcaagaaagtagacagcccttacctaaacctcctagtactttacgngggtcctttaccgtacccgggctacggttcccggggttacctaaccggtattccagtttcggacgacggtcggggttacgtacggggaacccgttacgtttccaacgttccgtaccgtaaccctactaccgtaacggtacccgtaacggtcccctggaaccgtacgggtaccctaagggtaaacgtaacgtttcgggtacgggtacgtttaggttttaacttaaccgtttcgtaaccgtagtaacctaaaccgttatttaactttaccgttttaccttttaccgggttacctttaacccgggttttcccgggaacggggttaccgggtaaaacccggtggggttaaccggtagtaaaccggttaaccgtaaaaccggtaacggttcggtaacggtaccgttggaccctaacggtactccgttaaggttcctacgttaaccc

SEQ ID NO: 66129 - DNA, 699 bp, Homo sapiens
  misc_feature: GYAE6OF02JEBI8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactcctggctgtgtctcgtggcgagcgggccacatcaactgcaacgtccagccagtagttagttttacttccggaccccaactaaataacaacttaacttagtcttggtaaccagcaagaaagtcgaacagtaccctctaaactctagtattcgtggtacttccgtaccggctacgttcccgggttacctaaccggtcttactagttcgacgtacggtcgggtacgtacggggtacccgttatttccgaaccttccgtaccaaccctagttaccacgcgtacgtccgttacgcgaaccggtcgtaacggtaaagtcgttagggtcggtacgtttaaggttttaccttacgttaccgtacgactaaccgttaacttaagtttaaccgtttaccttttcgtttaccgttacgttaccggttttacgggacggtaccgggtaaccgtaagggtcgtaacgtacgtaaccgtaaacggtcttacgggcgtacgtagacctaacttcgtactttacgtccttacgtacccg

SEQ ID NO: 66130 - DNA, 659 bp, Homo sapiens
  misc_feature: GYAE6OF02GSROD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctggtgtctcgtgggcgaggacgggccaccatccaacgtgacaagtccagccaggtagttgttttattcggcccccaacaataacaactacttagcttcggtaccagcaagaaagtacggacagccctacctaaactcctagtactttacgtggtccttccgtacccgggctacgttcccggggttacctaaccggtacttcaagtttcggactacgggtcgggtcgtcggggaaccgtactttccactcctccacctactccgaacgtcacggccgtgaccgtacgggcgtaggaagtacgtggtcggcttaaggttttacttacgttgtacagtacaacctatttactacctttacgtttccgtacgttacggtttaccggggcgggtaacgggtaccgtaagggaggtacgtaacgtaacggaaaacgtacgtggtcggtactcgacaccgtactcgtacttccgttactaccg

SEQ ID NO: 66131 - DNA, 627 bp, Homo sapiens
  misc_feature: GYAE6OF02HFX98.31.78.H01.1.454.CMB.1.raw
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (368)..(368): a, c, t, g, unknown or other
  misc_feature (368)..(368): n is a, c, g, or t
  modified_base (430)..(430): a, c, t, g, unknown or other
  misc_feature (430)..(430): n is a, c, g, or t
  modified_base (622)..(622): a, c, t, g, unknown or other
  misc_feature (622)..(622): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagtcttggtaccagtcagaaagtggacacgccctactaaactcctagactttacgngggtccttccgtacccgggntacgttcccggggttacctaacccggtnttaccgagtttcggcgtaggtccgggtctacgggaccgtactttccgaccttctaccaactntaccagtaccacgtcctgcgaggtctaggaagtatggacggtctagttttactacgtgtcagactaacgtattaacttacctttctttacgttacgttacgtttcgggacgggtacggtaccgaagggtgtacgtataccgtaaacgtacgttcggtacggtctacgacctacctagttcctgttacccttntaccg

SEQ ID NO: 66132 - DNA, 742 bp, Homo sapiens
  misc_feature: GYAE6OF02IHAYE.31.78.H01.1.454.CMB.1.raw
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggaggccaccatcaactgcaagtccagccagagttgttttacttggacccccacaaataaccaactacttagcttaggtaccagcaagaaagtaggacagccctactaaactctagatttacgnggtcttcgacccggntacgtccgggttaccaacgtnttnacgttgcaggtcggtgtcggtacgtactttcgacttcacaaccnctacgacgcacgtccgcgacgacggtactaggaagtacgttgggtacggtacttaagttttaacgtttacgtacggttactaaccgtacgtaaaaccttaacgtttaaccttttaaccgtttttaccgttttaaccgttacccgtttaaccccgggtttttaccgggaaccggggtaaacgggggaacccgttaaaacgggggttacgggtaaaccggtaaaccgtttaaaccggaaaaaaccggttaacccggttcggggtaaccgggttacccgttaagggtacccctaaaccgtaaactttccggtaccggttttacttaccccgtaaccg

SEQ ID NO: 66133 - DNA, 738 bp, Homo sapiens
  misc_feature: GYAE6OF02JMP1N.31.78.H01.1.454.CMB.1.raw
  modified_base (469)..(469): a, c, t, g, unknown or other
  misc_feature (469)..(469): n is a, c, g, or t
  modified_base (711)..(711): a, c, t, g, unknown or other
  misc_feature (711)..(711): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacagtcgtgatgacgccgtagtttccgacgcctccgtggctgtcgtctcgtgggacgaggacggccacatcaactgacacgcacgaccagtacgttgtttacgtccgaccccacgaaactaacactaacgttacgacgttacggaacctacgacgtaagtaagtacgacgacgtcctaacctaacgtcctagtacttacgcggtctaccgtacccggctacggtcccgggttaccaacgtagtactagtcgtacgacggtacggtcgtacgggtaccgttactcgaccttacgacctaccgtacttacgacggtaccgngtacccgtgaccggaacggtcgtaacgaagttaggtcggtaccgtagtttaactttacgttccgaacggttcaacgtaactaccgttaaattttccgtaccgttttagtttaccccgtaattttccgggtttaaaccgggcggggttacggaaaccgtaacggggttactaacgggtaacttaaaccgtaaggtaaccttagggggtaccaagggttacccacggtaaccgttacccggttntttaaccggttccgttaccgtaacccc

SEQ ID NO: 66134 - DNA, 819 bp, Homo sapiens
  misc_feature: GYAE6OF02GOO28.31.78.H01.1.454.CMB.1.raw
  modified_base (185)..(185): a, c, t, g, unknown or other
  misc_feature (185)..(185): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtntctcgtgggcgagacggccaccatacaactgcaacgtccagccagtacgttgtttttacgttcggacccccaactaaactaaaccgtaacttacttagtcgttacggtaacccagaccaaaggaaaacggtagggaacaacgtcccgttaaccctaaaaccttccgtagtaacttttaccgtcggggtcctttacccgtaccccggggtactaccggtttcccccgggggtttaacccctaaaaccccggttacgtttccgtaaacggtttcgggacccgtaacggggtcccgggggtttaccggttaccgggggtaaaccccgttcgtttttacccgaaccgtttcccttacccggtaaccctaactacccgaacggtaccctacggaccccgtttaggacccggtaccgggtaccgtaagggtaaacggtaacggttcgggttaagggtcgttaacgtttttacttacgttacggtcctaacgtaactaaaccgttaattacctttaactttaccgttttccgttaacgttaccgttttaccgggacgggtaacggaccgtagggtgtagactaacggtaaacgtaccggttggtacggtcgtcgactacgtcttacgtcgttcctactccg

SEQ ID NO: 66135 - DNA, 836 bp, Homo sapiens
  misc_feature: GYAE6OF02JLK37.31.78.H01.1.454.CMB.1.raw
  modified_base (758)..(758): a, c, t, g, unknown or other
  misc_feature (758)..(758): n is a, c, g, or t
tcagcagtagacgtcacgaccggtgctcgatttagtgtgagtagtttggtttggggtaggcgtacaacaggcaggcacgggcagcaagatggtcgttgcagaccaggtcttcatttctctgttgctcgtggactctcgtggtcgccgtacgggacagtccgtagatacgacgcctacggtttccagaccttcccgtggccttggtcgtctcgtgggacgtacggcggaccacgtacacacgtcgtacgtacgtccgacgtaccgagttacgttacgtttacgtaccgaccctaacgttaactaaccgtaacgttaacgtcgttacgttaccggtaccgacgaaccgtaacgtaaccggttacggacctaccgtaccttaaccgttaacttccggttagttaaccgtttcggtaccggttccgtttaaccccgggaccggtaaccttacccggggttttacccgggttaaccctttaaaccggtacgtttaaccggttcggtttaccggacggtacccgggtttcggggttacccggttacgggttaacccgttacggtttaacccgtacgttcccggtaaccctacgttaccgtacgtaaacgccgtaccgttaccggacgtaccggtaccggtacgtacggtaaacgtcggtaccggttaaggttactttacggtttacgttacgtacgtagtacgtaactacgttattacgtttacttcgtttacgtcgttaccggttcgaacggtacgtaacggngtacggtagacgtaacgaaccggttagtacgtcggtacgtagtaccgtacgtcgttacctcgtttaccgcgtttaccc

SEQ ID NO: 66136 - DNA, 781 bp, Homo sapiens
  misc_feature: GYAE6OF02GWOK8.31.78.H01.1.454.CMB.1.raw
  modified_base (230)..(230): a, c, t, g, unknown or other
  misc_feature (230)..(230): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgcctacggggacatcgtgatgacgcctagttccagtactccctgctgtgtctcgtgggacgaggaggccgaccatcaactggacagtccanccgagtagttgttttacgttccggcccctaacaataaccgtaacttaccttagtaccgttagaaccagtacgaaaggtaacgtaaggaccacgtacccttaaccctaacgtcctacgtacttaccgtaggtccttaccgtacccgggacttaccggtacccgggttaccaacccggttattaccgaagttcgggaccgtacggtccggggttcgtacgggtaacccttagttttaccgaccgttacaccgtaacccctagccgtaacgcctaacggtcccgtagaccggacggtacgtacggagtaagtcggtacggtacgtttaagtttacaccggttgtaaccgacgtacctaaagtttaccgttaattttaccccgtttcgttttaaccctacccgtttaccgggttaccgggaccgggttaaccggtaaacgttcggggtaagtacggtaacgtaacccggtaaaacgttacggttacgggtccgtaaccggttaactacccgttaaccgtacgttaccggtacgttttcccgtaacccgttacccg

SEQ ID NO: 66137 - DNA, 916 bp, Homo sapiens
  misc_feature: GYAE6OF02H0VSR.31.78.H01.1.454.CMB.1.raw
tcagcagtagacgtcacgaccggtgctcgatttagtgtgagtagtttgggtttgggggagctacaacaggcaggcaggggcagcaagatggtgtgcacgaccaggtcttctatttctcgttgttgctcgtggatctcgtggtcgtaccggtacggggacagtcggtgagtggacgcctacggtttccaacggtaccctccgtggtcttggtcgttcgtacggtgggacgaaggggaccggaccctaaccgtaattaccgtaaacgtcgaaccgtaaccgtccgaagtaccgtaaggttacggtttttagtttttaaccgttcccgggaacccccctaaaacgttaaaactaaaaaccgtaaacctttaacgtttaacggtaccgtttaccgggtaaacccaggtaaccggaaaaggtaaaacgggtaccggtaacgaaccccggttaccccttaaaaccccgttaaaaaccgtttccggtttaacggttaaacgtttttaacccggtccgggtttaaccctttaccccggggtaacccggtacgtacccggttacccgggttttaacccaaacgttcttacgtacgttcggcagggttccggtagtaccgggaacctttagttcccactaccgtccaaacccgttgaacgtacgccgtacgtccgtacgtaccggtagtaccgtaaggtaaccgtaggtcggtaacggtacgttaacgtttaacttacggtacttacgtaacgtaactaacgttaactttacttacgtttaccgtttccgtttaacgtccgttaacgggtaccgggtaaacggtaacgtaacgggaacgtacggtaacgtaaccggtaaaacggtccggtaggtacgtaccgaccgtaccgtaccgtacgttccgttcttaccgttcttaccccgg

SEQ ID NO: 66138 - DNA, 583 bp, Homo sapiens
  misc_feature: GYAE6OF02FW2QF.31.78.H01.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (413)..(413): a, c, t, g, unknown or other
  misc_feature (413)..(413): n is a, c, g, or t
tcagcagtagacgtcacgaccggtgctcgatttagtgtgagtagtttgggtttggggggagctacaacaggcaggcaggggcagcaagatggtgttgcagacccaggtccttcactttctctcgttgctctggatctctggtgcctacggggacatcgtgatgagccagtttccagactccctggctgtgtctctgggcagngggccacatcaactgcaagtccagccagngtgtttattggccccacaataacaactacttagcttaggaccagcaagaagtagacagcctctaaacncctgatttacngggcttcacccgggnagttcccgggtacctaacgnttcattcggactaggcgggtctgggaccgtatttccactcgtcaccatcagcacgctgcagtcagaanatgtggctagtttatacttgacagaccaatatttaactcgtttactttccgtacttacgtttccgggaacggtacgggtaacccaaggggttgtagacgttaccgaaaaggtaccttacggtaggtccgtacggctaaccctagtccgtttacgttcctttacgtacccg

SEQ ID NO: 66139 - DNA, 698 bp, Homo sapiens
  misc_feature: GYAE6OF02GBIVR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagcctcctggctgtgtctcgtgggcgagacgggccaccatcaactgacaacgtccagccagtagttgttttattccggccccacctaataaccaacttacttagtcttggtaccagacaagaaagtaggacacgcctactaaacctcctgtatttaccgtcggtcttccgtacccggtctacgttcccgggttacctaaccgtacttaccagttggccgacggtcgggtcgtcgggtacccgtactttcctactcctacctaccctactaccgtacgccgaacgtcctacggccgaacggtcgtaggaaggtaacttcgggttacggtacgttaggttttaactacgtttcgtacgacgtaacctaaacttactttaaccgttacctttacccgttttcgttaaccgttccggtttaccgggaacggaaccggtaaccggtaacgggtggactacgtaaccgtaaacggtaacgttggtacgtccgtaagccgaacctaccgttactccgtttccgttactaccccg

SEQ ID NO: 66140 - DNA, 700 bp, Homo sapiens
  misc_feature: GYAE6OF02IR54I.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactcccgtggctgtgtctcgtgggcgagacgggccaaccatcaacgtgacaacgtccagccagtagttgttttagttcggacccccaacaataaaccaacttacttagcttaggtaccagacaagaaagtacggacacgaccctactaaactcctagtatttacgtcggtccttaccgtacccgggctacggttcccgggttaacctaaccgtattccgtagttcggacgtaggtccgggttcgtacggggtaccttatttaccgaccgtcctaccaacctactacgacgtccacgtcccgtagacgacggtacgtagaacgtacgtcggtcggtacttaaggtttacttacgtacgtaccgtaacgtacctaacgttaatttacctttaaccgtttccgtttaccgttaccgttacggtttaccgggacgggtaacggtaccggtaaagggtcgtacgtaacgttaccgaaacggtcggtaggtccgtactacgtacctacgtacttcgtcttacgtcttacccg

SEQ ID NO: 66141 - DNA, 851 bp, Homo sapiens
  misc_feature: GYAE6OF02FMLK2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggacattcgtgatgacgcctacgtttccagacctccgtggtctgtcgtcgtcggtgggacgaggacggcccaaccactaccaacgtcgacgaacgtaccgacgtaccgagttaggtttcttttaccgtcccgaacccctaactaaacttaaacctaaccgttcttacgtccgttaacgaaccgaagaaccgtaaaggtaaacggtaacggaccaacccgtacccttaaccgttaaccttacgtagttacgttacggtccggttaccgttccggtaccggtacgttacgggttacccggttacctaacgttctacgtcggtacggacggttaccgggtacggttaccggtacggtaaccgtttcttacccgaactcccgtaaccgtacacggacgtcctaccggtacgtccggtaacggtcggtaacggtagttacggtaagttcggttaacgtacgtttacggtttaacgttacgtacgttacaccgttaataaaccgtttacttttacccgtttacgtttacccgtttacgtttaaccgttacgggttaacgggtaccggggaaacgtttaacccgggaaagtaaccggttaacgtacggtaaacgtaccggtttaccgggactttaacgggaccgttaaccctaccgttaccggttaacctttccggttacccgtacctttaaccccggtgttaacccccg

SEQ ID NO: 66142 - DNA, 737 bp, Homo sapiens
  misc_feature: GYAE6OF02F7QDO.31.78.H01.1.454.CMB.1.raw
  modified_base (249)..(249): a, c, t, g, unknown or other
  misc_feature (249)..(249): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgcctacggggacagtcgtgatggagcctagtttccgagtacctcccgtggccttgtcgtctcgtgggcgaggacggccacatcaactgacaacgtccacgccagtagttnttttacgttccggaccccaactaataaactaaccttacgttaacgtcttacggtaaccagacgtaaggaaaaggttacggaacacggtacccttaaccctaaacgtcctagttacttacgtcggtccttaccgtacccgggctaccggttcccggggttaccttaacggtacttctacgttcggccgacgggtccgggtcgtacgggaccgttacttacgtaccttctaccaaccgtacgtacacgccgtacgcccgtacgaccgacggtacgttaacggaagtacgtcggtacgggtacttaacgtttacgtacgttcgtactacgtaactaacgttaactttaactaccgttttcgtttaccgttaccggttaacgtttccgggaaccggtaacgggaacgtacgggtaggaactacggtaacgtaaacggtacgtcggttacgacgtacgaccgttactacgtccgttacgtacccgttactccg

SEQ ID NO: 66143 - DNA, 760 bp, Homo sapiens
  misc_feature: GYAE6OF02GREJ7.31.78.H01.1.454.CMB.1.raw
  modified_base (536)..(536): a, c, t, g, unknown or other
  misc_feature (536)..(536): n is a, c, g, or t
  modified_base (609)..(609): a, c, t, g, unknown or other
  misc_feature (609)..(609): n is a, c, g, or t
  modified_base (612)..(612): a, c, t, g, unknown or other
  misc_feature (612)..(612): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatcctctggtgccgtacggggacatcgtgatgagcctagtttccagtacctcccgtggctgtcgtctacggtgggaccgaggacgggacccaccgataccaactcgacctaaacgtcccgagaccgtaagtaggtttacgtttttaacgttcccggaccccctaaacctaaataaaaccctaacgttaaccttacggtaccgtttacggtaaccgaagtaaccggtaaaggtaaaaggtaacgaccgtaaccgtaccccttaacccgtaaacttccgtagttaacgtttacggtcggttcccttaccggtacccgggtactacccggttaccccgggttaacctaacggtactttacgagttccggacgtacgggtcgggttacgtaccgggtacgttacttacccnctctacccacgtagtccgacgcctacggctacggagacgtcgaagtagacgtgtacgtagtttagttctagtntanacgtaacctatttaccttagttacctttcggttaacgtcgttaacgggttcccggaagggtaacgacggtaaggtagtaactaacgtaacggtaacgtaggtcgacgtacgtacacgtactcgttaccgtcgttaccgtacttacccg

SEQ ID NO: 66144 - DNA, 747 bp, Homo sapiens
  misc_feature: GYAE6OF02FTWK3.31.78.H01.1.454.CMB.1.raw
  modified_base (389)..(389): a, c, t, g, unknown or other
  misc_feature (389)..(389): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagagggccaccatcaactgacaagtccagccagtagttgttttacttcggacccctaaccaataaccaactacttagcttacggtaccagacaaggaaagtacggacacgaccctacctaaactcctagtaactttcgtcgggtccttaccgtacccgggctaacggttcccggggttacctaaccgtnttactacgttggcgaggtcgggttcgtacggggtaccgtactttccgacttcctactaaccctagtaccagtccgacgccgtcgcgaacggtctaggaacgagtacggtagtacgttaagtttacgttacgttacgtacacgtacctaaacttacgtttaacttacgttttaccgtttaccgttaccgttaccgggttttaccggggaccggggttaaacgggtaacccggtaaggggttacgggtaacggtaacgttaaccggtaaaaccggttaacgttacggggttaaccggtacgttaccggtaccgttaaccgttacgtttaccgttacggtttaccctttaccgttaacccg

SEQ ID NO: 66145 - DNA, 691 bp, Homo sapiens
  misc_feature: GYAE6OF02HFRIO.31.78.H01.1.454.CMB.1.raw
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (659)..(659): a, c, t, g, unknown or other
  misc_feature (659)..(659): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggactatcgtgatgagccagtttccagactccctggctgtgtctcgtgggcgagagggccaccatcaactgccaagtccagccagtagttgtttttattcggacccctaacaaataacgaacttacttagccttaggaccagccaaggaaaagtgacacgccctaacaaactcctgtattaccgnggtccttacgtacccgggntaacggttcccgggttacctaaacgtcttactattcggctagggtcggtcgtcggaacccgtatttcacgttcctacaacccgtataccagccgtaacgtcccgtagtcccgaagggtcctaaggtaagacggttacggtacgggacttaacgggtttttacttaaacgttcggtaactaacggtaacctaaacgttacgtttaattacctttccgtttacttacggttacctttcgggggaagtaccgggtaaccgtagggttacgaagttacgtaaccggaaacgtacggttaggtcgaccggttanacccggtactacttacgttctactattacccg

SEQ ID NO: 66146 - DNA, 803 bp, Homo sapiens
  misc_feature: GYAE6OF02H958Z.31.78.H01.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (402)..(402): a, c, t, g, unknown or other
  misc_feature (402)..(402): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatgacgccgtagtttccagtacctcccgtggcttggtntctcggtgggcgaggacggcccacgtatccaactgactaacgtccacgcagtagtttnttttacgtccggaccccactaaactaactaacgttacttacgtcgttacggtaaccagtacgaaaggtaaacgtacggaactacgtaccctaaccccttaaccgtccttacgtacttacggtccggtccttaccggtacccccggnttacccgggttaccccgggtttacctaaaccggttacttcgtaacggtccggaccgtcggggtccgggttacggtccgggtaaccctttacttaccgtacctacgttaccacgtactcgcgtaccgacgtccgtcggaccgtaacggtaccgtaaggtacgttagtcgggttacggtaactttagttaccgtttagtacgtcgtaacgtactaacttaagttttaccgttccgtttacccgtttaccggttaccgttacccgggtttagggacccggggtaaacgggtacgggtttaacgggtacgtaacggttaactaacccgggtaaacgttcggtcgggtccgttaccgtacgtaaccctaccgtagtttcccggttactttcccggtacttacccgg

SEQ ID NO: 66147 - DNA, 793 bp, Homo sapiens
  misc_feature: GYAE6OF02H55YA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcctacggggacagtcgtgatgagcctagtttccagacctcccgtggtctggtgtcgtcgtgggcgaaggacgggcccaaccgatcgaacgtgactaacgtccagccgaaggtacgtttgtttttacttcggaccccctaaactaaactaacctaaacttacgttaggtccttacggtaaccagtaaccgaagtaaacggtacgactaacgtcctaaccctaaaacttccgttagtaactttaccggtcgggtccttaccggtaacccgggtctaccggttcccggggtttaacctaaaccggtacttacgtagttcggaccgtacggtccggggttccgtacggggtaaccctagttttaccacttccgttaccaacccgtatccgaacgtaccgacggtccctcggacgtacggtacgtaaggtaaacggtagttacgggttcgtaacgtttaagtttacgtttacgttcgttacgactaacgtaaacttagtttaacctttcgtttacccgttttaccgttaccgttaccggtttcgggtaaccgggtaacggtaaaccggtagggtacggtaacggtaacgtaacggaaacgtacgttaggtcgtaccgtacgtacctacgtaacttcgtacgttacctagtttaccccg

SEQ ID NO: 66148 - DNA, 762 bp, Homo sapiens
  misc_feature: GYAE6OF02HLE8N.31.78.H01.1.454.CMB.1.raw
  modified_base (468)..(468): a, c, t, g, unknown or other
  misc_feature (468)..(468): n is a, c, g, or t
  modified_base (740)..(740): a, c, t, g, unknown or other
  misc_feature (740)..(740): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacgggacagtcgtgagtgagtcctagtttccagacctccgtggctgtcgtctcgtggcgagacggccaacagtccaactgacaacgtccaaggtccaaggtagttacgtttttacgttccggaaccccctaaactaaactaaaccgtaaccttacgttacgacctttacggtaaaccctagaaccgtaaaaggtaaaacggtacggtaaccgaaccggtccctaaacccttaaacgtcccgttaggtaacttttaccggtcggtaccctttacccggaacccgggtacttaaccgggtttccccgggttaaccttaaacccgtntttccgaagttcggacgtacgggtcgggtaccgtagggtaacccttaagtttccgaacctctaccctaactaagtccacggtccaccgtaccgtacgaccggaaggtccgtaaagaacgtaacgtacggtacgtacggttaacgtttaacgttacgtcgttacaacgtactaagttaattacgttactttacgtcgttactacgttaccggaggtacgaaacgtagtagtacgtactaaccgaaagtcgtaggtacgacgtagaccaacgtntaccgttattaccgtactaccg

SEQ ID NO: 66149 - DNA, 722 bp, Homo sapiens
  misc_feature: GYAE6OF02FLNOW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaaccatccaactgcaagtccagccagagttgtttattcggccccacaataacaactacttagcttgaccagcagaagtagacagccctactaaactccagtatttacgcggtacttcgaccccgggctaacgttcccggggttacctaaccggacttcgtacgtttcggacgtacggtcgggtcgttacgggggaccctacgttctactcctcgaaccctagtcaaggccaacgtccgtagtacgacggtacggtaacgaaagtacgttcgggtacgtacgttaaacgtttaagtttaacggtcgttaccgaacgtacctaaacgttaacttttacgttaccttttcggttttacccgttacttaccggtttcgggtaaccgggtaacgggtaaccgttaaggggtacggtacgtaagtaacccggtaaaaccggtaacgttcggggtaacggtccgttaccgggtaccctaaccgtaaccgttccggtttaccggtttacccttaccgttaaccc

SEQ ID NO: 66150 - DNA, 667 bp, Homo sapiens
  misc_feature: GYAE6OF02GB5DF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttaggtaccagcagaaagtaggacagcctaccctaaactcctgtactttactgggacctttaccgtacccgggctaacggttcccggggtttaccctaaacccgtatttccagtttcggaccaggtcgggtccgtaggggaccctatttaccgactcctaccaccatccagctagccctgacagggtactaggaaagagtggtaggtacttaagtttaacttacgttgtacgaagtacctaaacgtactttaatacctttctttaccgttcttaccgtttacgggacggtaacgggtaacgtaagggtaggtacgaacgttaaccgaaaaccggtacttacgggtacggtaccgtacggtaacccaccgtagttaccgttcgtttaccgttaccttaaccg

SEQ ID NO: 66151 - DNA, 703 bp, Homo sapiens
  misc_feature: GYAE6OF02IH5O4.31.78.H01.1.454.CMB.1.raw
  modified_base (508)..(508): a, c, t, g, unknown or other
  misc_feature (508)..(508): n is a, c, g, or t
  modified_base (685)..(685): a, c, t, g, unknown or other
  misc_feature (685)..(685): n is a, c, g, or t
  modified_base (692)..(692): a, c, t, g, unknown or other
  misc_feature (692)..(692): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggactatcgtgatggacgtccgtagtttccagtacctcccgtggtcttgtcgtcctgtcgggcgaggacggccctaccagtcaactcgacaacgtcacgacgtagtaggttgtttttacttccggacccctaactaaaactaacctaaaccttacgttcgtacggttacgtaaccgagacgtaagtaaaacggtcgaacaacgtccctaacctaaactccgttagttaacgtttacggtcggtacccttaccggtacccgggtctaaccgggttcccgggttaacccctaacgttacttacgtacggtcggaccgtaggtccgggtcgtacgggtaccctacttcgacctctaaccactntacgcacgtacgtctacggacgcggtataggtaacgtagtcgtaagtacttagtttacttgacgtactacgtactaacttagttacttaccgtttcgttaccgtgttaccgttcgggacggtagtaacgtaggtagactacgaactaacgcgttaggtccgtctacgaccgtacgtntacgttntccctagtccc

SEQ ID NO: 66152 - DNA, 899 bp, Homo sapiens
  misc_feature: GYAE6OF02G904J.31.78.H01.1.454.CMB.1.raw
  modified_base (399)..(399): a, c, t, g, unknown or other
  misc_feature (399)..(399): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttcagactccctggctgtagtctcgtgggacgaggacgggccaaccgattaccgaacgtgacctaaacgtccagcccagtagttgtttttaacgttcggaccccctaacaaacgtaactaaccttacttacggcctttacgggacctagaccaagtaaaacggtacggaacacggacccttaccttaaaacctccgtagtactttacgtcgggtccttaccggtaccccgggntacggttcccgggggtttaccaaccggttacgttaccgtaagtttcggaccgtacgggtaccggggttccgtacggggtaaccccgtacgttttaccaccggttaccttacccgacccgtagtttaccgaacggtccgaacggtcccgttacgggaccgtaagggtccgtagtaaaacggtcgttagggtccggaacggtttaaccggttttaaacggtttaccgttaggttaacccgtaacggtaaccgttaaaccgtttaaagtttaacccgtttaaaccttttaccgggtttttaccgttaccgtttaacccgggtttttacggggaaccggggtaaaccgggttaaacccgggtaaagggtttaccggaacgggtttaacccttaaaccgggtaaaaaccggtttacccgggttacgggtttaaccggccgttaccggtaccccttaaacgtacggttttacccgtacggtttacccttaccgtttaaacccccgg

SEQ ID NO: 66153 - DNA, 892 bp, Homo sapiens
  misc_feature: GYAE6OF02HBY3Y.31.78.H01.1.454.CMB.1.raw
  modified_base (686)..(686): a, c, t, g, unknown or other
  misc_feature (686)..(686): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatcctctggtcgccgtaacggggacatcggtgatggagcctagtttccagacctcctggctgtgtctcgtgggcgaggaggccacatcaactgacaagtccagccaagtcgtttgttttacttccggaccccctaacgaaactaaacctaacttacttacggtaccgttacggtaaccagaccgtaaaggtaaaaacggtaaggggacctaacggtaccccttaacccgttaaaaccttccccgttaaggttaaactttttaacccggtggggttaccccgtttacccgggtaacccccgggggtacgttaaccggtttacccccggggggtttacccttaaaacccggtaacgtttaccgtaacgtttcgggaccgtaacggggtccggggttaccgggtaccgggggtaaccccttacgttttacccgacgttacccttaccgaaaccctacgtaccgtacgtcccgaaccggtcctacgggaaccgtacgggtcgtaacgggaaagttacgtgggtacggtacgttaaaggtttttacttaaccgttacggtanaaccgtaaccttaaacttaacttttaaccgttaccttttaccgtttaccgtttaacccgttcgggtttaccggggaacgggtaaacgggtaaccgttaaggggtacgggaacttaacggttaaccggaaaaacgttaccggttaggtacccgggtacgttacgcccgtaaacgtcgttaacgtttcccgtttagttacctacccgg

SEQ ID NO: 66154 - DNA, 659 bp, Homo sapiens
  misc_feature: GYAE6OF02HLIPB.31.78.H01.1.454.CMB.1.raw
  modified_base (633)..(633): a, c, t, g, unknown or other
  misc_feature (633)..(633): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgtctctggatctcgtggtgccgtacggggacatcgtgatgagccagtttttttttttaccagacctccctggctgtgtctcgtgggcggaggacggccaccactacaactagacacgtaccacgaccagtagttagttttacgttccggtaccccaacctaaactaacctaacctaacttacgtacgttacggtaccacgacgaagaaaggtagacacgacctacctaacctacctacgtacttacgtcggtactaccgtaccggtacgtacgtaccgggttaccgtaaccgtacttactagtacggtacgacggtcgggtcgtcgggtacgtacttctactacctacacctactacgactacgacgtactcggacgaacggtactagaaacgtgttacgggtcgtacgtagttttacgtacgtacgttccgagtactacgttattacttactttctacgtcttacgttcggaggacggtacgagtgatagtaactaacgactaggtgcgnacgtacctaggtctacgtactcctac

SEQ ID NO: 66155 - DNA, 897 bp, Homo sapiens
  misc_feature: GYAE6OF02J25LU.31.78.H01.1.454.CMB.1.raw
tcagcagtagacgtcacgaccggtgctcgatttagtgtgagtagtttgggtttgggggtagcgtacaacgaggcaggcaggggcagcaagatggtgttgcagacccaggtcttcactttctctgttgctctgatctctggtgaccgtacgggacatcgtgatgacgccgtagtttccaacgtccgtccgtggtctcggtccgtccgtcgtacggggccgacggacgggcccaccgtactaccgaacgttcgaccgtaaacggtcccacggaccgtaacgttggttttacgtttttaacgttcccggaccccctaaacctaaactaaacccttaaccgttacgtaccgtaccgttacggaccaacgacgtaaggaaacggtacggaccctacggttacccgttaacctaaccggttccttaggttaaccgtttacggtcgggttcccgtttaccggtaccccgggtcgttaaccgggtttacccgggtaaccgttaaccgtacttcgtacgttacggccgtacgggtccgggttaccgtacgggtaccgtactttacggacctaccgtaccgtaaccgtctacgtacgaccgtacgtcccgtaggttaaccgccgggttaagtaagggtacgggttaccaaggggtttccgaacggttttacttaacgtttaccgttcccggaactcgggttaaacctacgtttactttacgtttaccgtttaccgtttaccgaccgtttaacggttcccgggaaaaccggtacggtaaccggttaggttcgaaccggtttacgtaaaccgggttaccggtacggttacgggtaccctaccgggttaaccttaccgttaccgttaacggttcccgtttacccgttaaccggttcccctttaaccccgg

SEQ ID NO: 66156 - DNA, 785 bp, Homo sapiens
  misc_feature: GYAE6OF02JKTUL.31.78.H01.1.454.CMB.1.raw
  modified_base (233)..(233): a, c, t, g, unknown or other
  misc_feature (233)..(233): n is a, c, g, or t
  modified_base (536)..(536): a, c, t, g, unknown or other
  misc_feature (536)..(536): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgcctacggggacatcgtgatgacgcctagtttccagacctccctggcttgtctcgtcgtgggcgtacggacgggacccaccaagtccaaaccgngtccaacgtcccaggccctaagtacgtttcgtttttagttcccggaccccctaacctaaactaaacctaacttaccgttaagtccgtttacggtaaccagctaagtaaaggtacgacacgtccctacctaaactctagtatttacgcggtcttccgtaaccggtcgtaccggttccgggttaccttaacggtacttcgtacgttcggacgacggtcggttcgtacgggtaccttacttccgtactcctacctaccattccgacgaccgtacgtcctaaggaccgtaggtcctaaggaacgttnttacggacgttaccgtttaggtttaacctacggttacgtaccggtaacctaacgttaaccgttaatttaccgtttacccgttttacggtttcccgttaaccgtttacgtttacccggggacgggttaaacggtaacccgggtagttaaccgtacgtaacgtacccggtaaaaccgttcggttacgggtaacggtaccgttaccgtaccgtaccgtttccgttaagtcccggtttacctacggttacccg

SEQ ID NO: 66157 - DNA, 747 bp, Homo sapiens
  misc_feature: GYAE6OF02HXTH4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatgagcctagtttccagacctcccgtggtctgtgttcgtcgtcgggacggaggacggccaccattaccgaacgtcgacgaacgtaccacgccgaaggtgtttgttttaacgttccggaccccctaaactaaactaaactaaccgtacttacgacgttcggtaacagacgaagaaagtcgaacgcgacctactaaactccgtagtagttacgtggtccttaccggtaccgggtactacggttccgggttaacctaaccgtattacgagttcggccgaggtccgggtcgtacgggactactttcgactcacgtaccgtacacgtacgcgacgtccgtacgacgtacgacgtaagagtacgtgtacgtacttagtttataccgtcgtacgaacgtactaacttaactttacttaccgtttacgtttaccgtcgttaaccgggtttacgggaaccgggtaaacgggttaccgtaaaggggttacgtacgttaaaccggaaccggtaaacggttaacgggttacggtaccggttacccgtagtaacccggtaaccgttcgtttaccgttacgttttacccggttactacccgg

SEQ ID NO: 66158 - DNA, 764 bp, Homo sapiens
  misc_feature: GYAE6OF02G2ATK.31.78.H01.1.454.CMB.1.raw
  modified_base (202)..(202): a, c, t, g, unknown or other
  misc_feature (202)..(202): n is a, c, g, or t
  modified_base (722)..(722): a, c, t, g, unknown or other
  misc_feature (722)..(722): n is a, c, g, or t
  modified_base (748)..(748): a, c, t, g, unknown or other
  misc_feature (748)..(748): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgaccgtacggggacatcggtgatgacgcctagtttccagaccttcctggctgtcgtctcgngggcgaggacggcccacagtacaacgtgacaacgtccagcctagtagtttcgttttacgttccggaccccctaactaaagtaaacctaaaccgttacgttaacggtcgtttaccgggtaacccaggtacgtaaaggaaaaaggtacgggaccaacggtaccccttaaaccgttaaacccttccggttagtaacgttttaaccggtccggggttaccttacccgggtaacccccgggggtcttaaccggggtttaccccggggttacccctaaacggttcttacgtacgtttggaccgtacggtccggggtacgtacgggaccgttacttccaccttccgaaccacgtaactccaagcgtaccgccgtgaccgtagtcgtagaactggtcgtcgtagttacgtttacgtacgtagtacaagtacctaattacgttactttaccgtttcgttacttaccggttagttaccgggacgggaaggtacgtaagggacgtagtacgtaacgtaacgtaggtacggngtaccgtgacctacttcgtacggttntttacctagtaccccg

SEQ ID NO: 66159 - DNA, 869 bp, Homo sapiens
  misc_feature: GYAE6OF02G1XQX.31.78.H01.1.454.CMB.1.raw
tcagcagtagacgtcacgaccggtgctcgatttagtgtgagtagtttgggttggggagctacaacaggcaggcaggggcagcaagatggtgttgcagacccaggtcttcatttctctgttgctctggatctctggtcgccgtacggggacagtcggtgatgacgtcctagtttccagactcccgtggctgtgtccttcgtgggacgaggacgggcccaccgataccgtaactggacctaacgtcccgacggaccctaaggtacggtttacggtttttacgttaccgggacccccctaacctaaacgttaaaccgtaaccgttaacctttacggtaccgtttacgggtaacccctaagggtaccaaagggtaaacggttaacgggaaccgtaacggtaccccttaacccgttaaaacccgttcccgttaacggttaaccgttttaccggtcggggttcccttacccgtaaccccgggggtacttaacccgggttccccggggtttaaccctaacccggtactttaccgtacgtttcggaccgtaacgggtcgggtaccgttcgggtaacccgttacttttccgaccgtccgttacaaccgtacgtaccgaacgtccgtacggccctacggtaaccgagggtacccttaggaaacgtcgtacgggtacggttacgttaagttttaacgttacgtacgttacgtaaccgtacgtaacgttaacgtttacgttacctttacgttaccgttaccgttaccggtttaccggaccggtaacggtaaccgtaagggtggtacgtacgtaaccgaacgggtattacggacgttaccgacgtacctaacgttacgtcgttacgtttacgaccttaaccg

SEQ ID NO: 66160 - DNA, 760 bp, Homo sapiens
  misc_feature: GYAE6OF02HWWOZ.31.78.H01.1.454.CMB.1.raw
  modified_base (384)..(384): a, c, t, g, unknown or other
  misc_feature (384)..(384): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggactctcgtggtgcctacggggacatcgtgatgacgccagtttccagactccctggctgtcgtctcgtgggcgaggcggccaccatcaactgacaagtccagccagagttgttttactcggccccacaataacaactacttagctgtacagcaagaaggtaggacacgtccctaccgtaaactcctgtaatttacgtcggtccttaccgtacccgggtactacggttaccccgggggtttaccctaaacccggttntttacgtaacggttcggaccgttacggggtaccggggtcgttacggggaacccgtttaactttccgtaaccttccgtaccgtaacctacgtaccgtaacgcgtaccgtccgttacgaccggtacggccgttaggaaacggtacgttcgggtaggtacctttaggtttaacgtttaccgtgttaaccgaacggtactaacgttattaacctttacgtttaccgtttccgtaccgttacccttttacggggccggtaaacgggttaacccggaagggttaggtaaccggtactaaccggaaacggttaacggttcggtaccggtacggtcggacccgttaactaccgtttccgtttacgttacccgttacttacccgg

SEQ ID NO: 66161 - DNA, 859 bp, Homo sapiens
  misc_feature: GYAE6OF02FRR18.31.78.H01.1.454.CMB.1.raw
tcagcagtagacgtcacgaccggtgctcgatttagtgtgagtagtttggggtttggggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggagggcccaccatcaactgacaacgtccacgcctaggtagttgtttttacgttccggccccaaccaactaaaccaactacttagcttaggtaccagcaagaaagtaggaccagccctacctaactcctagtagttacgtcgggtccttaccggtaccccgggtctacggttcccggggttaccctaaccggtactttctaaggttccggtacgacgggtccggggttacgtacgggggtaacccgttacgttttcccaccgtttcccgtaccctacccgtaacgtaccgacgtacccgtacggtccccgttacggacccggtaacggggtaccgtaaggtaaacgggttacgttaccgggggttacgggtaacccggtttaaggttttttaacccgtttaaccgtttcggggttaccctaaacggtacctaaaccgtttattttaaccggtttacctttttacccgttttcccggttaacccgtttaccgggttttaccggggaaccggggttaaacggtaaccgggttaaacggggtacggtaacggtaacggttaaccggtaaacccggtaaggtttaccgggttacggtacccggttacgtaacccgaaccgttaccggttccgttaccgttttacttacccggttacccg

SEQ ID NO: 66162 - DNA, 955 bp, Homo sapiens
  misc_feature: GYAE6OF02HIFNT.31.78.H01.1.454.CMB.1.raw
  modified_base (140)..(140): a, c, t, g, unknown or other
  misc_feature (140)..(140): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtnccgtacggggacatcgtagatgacgctagtttccagtactcccgtggctggtgtctcgtgggacgaggacggccacctatcaacgtcgacaacgtccacgaccgagtacggtttagtttttacgttccggacccctaacaaacttaaacctaaaccttacgtttacggtaccgtttcgggaaacctgaccgtaaaggtaaacggtacggaactaccggtacccttaaacccgttaaaccgttccttaggttaaacgttttaccggtccgggtttacctttaccgggtaaccccgggtaccttaacccggggtttcccccgggggttttaaacctaaaccccggttaagtttaccgttacggtttacgggaccgtaacggggtccggggttacgtaccgggggtaaacccttcgtttactacccgtcttacccgaacttacgtacgaccggtacgaccgtcccgtacggtccggtaacggtacgttaacggtaacgtacggttacggtttacgggtaccggttttaagttttaccggtttaaccggttcggttaaccgtacgtaaccggtaaacgtttacgttttaaaaccggttttccctttaaacccggtttttacccggttaaccggtttacccgggttttaaccgggggtaccgggggttaaaccgggtaaccgggttaacggggtacgggtaacggtacccggtaaaccgtttaaaaccggacgggttaaccggttacgggaacccgtttacggtaccccgtaacggttacccgttacggtttcccggtttaccgtacccggtttaacccc

SEQ ID NO: 66163 - DNA, 698 bp, Homo sapiens
  misc_feature: GYAE6OF02G90G6.31.78.H01.1.454.CMB.1.raw
  modified_base (665)..(665): a, c, t, g, unknown or other
  misc_feature (665)..(665): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcctggctgtgtctcgtgggcgaggacggccacgactcaactgaccaacggtccagccgagtacgtttgttttacgtccggaccccaactaaactaacgaacttagttacgtcgttacggtaaccagaccaaaggtaaacgtacgaacaccgtacctaccctaaacttcctacgtacgtttacggtcggtaccttacccggtaccggtaccgtaccggttacccggggttacctaaccggtacttaccgtacggttcggacgtacgggtccgggttcggtaccgggtacgttactttaccgtacctcctacctaacctactacgacgtacgaccgtccgtagacgtacggctaaggaagtgtacggtacgtagtttagttacttagtcgtagtacgactaatagttacttctttcgttccttacgttcgttacgacggtacggtaccgaggtaggactacgtaacgaacgtacgtacggtcgtaccgngtaccgtactacgttcgtacttctacttacccg

SEQ ID NO: 66164 - DNA, 802 bp, Homo sapiens
  misc_feature: GYAE6OF02HFX9V.31.78.H01.1.454.CMB.1.raw
  modified_base (341)..(341): a, c, t, g, unknown or other
  misc_feature (341)..(341): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttcccagcctccctggctgtgtctcgtgggcgaggacgggcccaccagtcaactgacaagtccagccagtagttgttttattccggccccaacaagtaaccaacgttacttagtcttacggtaccagcaagaacgtaggacacgacctacctaacctcgttagtactttaccgnggtaccttccggaccccgggtctaaccggtttccccggggttacccttaaccgggacttttcgacggtttcggacgtagggtccggggttcctacgggggtaccctagttttccgacttccgtacccacctataccgaagtccgtaccgtcccgtagaccgtaggccgtaacggtaagttggtacgggtaccggtcgtttaacgttttaacgtttacgttacggtactaacggaccttaaacgttaagttttaacctttaccgtttttaccgttttacccgtttaccgtttaccggttttacccggggtaaccgggtaaaccgggttaacccgtaaaggggtaccgggtaacgtaaccggtttaaccgtaaaacggttaacgggttaaccgttggggttaccggtaacgttacggacccggttacccttacggttttccgttaccggttcctttaacccgg

SEQ ID NO: 66165 - DNA, 885 bp, Homo sapiens
  misc_feature: GYAE6OF02HDY1Q.31.78.H01.1.454.CMB.1.raw
  modified_base (580)..(580): a, c, t, g, unknown or other
  misc_feature (580)..(580): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatgacgcctagttccagtacctcccgtggctgtcgtctcgtgggcgaggacggccaaccataccgaacgtgacgaacgtccgacgaccgagtacgttttagttttacgttaccggaccccctaaactaaactaaacctaaccttacgttacgtaccgtttacggaaccagaaccgaaaggtaaacggtaacggaaccgaccgtaccctttaaaccctaaaccgttccgttaagttaacgtttaccggtccgggttacctttaccccggacccgggtacttacccggggttaccccgggtttaacccctaaaccggttattaccgtaggtttaccggacgtaccggggtcgggttccgacggggtacttaccgttaccgtaacttcctaaaccgctaacgtaccgtacggcgaccgtccgnggaccggtaacgggtcttaaagggaacgttacgggttcggttaacggttacgttaacggtttttaaccgtacggttcgttaaacccgtagtaacccttaaacgttacttttaaaccgtttacccgtttgtttaacccggttacgttacccgggtttaaccgggaccggggtaaacgtaacgggtaagggttacgtacggtaacggttaaaccgtaaaccgggttacggttacgtaccggggttaccctaccgggtaccttaaccggttccgttaacgtttaccgttacccttcccgttaacccgg

SEQ ID NO: 66166 - DNA, 785 bp, Homo sapiens
  misc_feature: GYAE6OF02ID6BW.31.78.H01.1.454.CMB.1.raw
  modified_base (207)..(207): a, c, t, g, unknown or other
  misc_feature (207)..(207): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcctacggggtacatcgtgatgacgcctagtttccagacctcctggctgtcgtctcgtgggcgtaggnggccaacatacaactgacaacgtccaacgccaaggtagtttagtttttacttccggtacccccaaacgtaaactaaacctaaacgttacttacgtacgtttacggaccgtaagacgaaagaaacgtacggaactacgtaacctaaccctaaaacctaccttagttaactttacggttacgggtcctttaccggtaccggggacctacggttacccggggtttacctaaaccggtactttcgtaacgttcggtacgtacgggtcggtacggttcgggtaacctcgtttacgtactaccgtaccctaccgtaactaccgaacgacgtacgtccgtagaccggaggtacttaaggaaagttacggtcggttacggacgttaacgtttaacttagttacgtacgacgtaacctaagtttaacttacgttacctttcgtttaccgttacgttacgttaccggggacgggtaacggtaacgtaagggtacgggtaacgtaacggtaacgtaaaccgtaccggtaggttaccggtagtaccgtaaccgactttaacggccgttttacgttacgttaccctaccgg

SEQ ID NO: 66167 - DNA, 733 bp, Homo sapiens
  misc_feature: GYAE6OF02H91UU.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctcgtagggcgagacgggccaccatccaactgacaacgtccagccagtagttgttttattcggccccacaataacaactacttagcttggtaccagtacaaggaagtacggacagccttacctaaactctagtactttacgcgggtacttaccgtacccgggntaccggttcccgggttacctaaccgtcttacgagttcggctaggtcgggtctagggtaccctagtttccacgtcctaccaactactccgaagtccgaacgtccgtacggaccgtaacgggtacttaggaaaccggtagttccgggttacggtacccgttttaaggtttttaaccgttaaccgttacggttaccaaacgtacccgtaaaacttacgttttaaccgtttaaccttttcccgttttaccgttaccgttaacccggttttccggggacgggttaaacgggaaccgtaaggggttcggaagtaccgttaaccgaaaacggttcggtagtaacggtccgacgtacgtacctagttacgtcggtttaccctagttaacccg

SEQ ID NO: 66168 - DNA, 612 bp, Homo sapiens
  misc_feature: GYAE6OF02GUX7J.31.78.H01.1.454.CMB.1.raw
  modified_base (456)..(456): a, c, t, g, unknown or other
  misc_feature (456)..(456): n is a, c, g, or t
  modified_base (483)..(483): a, c, t, g, unknown or other
  misc_feature (483)..(483): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggcccccaacaaataacaacttacttagcttaggtaccagcaagaaagtaggacacgcctacctaaactcctgtatttacgtgggtccttccgtacccgggctacgtcccggggttaccctaaccgtattccagtttcggacgtacggccgggttcgtcggggaccctagtttccactcctacaaccactccagcacgcctgcaggctagaagntggtcggtctagtttactacgtcgtanacgtactaactaacttacttactttcgtttaccgtaccttacgtttacgggcggacggtaacgtaagggtcgagtactaacgaaacgtacttggacgtactacgactaccattcgtcgttctactaccg

SEQ ID NO: 66169 - DNA, 656 bp, Homo sapiens
  misc_feature: GYAE6OF02F0TF0.31.78.H01.1.454.CMB.1.raw
  modified_base (463)..(463): a, c, t, g, unknown or other
  misc_feature (463)..(463): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtcgtctctgggcgaggacgggccaccatccaactgcaagtccagccagtagttgttttattcggccccacaataaccaactacttagcttggtaccagacaagaaagtaggacagcctacctaactcctagactttacgtcggcttccgtacccggctacgttccccggggttacctaaccgtacttcagtttcggcgaggtccgggtcgtacggggtacctatttccaccttctccacctactcgacgctacgccgtagcgacggtctaggaacgnggttaggtggacttacggttttattaccgttacgtacgagacctaacgtatttacgttacctttacttttccgtaccgttacgttttaccgggacgggtaaccggtaaccgtaaggggtcgaacggtactaaccgaaacggtacgtaggtcgtcgtacgactaccgtacgttcttcgttacctacgttacccg

SEQ ID NO: 66170 - DNA, 734 bp, Homo sapiens
  misc_feature: GYAE6OF02H1IFV.31.78.H01.1.454.CMB.1.raw
  modified_base (162)..(162): a, c, t, g, unknown or other
  misc_feature (162)..(162): n is a, c, g, or t
  modified_base (227)..(227): a, c, t, g, unknown or other
  misc_feature (227)..(227): n is a, c, g, or t
  modified_base (333)..(333): a, c, t, g, unknown or other
  misc_feature (333)..(333): n is a, c, g, or t
  modified_base (422)..(422): a, c, t, g, unknown or other
  misc_feature (422)..(422): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgcttctggatctcgtggtgccgtacggggactagtcgtanatggacgcctagtttcacgaccttcccgtggctggtcgtctacggtgggcgaggacggaccaccntacctacgtgacctaacgtccagcctaggtagtttgtttttaacgtccggaccccaacgtaaattaaaccgtaaccttcgttaacgtccgtttacggtaaccccgngtaacgaaggtaaaacggtaccgtaacgaccgtaccctaacgttaaacctcgttaagtacttacggtcggtcttacccgggacccggtntacccggttccgggttaaccaccgtgtttacaggttgccgtaggtccgggtagcggtaacgtctttaccgctaccactactacacgcgcacgtcgtaagcgtacgacgtaggtacgagtacggtcgtacgttagtttaacgtcgtacgaccgtacgtaactaacttacgtttaaccttcgtttccgttacgtttccggtacccggtttcgggaacggttacgggtaaaggtcggttaagtacgacgttaaccggagttacctgggtaccgacgttctacgtacttccgtaacgtttccgtactccgttaacc

SEQ ID NO: 66171 - DNA, 702 bp, Homo sapiens
  misc_feature: GYAE6OF02H0UAX.31.78.H01.1.454.CMB.1.raw
  modified_base (445)..(445): a, c, t, g, unknown or other
  misc_feature (445)..(445): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctcgtggtgaccgtacggggacagtcggtgatgacgcctacgtttccagacctcccgtggtcgtgtgtctcgtgggcgaggcgggacccacactacaacgtcgaccaacgtccgacgccgtaaggtagtttagtttttacgtccggaccccaactaaactaactaaccttactacgtcgtacggtaccgaagaacgtaaggtaaacggtagaaccgtacgtaccctaccctaactccgttagttacgttacggtcggttccgtaccggtacccggtcgtaccgggttcccgggttaccctaacggtcttacgnggttcggccgtaggtcggtacggtacgggtaacgttcttacgtaccttcaccgtacctagcgtagctaccggcgtagacgtacgtgtaagagtgacggtgtaacgttgttactcgtagtccagacctattaacgttcttaacgttcgtttactacgttcggtaccggtacgggacgtaacgtagggtagacgtacgtaacggtaacgtaccgtcggtgtaaccgcggtactactagttcggttactccggtacttcg

SEQ ID NO: 66172 - DNA, 807 bp, Homo sapiens
  misc_feature: GYAE6OF02IBVHO.31.78.H01.1.454.CMB.1.raw
tcagcagtagacgtcacgaccggtgctcgatttagtgtgagtagtttgggttgggggagctacaacaggcaggcaggggcagcaagatggtgttgcaggacccaggtcttcatttctctgttgctctggatctctggtcgccgtacggggacatcggtgatgagccagtttccaggtactccctgggtcctggtcgtctcgtgggcgtaggacgggccaccatacaacgtcggactaacggtccagtccaggtacgttgttttacttcggaccccactaactaacgtaacttactacgtcttacggtaccagctaacgaaagtaggactacgtccttacccgtaaaccttccgtagttacttaaccggtgggtccttccggtaccccgggtcctaacgtttccccggggtttaacctaaccggtacttacgtagttacgggaccgacgggtccgggttaccgtcgggggaaccctttactttaccgaccttaccttaccgaccctaactcggtacgtaccgtacggtaccgtcggacgacgggtcttaacgggaagtacgttaggtcgggttaacgttaacgtttactttaccggtattccgtaaggacccttaaactgttttaccttaacgttttcccttttacgggtacccttacggggttttacccgggacccgggggtaaacggtaaccggtaaacgggtttccgggaaagttaaaccgtacggtaaaccggtacgacggttcgggtacctacggtacctaccggttacttacccgggttacgtttacccgttactaccccgg

SEQ ID NO: 66173 - DNA, 787 bp, Homo sapiens
  misc_feature: GYAE6OF02FXWJJ.31.78.H01.1.454.CMB.1.raw
  modified_base (383)..(383): a, c, t, g, unknown or other
  misc_feature (383)..(383): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcggtgatgagccagtttccagactccctggctgtgtctcgtgggcgaggacgggcccaccatcaactgacaacgtccagccagtagttgttttacttcggaccccacaataacaactacttagcttggtaccagcaagaaagtacggacacgacctaccctaaactcctgtactttacgtgggtaccttcgtaccccgggctacggttccccggggttacctaaacccgtnttcgtacgttcggccgtagggtccggggttcgtccggggtaccctagttttaccaccttccgtaccaacctactcctaacgcaacgtcccgtgacgcggtctaggtaaacgtagttcggaggtccgtttaaaggtttttaacgttccgtttacggtacaccggttaacctaaacgtttaactttaacgtttacctttttccgtttttaccggtacccgtttaacccgggtttttccggggggaacccgggttaaacggggtaacccggtttaaacggggtcggggtaaacgttaaccgttaaacccggtaaaaacccgggttaaccggttggggttaacccggtaacgttccggaaccgttacccttaacgttaccgtacgttttacccttacgttaaccccgg

SEQ ID NO: 66174 - DNA, 604 bp, Homo sapiens
  misc_feature: GYAE6OF02HDZEW.31.78.H01.1.454.CMB.1.raw
  modified_base (347)..(347): a, c, t, g, unknown or other
  misc_feature (347)..(347): n is a, c, g, or t
  modified_base (481)..(481): a, c, t, g, unknown or other
  misc_feature (481)..(481): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatccaactgacaagtccagccagtagttgttttacttcgaccccaacaaataacaacttacttagcttaggtaccagacaagaaagtaggacacgccctacctaactctgtattacgtcggtcttccgtacccgggncgtaccggggttcctaaccgtattcagttcggctagggcggtccgtacgggaccgtatttaccgacttcctaccacctagtccagcacgcctgacgagtctagaagtagtggtgtacgtagtttatacttgcanctaatattacttacttcgtttctcttacgtttggacggtaggtacgtagggtagatacgtacgaaacggtacgttggtacggtacgagtacccgactacgttactccggttacttacctaccg

SEQ ID NO: 66175 - DNA, 722 bp, Homo sapiens
  misc_feature: GYAE6OF02JYESG.31.78.H01.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (326)..(326): a, c, t, g, unknown or other
  misc_feature (326)..(326): n is a, c, g, or t
  modified_base (382)..(382): a, c, t, g, unknown or other
  misc_feature (382)..(382): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgcctagtttccagactccctggctgtgtctcgtgggcgagngggccaccntcaactcgctaagtccagccanagttgttttatcggacccacaattaacactactagcttacggtacagacagaaacggtggacagcccttacgtaaacctcctagacttttacncgggtacctttccgaccccggggctaacggtttcccggggttacccttaaaccggnttttccgacgttgggtacccagggttcccgggtgttacggggacccgtagttttccaacttccaccgacctactccgaagtccacggacctcgacgtacgacgtcgaaaggtacgttacggtcggtaacttaggttttaactttaccgtagttccgactacgaactttaacttaactttaccgttacttttaccgttaccgttaccgttttacggggtaccgggtaacggtaacccgtaaggtccggtagtaacgttaccgaaacggttacgttacggtacggttaccgtaggttaccaaccggttccgttaacgtttccgttaccgtttaacgttcccg

SEQ ID NO: 66176 - DNA, 659 bp, Homo sapiens
  misc_feature: GYAE6OF02GPLUB.31.78.H01.1.454.CMB.1.raw
  modified_base (478)..(478): a, c, t, g, unknown or other
  misc_feature (478)..(478): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccgtggctgtgtctcgtgggcgaggacgggccaccatcaaactgacaacgtccacgaccagtagttgtttttagtttccggaccccaaccaaataaacaacctaacttacgcttggtacccagcaagaaagtaggacacgccctacctaaactcctagtactttacgtgggtccttaccgtacccgggctaacgttcccggggttacctaaccgtattctagttcgacgaggcgggtcgtggggtaccgtactttacactcctacacctactcgacgcacgcctgacgaggacgtagaaagngtggtcgtacgtagtttaagttacttagtactaagactaaccgtaatttacttacctttcttttaccgtacttaccttacgggtcggtacggacgtaagggttagacgtaacgtaccgaaacggtaacgttcggtggtaccgtcgaccacgttacgtacgttcggttcctaccgttacccg

SEQ ID NO: 66177 - DNA, 640 bp, Homo sapiens
  misc_feature: GYAE6OF02FSWO2.31.78.H01.1.454.CMB.1.raw
  modified_base (324)..(324): a, c, t, g, unknown or other
  misc_feature (324)..(324): n is a, c, g, or t
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacggccacatcaactgacaagtccagccagtagttgttttacttccggccccaacaataaccaactacttagcttgaccagcaagaaagtacggacagtcctacctaaacctctagtatttacgngggtccttccgtaccccgggntacggttcccggggttacctaaccgtnttaccgtattcggcacgggcgggttccgtcggggtaccctagtttccacttccgtaccacctagtccagtcacgcctcgacgtaggtcagtagtagtcggtcggtcgttagtttacgttacttgtaccgatacctactaatttacttactttacctttcgttacctacggtttccgggaggtaacggtaaccgagggtacgacgtaataccggtaaacgtacgttggtacgtcgtacgtaccacctattcttcgttcttaccttaccg

SEQ ID NO: 66178 - DNA, 699 bp, Homo sapiens
  misc_feature: GYAE6OF02G2LJ7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagacgggccaccatcaacgtcgactaagtccaaggccaagaggttgttttaattcggaccccaaccgaataaaccaacttacttagctttacggtaccagacagaaagtacggacacgtacccttaccgtaaacctccgttagtaactttacgtcgggtacttccgtaaccccggggctacggttcccggggtttacctaaccgtattacctagttacggcaggtccgggtcgtcgggggacctacgttttccaacgttctaccgacctaacgtccaacggcacgtcccgtgaccgtggacttaggaagtacgtaggtcggtactttagtttaacgtacttcgtactcgactaaacgtatttaacttaccgtttccgtttcgtaccgtttacggtttccggggaccggtaacgggtaaccgtagggttacgagtaacgtaaccgaaacggttaacgtggtacggtactacggccttaccgaccttcgtacgttcttcctaaccg

SEQ ID NO: 66179 - DNA, 811 bp, Homo sapiens
  misc_feature: GYAE6OF02G3U72.31.78.H01.1.454.CMB.1.raw
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggactctctggtgcctacggggacatcgtgatgagcctagtttccagactcccgtggctgtgtctcgtgggcgaggaggccacgatacgaactgactaacgtccacgccagtagttgttttacgttacggaccccaactaaagttaaacctaacttaacgttagcctttaggtaaccagacaaggtaaacgtacggactacggtaccttaccctaaacgtccgtagtaacttttaccggngggtaccttaccggtaacccggggacttaccggttaccccgggggtttaacctaaaccggtactttacgtacgtttcggaccgtaacgggtccgggttacgtacggggaacccgttacgtttaccgaccttacgtacccgtaaccctacgttaccggaacgtcctaaccgggtacccttacgggaccgtaagggtaccgttaacgggaaacgtacgttacgggttcggtaacgtttaacggttttaacttaccggttacgtaaccgtaacgtaactaaaccgtttaattttaacgtttaacccttttccgtttaccgttaccgttacggtttaccgggtacggtaacggtaaccgtagggtacggtacgtaccgtaacgtaaacggtagttcgggtacgtacctacggacctacgtacttccggttacttacgtccgttaaccg

SEQ ID NO: 66180 - DNA, 1014 bp, Homo sapiens
  misc_feature: GYAE6OF02GPQTM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgagtgagcctagtttccagtacctcccgtggctgttgtccgtcgtcggggcgaaggacgggacccaccagtaccaactcggaccaaacgtcccgaaggacccaggtaggttttacggtttttaacgttccgggaacccccctaaactaaaactaaaacccgtaaaccttaacctttaacggtaccgttttacggggtaaaccctaacggaaccgtaaaaggtaaaaaggttaacgggaaacctaaccggtaccccttaaaacccttaaaaccgttaccgttacggttaacttttaaccgggttaccggggttaccgttttaccccgggtaacccccggggtacgtaaccggtttacccccgggggtttaaccccttaaaaccggtaactttaccgtaaccggtttcggaacggtaacgggtccggggtttaccgggtaccgggggttaacccttaacgttttcccaaacccgtttacccttaacccgtaacccgtaactacccgaagtacccggtaaccgtcccgtacggtaccgacggtaaccggtaacggtaaaacggttcgtaacgggtacggttaccgtttaaacggtttttaacgttaaccgttaacgggttaccgtaaaaccggtaaaccttaaaaccgtttaacgtttaaaccgttttacccgtttttacccgtttttacccgttacgtttaacccgggtttaaccggggtaacccgggtaaacgggtaaacccgggttaaagggtagggtaacctaacggtaacggtaaaacgttaaccggtttacggtaccgggtacttaccggaaccttacccgttacgttaccgttacgtttaccctaccgttaccc

SEQ ID NO: 66181 - DNA, 830 bp, Homo sapiens
  misc_feature: GYAE6OF02I5COX.31.78.H01.1.454.CMB.1.raw
  modified_base (236)..(236): a, c, t, g, unknown or other
  misc_feature (236)..(236): n is a, c, g, or t
  modified_base (281)..(281): a, c, t, g, unknown or other
  misc_feature (281)..(281): n is a, c, g, or t
tcagcagtagacgtcacgaccggtgctcgatttagtgtgagtagtttgggtttgggggagctacaacaggctaggcaggggcagcaaggatggtgttgcagacccaggtcttcattctctgttgctctggatctctggtgcctaggggacagtcgtgactgagccagtttccagactccctggctgtgtcgtcgtggcgtaggacgggcccacatcaactcgacagtccagccagngttgtttagttcggacccacaataacactactagtcgttgtaccngtcaagaacggtagacacggtacctactaacctcgtgtattacgtcggtacttccgtacccgggtctacgttccggggttacctaaccggtattaccgtaagtttcggacacggtcgggttccggtacggggtacccgttaagtttccgtaaacgtccgtaccgaaccgttaccgtaccgtaacgtaccgtacggtacccgtacggttacgacgggtacgtaacggtaaacgggtacgttaggtaccgggtaccgtttaacggtttaacggttaacgttacggttaccgtaaccggtaaccgttaaccgttaaccgtttaaacgtttaacccggtttcgttttaacccggttccgttaaacccgtttacgggggttaacccggggtaaacgggtaaacccggttaggggtttacccggggaacgttaaaccgggttaaccggtaaaaaaccggtccgggttaaacgggtttacgggtaacccgtaccggttaaccggtaaaccgttcggttaaaccccggttcggtttaaccgttcccggtttaacccg

SEQ ID NO: 66182 - DNA, 648 bp, Homo sapiens
  misc_feature: GYAE6OF02I6BC9.31.78.H01.1.454.CMB.1.raw
  modified_base (180)..(180): a, c, t, g, unknown or other
  misc_feature (180)..(180): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (488)..(488): a, c, t, g, unknown or other
  misc_feature (488)..(488): n is a, c, g, or t
  modified_base (628)..(628): a, c, t, g, unknown or other
  misc_feature (628)..(628): n is a, c, g, or t
tcagcagtagacgtcacgaccggtgctcgatttagtgtgagtagtttgggtttgggggagctacaacaggcaggcaggggcagcaagatggtagttgcaggacccaggtcttcatttctctgttgctctaggatctctggtgcctacgggacatcgtgatgagccagtttcacgactccnggcctgtgctcgtgggcagcggccaccatcaactgacaagtccancgagngttgttttatcggccccaacaataacaactagttagcttaggtaccagacaacgtaaagtaggaactcgacctacctaaactccgtagtacgtttacgcgggtacttccgaaccggtcacgtccgggttacctacgnttaccnttcggcacggtcggtctcgggtaccgtatttaccacgttctacccgacctatacgagccacgtccgtacgacgaaccgggtctaacgagtacgtgaccgtgtagtttactacgtnttacgacgtacaacgtacgtttactaccgtttctttacgactttccgttaccgggtacggtacggacggtaacgggttcggacgtagtaacccgaaaggttacgtcgggtacttaccgtacggacccttacgaacctttntaccgttcttaccgtacccg

SEQ ID NO: 66183 - DNA, 755 bp, Homo sapiens
  misc_feature: GYAE6OF02G7V5W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatggagccagtttccagactccctggctgtgtctcgtgggcgagcgggccaccatcaactgcaagtccagccagtagttgttttattcggaccccacaataacaactacttagcttggtaccagcaagaaagtaggacagccctacctaaactccttagtactttacgcgggtctttccgtacccggggcctacggttccccgggggtttaccctaaaccggtactttccgtaacgtttcggacctaaggggtccggggttaccgtcgggggtaaccccgttaagttttcccgaccttcccgttacccaacccgtacttaccgacgtaccgtaccggtacccttgggacccgtagggtcccgttaaggtaaacggtacgttagggttcgggtaccgtttaaggttttaacgtttaccgtaggttaccaacggtaccctaaaattacgttttaacgttacctttttaccgttttaccgtaccgtttaccggtttcgggaaccgggtacggtaaccgttaaggggtcggacgttacgtaacgaaaccggtaacgtcggtacggtactcgaccaccgtattaccggtcttaccattacccg

SEQ ID NO: 66184 - DNA, 735 bp, Homo sapiens
  misc_feature: GYAE6OF02HZB71.31.78.H01.1.454.CMB.1.raw
  modified_base (557)..(557): a, c, t, g, unknown or other
  misc_feature (557)..(557): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcccgtacggggacatcgtgatgacgcctagtttccagtacctccctggctgtgtctcgtggcgaggacggccacataccaactgacgaacgtccagccaggtagtttacgttttacttaccggaccccaaccaaataaactaacctacttagtcttacggtaccagacgaaaggaaaagttacggacgaacgtcctaaccttaaactccgttagtacgttttacgtcgggtaccttaccggtaccccgggtatacccgggttcccggggttaccctaacgtacgtaccgttagttcggcgtacgggtcgggtaccgtacggggtacctacgtttccaccgtcttaccgtaaccctagtacgaccggtaccacgtcccacggaccgtagacgtagtaaacgtagttcggtaacggttnttaacgtttaatcgtgtacctaacgactaaacgtattttaccgtactttacgttccgtaccgttaacgggttccggaacgggtacggtaaccgtaagggtcgtaagaccggttaaacaacggttagttacggagtacccgtatccgtacgaacctttggtaccgttacttacctaccg

SEQ ID NO: 66185 - DNA, 685 bp, Homo sapiens
  misc_feature: GYAE6OF02HGGB0.31.78.H01.1.454.CMB.1.raw
  modified_base (359)..(359): a, c, t, g, unknown or other
  misc_feature (359)..(359): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtcgtctcgtgggcgaggacggccaccatcaactgcaacgtccagccagtacgttagtttttagttcggacccctaccaactaacaacgttaacttagtcgttaggtaccagacaaggtaaagtacggacacgtcctactaaccgtctacgtattacgtcggcttccgtaccggnacgtaccgggttacctaccgtacttcacgttcgcgacggcgggttccgtcgggacgtactttcgtactctcacctatcacgcacgccgtgcaggcctagaagagttcggtaggtacgttaggtttaacttcggtacgtacaggtactaaccgtttaagttaccgtttactttacccgtttcgttaacccgttaacggttttccggggaccgggttaacgggtaaccgtaagggttcggtaacgtacgttaaccgaaacgggttacttacgggtcgtaccgttgaacccgtacgttaaccgttcgttcggttaccgttccttaccgg

SEQ ID NO: 66186 - DNA, 758 bp, Homo sapiens
  misc_feature: GYAE6OF02F1JAC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcctggctgtgtctcgtgggcaggcgggccaccatcaactgaccaagtccagccagtagttgttttacgtcggaccccaacaactaacaacttacttagtcgttaggtaccagacaagtaagtaggacacgccctacctaaacttccgtagtacttcgtcggtccttccgtacccgggctacggtacccgggttaccctaaaccgtcttcgtaacgttcggacgtacggtcggggttcgttcggggaacccgttacgtttccctacgtccctaccgtaaccctacgttaccgaaggtccgaccggtcctacggccgtaagggtacctaagggaagttacttagggtacgggtactttaacggttttaacgttacgttacgtaccgaacgtaacgtaaccttaaacgtttttacgttaaccgttttcccgttttccgtaacctttccggggttttaaccggggcccgggtaaaccgggtaccgggttaaacgggttgggtacgttaacgtaaaccgtaaacgggtagttcgggtaacgtcgttaccggcctaacgtccgttacgttccgttccgtacttccccg

SEQ ID NO: 66187 - DNA, 629 bp, Homo sapiens
  misc_feature: GYAE6OF02FJH6O.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaagtccagccagagttgttttattcggccccaaccaataacaactactagcttggtaccagcaagaaagtaggacagccctacctaaacctccgtagatttactgggacttcgtacccgggctacgtcccggggttacctaaaccgattcagttggcaggtcgggtctggggacctatttcacctctaccaccatacagcacgcctcgcaggtctagaacgattggtggacttaaggtttacttacgttcgtacagactaaactagttaacttactttctttaccgttacctacgtttacgggaccgggtaacgggtaaccgtaagggttacggtaagaacgtaaccgaaaacggtaaccgtggtacggacgttacggaccaaccgtacgttctcggttacttactaaccg

SEQ ID NO: 66188 - DNA, 745 bp, Homo sapiens
  misc_feature: GYAE6OF02I9IPY.31.78.H01.1.454.CMB.1.raw
  modified_base (560)..(560): a, c, t, g, unknown or other
  misc_feature (560)..(560): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactcctggctgtgtctcgtggcgaggaggccaccgatacaactgcaacgtccagaccagtagttgttttacttcggaccccaacaactaaacgaacttacgttagtacgttacggtaacctagacctaaggaaaagttaacggacagtccctaacctaaacctccgtagtacttttacgacggtccttaccgtaccccgggtactaccggttcccggggttacctaaaccggtatttacgtagttggacgtacggtccgggtaccgtacgggtaacgtacgttttaccaaccgttccgtacaacctattaccgaagtacgacgtccgtagcgaacggtctagaaagtggtacggtacggtaccttaagtttaacgttacgttacggtanaaccgttaccaaaacttaactttaacgtttacccgttttgtttaacccgttcgtttaaccggtttccggggtaacgggtaaacgggtaaccgtaagggtaggtacgtaacgttaaccgtaaaacgttaccgacgggttccgtacgtacgtaccctacgttacttacgtcgttaccttactccccg

SEQ ID NO: 66189 - DNA, 678 bp, Homo sapiens
  misc_feature: GYAE6OF02F5V0T.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggaccccacaataacaactactagcttaggtaccagacagaaagtacgacacgccctactaaacctcctagtactttacgtgggtccttaccgtacccgggctaacgttcccggggttacctaaccgtattccagttcggcgtaggccgggttcgtacgggtacccgtagtttccacttctaccaccgtactccgaacgtcacgtaccctgacgtacggacgtaggaacgtagtggtacggtacgtttaagttttaattacttagtaccgtagacctaaacgttatttaacttaccgttttccgttttaccgttaaccgttacggttttaccgggaaccgggttaacggtaaccgtaagggtaggtacgtaactaaccggaaacgtaacgttagggtccgtacgtcgacctacgtacgtcttcgttactctaacccg

SEQ ID NO: 66190 - DNA, 570 bp, Homo sapiens
  misc_feature: GYAE6OF02FK4DB.31.78.H01.1.454.CMB.1.raw
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
  modified_base (332)..(332): a, c, t, g, unknown or other
  misc_feature (332)..(332): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggcccaccatcaactgacaagtccagccagtagtgttttattggccccacaataaccaactactancttggtaccagcagaagtaggacagcctacctaaactctagatttacngggtcttcgacccgggnacgtccgggttaccaacgtnttcattcggctagcggtctcgggaccgtntttcacctctaccaccatcagcgagcctgccaggctagaagtagtgtcggattagtttaactacgttgtacagtaccaacttatttactactttccgtttacgtctaccgttcgggcgtacggactagggtgacgagtaccgaaacgtctaggtacgtactgaccaccgtatccgtcgtccttactacg

SEQ ID NO: 66191 - DNA, 695 bp, Homo sapiens
  misc_feature: GYAE6OF02GEKGM.31.78.H01.1.454.CMB.1.raw
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctattgctctggatctctggtgcctacggggacatcgtgatgagccagtttccagacctccctggctgtcgtctcgtgggcgagacgggccaccataccaactgacaagtccagccagagttgttttattcggaccccacaataacactactagcttaggacagcaagaagtagcagacctacaaactctanacttacgnggtcttcgaccggnacgtcccgggtactaacgtnttcgagttcggcgtaggtccggtcgtacgggaccgttacttacaccgttcctacccgaacgtacttaccgaacgccgacgcccgtcgacgtacgggtacctaaggaaacgtacggttcggtacgggtaaccgttaaggttttaacgttaccgtttacggtaactacggtaacccgtaacttaacttacgtttaacccgtttcgttttaccgttaccgtttaccggttaccggggtaccgggaacgggtaccggtaagggtacgggtacgtaacgttaccggaaaacgtcgtacgggtccgtacgtacgtaccgtacgtacgttcgtcgttacccgtcttacccg

SEQ ID NO: 66192 - DNA, 689 bp, Homo sapiens
  misc_feature: GYAE6OF02F0NX2.31.78.H01.1.454.CMB.1.raw
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (637)..(637): a, c, t, g, unknown or other
  misc_feature (637)..(637): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagacgggccacatcaactgacaacgtccagccaagtacgtttgtttttacgttaccggaccccctaacctaaataaaccaaacttaaccttacgtcttaggtaaccagacaagaaaagtaggacagccctaacctaaactcctagtactttacgnggtccttccgtacccgggntacggttcccgggttactaaccgtattacattggcaggcggtcgtgggaaccctatttccacttccaccgaactntcagcacgtcctgcacggntagaanagttggtacggtacgttaagtttaccgttacgtgtaccaagtcctaaacgtatttactttaacctttacgttttacctaccggtttaccgtttcggggtacggtaacggtaacggtaacgggtaacggtagtaaacgaccggtaaaaacgtaccggtttacggnggtactaccgaccgtaaccttacggttcgtttccggttctttacgttacccg

SEQ ID NO: 66193 - DNA, 786 bp, Homo sapiens
  misc_feature: GYAE6OF02H8R2R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccggtacggggcacgtgtgatgacgcctagttccagtctccgtggctgtcgtctcgtgggacggaaggcggaccccaacgactaccgaacgtgaccgtaacgtccgacgaccaaaggtgttttacgtttttacgttccggaaccccctaactaaaactaaccgtaaacctttacgttacgtccgttaacggtaccagaacgtaaggaaacggttgaacctaccgtacctacccgtaaactccgttagtaacgtttcggtaccggttccttaccggacccgggttctaccgggttcccgggtttaacccacgttactcgttagtcggacggtcggtccggtcgtaccgggtacttctttaccgccgtacaccgccctaacgtctaccgctacgctcggacgtcgagtagtagtagtccggtgttacttacggtttacttggtacttaccgtaagtaacctaacttagtttactttaccgttttcgtttcccggttaaccgtttaccgggtttaaccgggaccgggtaacgggtaccggttaaggggtacgtaccgtaaacgtaacccggtacggttaaccggtcggtaccggttacgttaccgaccgtttaccgaccttttacggtccgtttacctcgttaccccgg

SEQ ID NO: 66194 - DNA, 766 bp, Homo sapiens
  misc_feature: GYAE6OF02JKWST.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccacatcaactgcaagtccagccagagttgtttattcggccccacaataacactacttagcttggtaccagcaagaaagtaggacacgccctacctaaactcctgtactttacgtcgggtccttccgtacccggggctacggttcccggggttacctaaccggtacttccgtagttcggcctaacggggtccgggttcgtacggggaacccgttacgttttaccgaaccttaccgtaccctaacccgtacgttaccgaacgaccgtaacggtccctaggtaccgtaacgggtacctaacggaaacggtacgttacgggtacggtacgttaacgttttaacgttaacgttacggtaccgaacgtaaccgtaaaccgttaagttttaaccgttaccgttttaccgttttaccgtacccgtttaccggtttacccggggacggggttaaaccgggtaaccgttaaggggtacgggtagtaacgtaccggtaaaacggtacgttcgggtacggtacgttacgaccttaaccgtacctttaccggttacgttacccttacgtaacccg

SEQ ID NO: 66195 - DNA, 750 bp, Homo sapiens
  misc_feature: GYAE6OF02FRTMF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacattcgtgatgagcctagtttccagacctccctggctgtgtctcgtgggcgaggacggccaaccatacaacgtgacctaacgtcccagaccagtagtttagttttagttccggaccccctaactaaataaaccaacttaacttacgaccgttacggtaaccagacgaaaggtaaaggtaacgggacacggtacccctaccgtaaaaccttaccgtagttaactttaccgtcgggttccctttacccggtaaccccgggtaccgtacgggtttaccccgggggttaacccctaaaaccggttcgttaacggtacgttcgggacgtacggggtccggggttacgtcggggtaacccgtattttacgaaccgttcctacaaccctataccgaacggtacacgcctagccgtaggtactaggaaacgtaggtcggtacggtacttagtttaagtaccgtgtaccaagttactaaacttagtttaacttactttcccgtttagtaccgttacggttccgggtacggacggtaacgggaggtgaacgtacaacgtaaacggtatcggtagtaccgtgacaccggttatcggtcttaccgacttacg

SEQ ID NO: 66196 - DNA, 872 bp, Homo sapiens
  misc_feature: GYAE6OF02HCO9Q.31.78.H01.1.454.CMB.1.raw
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtagcctacggggacatcgtgatgagccagtttccagactccctggtctgtgtctcngggcgagacgggccaccnctcaactggaccaagtcccagcccgaagtaggtttagtttttagtttcccgggacccccctaacctaaacttaaaacctaaccgttaaccttttaacggaccgttttaccggggttaacccgaacggtaccccgtaaacgggtaaaaacggttaaggggaacctaaaccgggtcccctttaacccgtaaaaccttccccgttaggtaacctttttacgtaccggggtcctttaccccggtaaccccggggtccacgggttttaccccgggggtttaccccctaacccgggttaatttccgtaacggttttgggccctagggtcccggggtttccgaggggggttaacccctagttttccctaaccgttaccgttacccaccggtacttaccggaggtccctacgccccgtagtccgaagggtccgtggtaaacgtaggtcggtacggacgttacgttttaacgttacgttagtccgtacgtaccgaattaactttacgttactttacccgttttcgttaccgtttacggttaccgccggggtaaccgggtaaccgggtacgtggggtaacgtaacgtacccggtaaaacggttagttccgggtaggtaccgttaggtacccttaccggtacttcccggtttaacgttcccgttagtacccg

SEQ ID NO: 66197 - DNA, 774 bp, Homo sapiens
  misc_feature: GYAE6OF02JK6SA.31.78.H01.1.454.CMB.1.raw
  modified_base (382)..(382): a, c, t, g, unknown or other
  misc_feature (382)..(382): n is a, c, g, or t
  modified_base (403)..(403): a, c, t, g, unknown or other
  misc_feature (403)..(403): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggtaggctaacaacacggcaggcagggcagcaagatggtgttgcagaccctaggtcttcgactttctctgttgtccttctggattcctctggtcgccgtaccgggactagtccgtgtactggacgtcctagtttccagtcctcccgtggtctgtcgtctcgtgggcgagacgggcctacgactacagtgactacgtccagaccagtagtttcgttttcgttaccggcccctaactaaactaacttaacttacgttaggccttacggtaccgagacaacggaacggtagacgtaccgtacctaccaacgtcctagtacgtttacggnggtccttaccggaacccggtntaaccggttcccgggttacctaacgtacgttacgtacgtcggtacgacggttcggtcgtaccgggaacttacttcgttacgaccttacgaccgtatcggacgaccncgtaccgtacggaccgttacggacgtaagtaaacgtcgtacgggtacgtacctttagtttaaccgtacttcgttaccgaagtaaaccctacggttacttttacgtacggtttttcgtaccgttaccgtacggtttcccgggaacgggtaccggttaaaccgttagggtaccgtaacgtaaccggacggttaaacccggtaattaccgggcgttacgtaccggtaaccctggtaccgttacgtacggtttaccctaccgttacccg

SEQ ID NO: 66198 - DNA, 686 bp, Homo sapiens
  misc_feature: GYAE6OF02F4W79.31.78.H01.1.454.CMB.1.raw
  modified_base (657)..(657): a, c, t, g, unknown or other
  misc_feature (657)..(657): n is a, c, g, or t
  modified_base (666)..(666): a, c, t, g, unknown or other
  misc_feature (666)..(666): n is a, c, g, or t
  modified_base (671)..(671): a, c, t, g, unknown or other
  misc_feature (671)..(671): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggagggccaccatcaactgacaagtccagccagtagttgttttattcggaccccaacaataacaactactagcttaggtaaccagacaagaaagtaggacagcctacctaaactcgtagtaactttacgtgggtacttccgacccgggtctacggttcccggggttaacctaaccgtattacgtaacttcggacgtacggtccgggtactacgggggtaaccttacgtttacctacgtaccttaccaaccgtacgtaccaacgtcgaacgcccgttaggaccgtaacgggtaccgtaaggaaaggtaacgtagggtcggtacctttaaggttttaaactacgttagttacaacggtactaaacgttatttaaacttactttaccgtttcgttactaacgtttcgggaacggtacggaacgagggttacgagtactaacgaaacgtaagtcggtacgntcgactacncgttntacttcgtactaccg

SEQ ID NO: 66199 - DNA, 772 bp, Homo sapiens
  misc_feature: GYAE6OF02I57P6.31.78.H01.1.454.CMB.1.raw
  modified_base (305)..(305): a, c, t, g, unknown or other
  misc_feature (305)..(305): n is a, c, g, or t
tcagcagtagacgtcacgaccggtgctcgatttagtgtgagtagtttgggtttgggggtaggcgtacaacgaggcaggcagggcgagcaagatggtgttgcagacccaggtcttcatttctctgttgctctggatctctgtgcctacggggacatcgtgatgagccagtttccagactccctggctgtgtctctggacgagaggccacctatcaactgacaacgtcagccgagcgttatttttagttcggacccccacaataacctaactactttacggcttaggtacccagaccaaggtaaagnggtaccaggtaccgtaccccttaaaactccgtagtacttttaaaccgtcggggtacctttaccgtaccccccggggtaacgagtttcccccggggggttacctttaaacccgacgttttacctacggttcggacgtaggcccggggtcttcggggggaacctaacttttccgaccctcgttcgaaccctagtccgtacgctacgcccgttaggaccccgtaggcgttacggtaaaggtcgttacggttacgggaccgtttacgtttaaacgtttcgtacggttaaccgtaacgtaccgtaacttaacgtttaacgttactttccgtttacgttaccgtaccgtttttacggggaccgtaaacggttaacccggaagggtttacggacgtacgttaacgaaaccggttaatcgggttacgacgtttacggactaccctagttaccgtcggtttacccacgttaacccg

SEQ ID NO: 66200 - DNA, 812 bp, Homo sapiens
  misc_feature: GYAE6OF02IE9T5.31.78.H01.1.454.CMB.1.raw
  modified_base (121)..(121): a, c, t, g, unknown or other
  misc_feature (121)..(121): n is a, c, g, or t
  modified_base (162)..(162): a, c, t, g, unknown or other
  misc_feature (162)..(162): n is a, c, g, or t
  modified_base (191)..(191): a, c, t, g, unknown or other
  misc_feature (191)..(191): n is a, c, g, or t
  modified_base (513)..(513): a, c, t, g, unknown or other
  misc_feature (513)..(513): n is a, c, g, or t
  modified_base (584)..(584): a, c, t, g, unknown or other
  misc_feature (584)..(584): n is a, c, g, or t
  modified_base (645)..(645): a, c, t, g, unknown or other
  misc_feature (645)..(645): n is a, c, g, or t
tcagcagtagacgtcacgaccggtgctcgatttagtgtgagtagtttgggtttgggggaactacaacaggcaggcaggggcagcaagatggtgtgcagacccaggtcttcatttctctgtnctacgtggatctcgtggtcgccgtaacggggctagtcgtanacgtgacgtcctagttccaagtcctccgnggtcctgtcgtctacggtgggacgacggaccggaccaaccgtacgtaccaaacggtcgacgttaaaccgtcccgacgtaccgaagggttatttacggtttttaccgaccccggaccctaacaaaattaaacctaaccggttacttacgggtacctttaaccggtacgaacgaaccgtaaagggtaaacggtaaccgtaacggaccgtaccccttaaaacccggttaaccggtcctttaaaggttccggttttaacggccgggttccctttaacccccgggacgggtaccgttaccgggttacccggttaacccttaaaccgntttaacgtcggtacgaggtaccgggtcgggtacgaccggttactattaccgacgttccacacctagcgacnccgaagtcgcacggcgtaataggtctatcggtaacgttcttaagtttacgacgtacggtanaacccgtaatacttaacttcgttacgtttacccggttactaccgggttcgttaacggggcgtaaccggtacgggtcgttaaggaaccgtactaaccggggtctaacggtcgtacggtacgccgtaaccttacggttctacctttaccggtcctaccgttcctacccc

SEQ ID NO: 66201 - DNA, 662 bp, Homo sapiens
  misc_feature: GYAE6OF02GAJ4Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgcaagtccagccagagttgttttattcggccccaacaataacaactactagtcgttgtacagcaagaaagtagacacgtcctacctaaactcctagtactttacgtggtccttaccgtacccgggctacgttacccggggttaccctaaaccggtacttacgacgttggaccgtaggcgggttcgtacgggtaccgtatttccacttcctaccgacctatccgacgcgtacgtcctgcgaggtctagaagtgtacggtaggtacttagtttataacgttcgtacacgtactaaacgtatttaaccgtaccttttccgtttcgtaccgttaccgtttccggggaccggtaacgggtaaccgtaggggtacgtaggtaactaaccggaaaacgtacgttaggtacgtacgtacgcctacgtacgttccgttacgttccgttagtacccc

SEQ ID NO: 66202 - DNA, 779 bp, Homo sapiens
  misc_feature: GYAE6OF02J28WJ.31.78.H01.1.454.CMB.1.raw
  modified_base (230)..(230): a, c, t, g, unknown or other
  misc_feature (230)..(230): n is a, c, g, or t
  modified_base (386)..(386): a, c, t, g, unknown or other
  misc_feature (386)..(386): n is a, c, g, or t
  modified_base (629)..(629): a, c, t, g, unknown or other
  misc_feature (629)..(629): n is a, c, g, or t
  modified_base (759)..(759): a, c, t, g, unknown or other
  misc_feature (759)..(759): n is a, c, g, or t
tcagcagtagacgtcacgaccggtgctcgatttagtgtgagtagttgggtttgggggaggctacgaacaggcaggcaggggcaggcaagatggtgttgcagacccaggtcttcattctctgtgctctggactctcgtggtcgaccgtacgggacagttcgtgagtgacgtcctagttccagtccctccgtggtctggtctcgtcggtcgggcgaggacgggcccacgtancacgtgccgaacggtccagcctaggcgtttcgtttaccgtccggacccccaataaactaaccgtaaccttacgtacgtcctaggtaccaaggacctaaaggaaacgtcgacctaccggacccttaacccaacgtcctaaggtactttaacccgggnggttaccctaccgggtacccggtactaccggggtttacccgggtcctaaaccgttgtccgttaaacgtcgggacccgttagggggcccgggtttaaacgttccggggaaacccttttgttaccccaaacgttttccccgaacccaaaccccgttggaaccgaccgggtccgacgtttccgacgtaccgtacgtacggtaacgaagtaacgtggtaccggtaactaggtttaccgtacgttacncgtaacaccgtaacttaacgttcttccgtttacgttaccgttacggtaccggttaccggagggtaacccggtaaggtacgacgtaagtccctaaagacggtgtacggtacgtaccgtcgaactccgttancgtttacgtccgtcgttacc

SEQ ID NO: 66203 - DNA, 662 bp, Homo sapiens
  misc_feature: GYAE6OF02JNR0F.31.78.H01.1.454.CMB.1.raw
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
  modified_base (465)..(465): a, c, t, g, unknown or other
  misc_feature (465)..(465): n is a, c, g, or t
  modified_base (585)..(585): a, c, t, g, unknown or other
  misc_feature (585)..(585): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctntggtnccgtacggggacatcgtgatgagcctagtttccagacctcctggctgtgtctcgtgggcgaggacgggcccaccatcaactcgacaacgtccacggccaagtagtttgttttacgttcgaccccaactaataacctaactacttacgcgttacggacacgcgaaagtaaaggtacggactacgtaccctaaccttaaacctcgtagttactttacgcggtaccttccggtaacccgggctaccggttccccgggttaccaaccggttctttacgacgttcggactacgggtccgggtcgtagggtaccctattcactccacacctntacgacgcacgtcctaggctacggctaaggatagtcgtacgtcttagttactcgtcgactagtactaactattacttacctttcgttaccgtcttaccggttcggacggtacggtaacgngggtagactacgtaaccgtaaggtacgtcggtagtccgtacaacccggtctacgttccggtacttccgtagtacccg

SEQ ID NO: 66204 - DNA, 1012 bp, Homo sapiens
  misc_feature: GYAE6OF02GV47C.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagtacctccgtggctgtgtctcgtcgggcgaggacggcccaacataccgaactgacctaacgtaccagaccgaagtaggtttacgtttttagttccggaccccctaactaaacgttaaaaccaaacctttaaccgtttacgtaccgttttacggtaacccgaacgtaccgtaaaggtaaaaaggttaacggaaccgtaaccgtaccccgtttaaacccgttaaaaaccgttcccgttaacgttaacggttttaccgtacgggggtaccttttaccccgggaaccccggggtacttaacccgggtttccccggggttaaccccttaaaccgtaacgtttacgtacgtttacggaccgtaacgggtccggggttaccggttacgggggtaacccgttaacgtttttcccgtaaccgtacccgttaaccgtaacccgtaagttacccgtaacggacccgtaaccgtacccggttcggaaccggtaacgggtaaccgtaacgggtaaaacgttacggttacgggttaccggtaaccggtttaaacggtttttaaaccgttaaccggttccgttaaccgtaaacgggtaaccctaaaaacgtttaaccttttaaaccgttaacccgttttttccgtttaaacccggttacgttttaacccgggtttacccggggttaaaccgggtaaacccggggttaaacgtaacccggggttaggtaaacggttaaccgttaaacccggttaaaaaccgggtaccggtttaacgggtaacggtaacccgtttacgtaacccgtaacccgtttacgttaccgttttacccggttacccttacctttaaccccgg

SEQ ID NO: 66205 - DNA, 861 bp, Homo sapiens
  misc_feature: GYAE6OF02IXFFS.31.78.H01.1.454.CMB.1.raw
  modified_base (185)..(185): a, c, t, g, unknown or other
  misc_feature (185)..(185): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgacgcctagttccagtcctcccgnggctgtgtctcgtgggcgaggacggccaccatccaacgtgactaacggtccacgaccgaagtaggttcgtttttacgttccggaccccctaactaaactaaccgtaaccttacgttacgtacggtttacggaaccctaagtaccgaaaggtaaaacggtacggaaccctacgtaaccccgttaacccgtaaaaccttcccgtagttaacgttttacgtaccgggtcctttaccccggtaccccgggtacgttacccggtttccccggggttaaccccttaaacccgggtactttaccgtaacggttcggtacccggtacggggttcccgggttaccggtaaccggggtaccccgttattttaacccgaccgttaccctacccgtaaccggtacgttaccgaaccgtccgtaccgtacccgtaccggtacgaacgggtacgtacggtaacggtaacggttcggtaggtaccttaaggttttaccgttacgttacgtacgtaaccgtaacgtaacttactttaaccgtttccgtttaacgtttacccggttaccgttccggttaccggggtaccggtacgggtaaccgtaagggttacgacgtaacgtaaccgaaggttacctagggtcccgtagttaccaccgtaccgttagaccgtttcgttaccttacgtacccg

SEQ ID NO: 66206 - DNA, 751 bp, Homo sapiens
  misc_feature: GYAE6OF02FWO55.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccgtggctgtgtctgtgggcgagacgggccacagtccaacgtgcaagtccagccaggagttgttttattcggccccaacaataacaactacttagcttaggtaccagacgaacgaaagtacggacagtacctacctaaactcctagtactttacgtggaccttacgtacccgggactacgttacccggggttaccctaaaccggtacttacgacgtttcggactacgggtccgggttacggtacggggtaacccgttacgttttaccgaaccttaccgtaccgtaacccgtaagttcccgaagtaccggaacgtacccgtttaggaccgaacgggtccttaacggaagtaacgttcgggtacgtacccttaaggttttaacttacgtacgtacgaacgtactaaacgttaacttaacgttacgtttaccgtttcgtaccgttacggtttaccgggacggtaacgggtaactaaggggttagtacgtaacggtaaccgtaaacggtaacgttacgggtacggtaccgttagacccgtaacctagttaccctttacgttacccgttaccgttacccg

SEQ ID NO: 66207 - DNA, 658 bp, Homo sapiens
  misc_feature: GYAE6OF02GT7EW.31.78.H01.1.454.CMB.1.raw
  modified_base (419)..(419): a, c, t, g, unknown or other
  misc_feature (419)..(419): n is a, c, g, or t
  modified_base (647)..(647): a, c, t, g, unknown or other
  misc_feature (647)..(647): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggggacagtcgtgatgagcctagtttccagacctccctggctgtgtctcgtgggcaggagggccaccatcaactgacaacgtccagccagtagttgttttacgttcggcccccaacaactaaacaacttacttagcttcggaaccagacaaggaaagtaggactacgtaccctacctaaacctccttagtactttacgtcgggtcttaccgaccggctaacgtcccgggtacctactactcagtgcaggtcggtcgacgggactacttcactcncactagacacggcacgtcctgacgtacggctaagacggtattgggtacgtcgttaaggtttactacggttacgacgtaacgtactaaacgtttattaacgtttcctttaccgtttacgtaccggttacgtttacgggaccgggtaacggaaccgtagggttacggactaacgtaacgaaccggtagttccggtaacggtactcgaacctcgtacgttgtttacccgtnttaccgtaccg

SEQ ID NO: 66208 - DNA, 617 bp, Homo sapiens
  misc_feature: GYAE6OF02GBRJI.31.78.H01.1.454.CMB.1.raw
  modified_base (333)..(333): a, c, t, g, unknown or other
  misc_feature (333)..(333): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgacaagtccagccagtagttgttttattcggacccccaacaataaacctaactacttagtcttaggtaccagacaagaaagtaggacagcctacctaaacctcctagtactttacgnggtcttaccgacccggctacgttcccggggtacctaccgattcgagttcggcaggtcggtcgtcggaccgtattcactctacaccatcagcacgtcctcgacgacggctaggaagtagttggtacgtacgttaagttttactcgtacgttacaacgtactaacgtatttacgttacctttcgtttcgtacttacgtttccgggacggtacgggaaccgtagggtagtacgtacgtacgtaaacgtacgtgtacgacgtcacgactcgtcctcttcctactaccg

SEQ ID NO: 66209 - DNA, 688 bp, Homo sapiens
  misc_feature: GYAE6OF02H31D5.31.78.H01.1.454.CMB.1.raw
  modified_base (278)..(278): a, c, t, g, unknown or other
  misc_feature (278)..(278): n is a, c, g, or t
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtagttgcagacccaggtcttcatttctctgttgctctggatctcgtggtcgcctacggggacagtcggtgatggagcctagtttccagacctccctggtctgtgtctcgtggacgagacggccacatcaactgacaagtccagccagtgttgttttacgtcgaccccaataataaccacttatacgngttcggtacacgtacaaggaagtcgaccagtcctaccctaatccttagtattacgcggtcctaccggaccgtgtaccgggttccggttaacctaacgtgttctacgtggtccaggggcggttacgtcgggaaccttacgtttccgaccttcttaacccgaactacgttcgaaacgtcgtacgtccgttcgaccgtaaggccgtaagtaacgtgtcgttagggtaccttaaggtttccgttancgggttaacagtaccaatttacgttaacttccgttttaccgtttcgtaactttcccggttgggaaccggttaaacggtaccgtaggggtatacggtaacgtaccgtaaacgtaccgttgggtaacttcggactccgtaccgttacgttcttacgttccttaccggtcc

SEQ ID NO: 66210 - DNA, 754 bp, Homo sapiens
  misc_feature: GYAE6OF02HJART.31.78.H01.1.454.CMB.1.raw
  modified_base (735)..(735): a, c, t, g, unknown or other
  misc_feature (735)..(735): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgagtgagcctagtttccaggacctccctggctgtcgttctcgtcgggacgaggcggtccacagtcgaactgacgaacgtccacgacctaaggtacgtttacgtttacgttccggacccctaaactaactaaaccttaaccgttacgttaacggtccgttacggtaaccaggaccgtaaaggtaaacggtaacggaactaccggtaccttaacccttaactaccgtacgtttaacttacggtaccggtccgtttaacccggacccggtactaccggtttaccccggggttaccctaaacgtgtttacctaggttaaccggccgtacgggtaccgggttacggtcggggtaaaccttaccggttacttaacccggtacttccccgaacgttaactcgaaccgtacccgttacgtaccgtacggacgaccgtacgtaaggtacgtagtacggtcgtattacgttacgttagtacgctacgaactacgttactacgtttacgttcgtcgtacgttcgtacgggtaccgaggtacggagtacgacgtacgtacgtaaacgtgtacgtggtacagtcctacgngttacgtctacgttctccg

SEQ ID NO: 66211 - DNA, 716 bp, Homo sapiens
  misc_feature: GYAE6OF02FR4E5.31.78.H01.1.454.CMB.1.raw
  modified_base (186)..(186): a, c, t, g, unknown or other
  misc_feature (186)..(186): n is a, c, g, or t
  modified_base (681)..(681): a, c, t, g, unknown or other
  misc_feature (681)..(681): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactcctggctgtntctcgtgggcgagacggccaccatacactaaaaagcaacgtccacgccagtattgtttttagttccggaccccaaccaaactaacaactacttagcttaggtaccaagcgaaaggtaaacgtaggaaccacgtaccccttaacccgtaaacctccgtagtaagtttaccgtcgggtcctttaccgtacccgggcgtaccggttccccggggttacctaaccgtacttctagttggacaggtcgggtcgtacgggtaccgtattcctactcctaccgacctacgtaccgacgaccgacgtccctaggccgtaacgggtcttaaaggaacggttagttcgggtacggtacgttaacgttttactacgtttacgaccgtaagtaccttaaacttaacgtttactttacgttttccttttcgtactttacccggttcggggacgttacggaacgttaggggtcgtaacgaactaaccgaaacggttactacgggtcgtntaaccgcttaccgtattcggtcttcctactacccg

SEQ ID NO: 66212 - DNA, 860 bp, Homo sapiens
  misc_feature: GYAE6OF02G8SF0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagttccagactcctggctgtgtcttctgggcgaggagggcccacagtcaatgaccaagtccagaccagtacgttgtttttattcggacccccaactaaactaacgtaaccttaacttagtccgtttacggtaaccagtaaccgaaaggtaaaaggtaacgggaacctacggtaaccccttaacccgttaaaaccgttccgttaacgttaaccttttaaccggtacggggttacctttaccgggtaaccccgggtacgtaccggttccccgggggtttaaccctaaacccggtacttacgtacgtttggaccgtacgggtccgggttacggtacggggtaccgttaactttaccgaccttccgtaccgtaacctattaccgacgtaccgacgtccgtacgccgtaaggtccgtacggtaaaggtacgttacgggtacggtacgttaaggttttaacgtacgttacggtacgtacgtaacttaaacgtactttaaacgtttaccttttaccgttacgtttaccgtaacgggtttaccggtaccggggtaaacggttaaaccggtaacgggttacgggtaacgtaaccgttaaccggtaaaacggttaaccgttcggggtaaccggtacggttacccggtaacccgttaacggttaaccgttaccggtttaaccgttacccgttaccgtttaaccccgg

SEQ ID NO: 66213 - DNA, 911 bp, Homo sapiens
  misc_feature: GYAE6OF02IKIWO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtggggcgaaggcgggcccaccgataccaacgttcgaccgtaaacggttcccacggacccaaggtaacggttttggtttttttaacgtttcccgggaaccccccctaaaccgtaaaacgttaaaaaccctaaaccttttaaaccgtttaacggtccgttttaaccggggttaaacccctaacggaccgtaaaagggtaaaacggttaacggggaacctaccgggtaccccttaacccctttaaaaacccgttccccgttaacggttaaccgttttaaccggttcgggttcccgtttacccggtaaccccgggggtaccttacgggtttaccccgggggtttaccccttaaaaccggtactttacgtaagttccgggacgtaaccgggtccggggttacggtaccgggggtacccttaacgttttacccggaaaccctttcggtaaccctaaccggaccgttttacgaaaccggcccgtaacgtcccggtaccgtcggaaccgggtacggttaggaaacggtacggtcggttacggtaccgtttaacgggtttattacccgttcgacgttaacgcgtaaactactttaacttacttccgtttacctacgttccgtttcgggaccgggttacggaaccgtaagggttcgaacggtcttaaccgaacgtacggtgtacggtctacgacctaccgtacgtcgtttaacgtccgttattacccg

SEQ ID NO: 66214 - DNA, 753 bp, Homo sapiens
  misc_feature: GYAE6OF02HWLLY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatacaactgacctaacggtccacgccaaggtaggttgtttttaagttccggaccccctaaactaaaactaaacaaaccttaacgttacgtaccgttacgggtaaccagtacaaggaaacggtaacggaaccacggaccctacctaaacctccgttagtacgtttacgtcggtcttccgtacccgggcgtaccgttccggggttacctaaccggtacttactagttcggcgtacggtccgggtcggtacgggtaccgttacttaccgtactcctacgacctacgtccacgaccgtacgtccgtagccgtacggtactaggtaacgtagtcgggtacggtacgttacgtttaacgttacgttacgtaccgacgtactaaacttagtttacttactttccgtttacgttaccgttaccggtttccgggtacggggtaacggtaaccgggtaagggtcggaacgtaacgtaaccgtaaacggtaacggttaggtccggtacggtacgtaccgtacgttacgttcgttacggtttctaccttacccg

SEQ ID NO: 66215 - DNA, 743 bp, Homo sapiens
  misc_feature: GYAE6OF02JHEA0.31.78.H01.1.454.CMB.1.raw
  modified_base (533)..(533): a, c, t, g, unknown or other
  misc_feature (533)..(533): n is a, c, g, or t
  modified_base (722)..(722): a, c, t, g, unknown or other
  misc_feature (722)..(722): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagtacctagttccagacctccctggctgtgtctcgtggacgagacggccacactacaacgtgactaacgtccagtaccgaggtacgttgtttttaacgttccggacccctaacctaaataaacctaaccttacgttaacgtcttacggaaccctagaaccgaaggtaaaaggtacggaaccacgtacccctaccctaaaacctccgtacgttaacgttttaccggtcgggtacctttaccggtaaccccgggactaccggttacccggggttaaccctaaaccgttattaccgtaagttggacccgtaagggtccgggtacgttacgggtacctatttccaacctctaccgactaacgtcaacgccgacgtcncgtcgacggatacgatacgtgtacgcgttaagtttactacgtacgtagtacgtacctaactaacttagtttaccgtttactttccggtacttaaccgggtttcggggtaaccgggtaacggtaacggtacggtacggtaaggtaaccgtaaccgtaaaggtaccggtgtacgggtcaacggtcaacctnttacgtcgttacctactaccc

SEQ ID NO: 66216 - DNA, 854 bp, Homo sapiens
  misc_feature: GYAE6OF02JX6WR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcctggctgtgtctcgtggacgaggacgggccaccgataccaacgtgaccaagtccagccgaggtacgttgtttttacgttcggcccccaacgtaaataaacctaacttaacgttacgtcttacggtaccagacgaaagtaaagtacggacacgtcctaaccgtaaactcctagtactttacgtcggtaccttcccgaccgggtctaccggttacccggggttaccttaaaccccggttattccgtaagtttcgggaccgttacgggccgggttaccggagggggttaacccttagttttaccctacgtaccctaccgtaaccgtactaccgtacgtaccgaccgtccttacggacggtacggtacgtaagtaaacggtacgttcggttaccggtaacgtacgttttttaaagttacccgttaggtacccgtaaggtaaccctaaaacgttttaccggtttaaaaccgttttaccctttttacccgggttttcgtttaaccccggttaacccggggtttttccggggaaaacccggggttaccgggtaaacccgggttaagggtaacgggtaacgttaaccttaaccgggtaaaaccggttaacgttcgggtaccgggttaccctagggtacccctaaacgttcccgtaacggtttcgtaacccttttacccggtaccc

SEQ ID NO: 66217 - DNA, 638 bp, Homo sapiens
  misc_feature: GYAE6OF02GOZSE.31.78.H01.1.454.CMB.1.raw
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacagtcgtgatgagccagtttccagacctccctggctgtgtctctgggcgagaggccaccatcaactgacaacgtccagccgagagttgtttttattcggccccactaataccaactacttagcttagaccagcaagaagtaggacacgcctacctaaacgtctagtattacgtgggccttccgtacccggctacgttcccggggttacctaaccggtnttccaagttcggacctaggtccgggtcgtacgggacccgtattttcaccttcgtaccacacgtcacgcacgtcctgccagtacctagaacgtagtggtacggtattacgtttattacgttgtcacgaacctactagtttaacttacttttctttaccgttaccttacggttttaccggaccgggtaacggtacgaacgggtggtacgtactaacgaaacgttaactcgggtacgtacgtcgaaccgctagtcttccggttactcttacccg

SEQ ID NO: 66218 - DNA, 621 bp, Homo sapiens
  misc_feature: GYAE6OF02ISRVG.31.78.H01.1.454.CMB.1.raw
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (426)..(426): a, c, t, g, unknown or other
  misc_feature (426)..(426): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgcctacggggacatcgtgactggacgcctagtttccagtcctcccgtggctgtcgtctcgtgggcgaggacgggccactatcaacgtgacaacgtccagccagacgttgttttactcgaccccaacgaataacactacttagcgttacgtaccagcaaggaacgtagacacgaccttacctaaactcctagtacttacgcggtaccttaccgtacccgggntacgttaccgggttacctaaccgtnttcagtcgctaggcggtcgtacggcctattcactctacacntcacgcagcctgcgacgtcgtagacgtagttcgtacgtacttagttacgtagttgtacgactactaacttacgttacttaccttcgttccgtacgttaccgttacggcggtacgaacggtacgtagacgtacgtacgaacgtaacgtggtaccggtacgtcgacgtcgtacttcggtacttaccgtagttacccg

SEQ ID NO: 66219 - DNA, 880 bp, Homo sapiens
  misc_feature: GYAE6OF02GS2P4.31.78.H01.1.454.CMB.1.raw
  modified_base (192)..(192): a, c, t, g, unknown or other
  misc_feature (192)..(192): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtcgccgtacggggacagtccgtagactggacgtccgtacgttccagacctccgngtctgtcgtcgtcgtgggcgagacggccacactacaacgtgaccgaacgtccagtccgaagtagttcgtttaagttccggacccctaacgtaaataaccgtaaccttaacgttacgtaccgtttacggtaaccgagaacgtaaacggtaaaaagtacgggaaccctaagggtaccccttaaaccctaaaaccggttccccgtaaaggttaaccgttttaaccggtcgggtaccttttacccggtaacccggggactaccggtttacccggggttacctaaaccggtacttcgtaggttacgacgtacggtcgggttacgtacgggtaccgtatttaccgacgttcctaacgaccctagtaccggacaccgtaaccggtccctaggacctaacgggtacgtaacggtaaacgtaacgggttccggtaaggtaaccgtttaaggtttaacccgttaacgttacggtacgtaaaccgttaacctaaacgttaacgtttaacctttccggttttacccgttagttacccgttaaccggtttagggaacccgggtaaacgggtaacgtaaacggggttaccgttagtaaccggttaaaccggtaaacggttaacgggttcggtaaaccggtaccggttaccaaccgttaacggttcccgttaacgggtttcccttaacgttcccggtaacccg

SEQ ID NO: 66220 - DNA, 718 bp, Homo sapiens
  misc_feature: GYAE6OF02FNBHY.31.78.H01.1.454.CMB.1.raw
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (379)..(379): a, c, t, g, unknown or other
  misc_feature (379)..(379): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccctacgggacatcggtgatgagccagtttccagacctcccgtggctgtcgtctcgtgggcgagacgggcccaccatcaactgactaacgtccagccagtgttgttttattcggacccccaacaataaccaactacttagcgttagaccagacaagaagtgacacncctacctaactcctntattacgtggtccttaccgcccgggactacgttcccggggttacctaaccgtacttcgngttcggacgtacgggtcgggttaccgtacggggacccttacttttcccgactttaccgtaaccaccctagttaccgaacgtcccacggtcccgtggccgtaggtcccgtaaggaaacgtagttcgggtggtactttaacgtttaacgttccttagtacccgaagtacctaactaacgtttaactttacctttccgttttaccgttaccgttacggtttccgggaacggtaaccgggtacgaagggttaggacgttaaccgttaacggtaaaacggtccgttacgggtacggttacgttaccgacctaccgtagttccgtttacttaccgtttacctccg

SEQ ID NO: 66221 - DNA, 842 bp, Homo sapiens
  misc_feature: GYAE6OF02HB014.31.78.H01.1.454.CMB.1.raw
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcggtgatgacgtcctagtttccaagacctcccgtggcctgtcgtctcgtgggacgaggacggccaacgtataccaacgtgacctaacgtccaagccaggtagtttacgttttacgtacccggaccccctaaactaaactaaactaaccgttaacgttacggtccgtttaacgggtaacccaggaccgtaaaaggtaaacggtacggaacctacggtaccccttaacctaaaccgtccgttaaggtaaccgtttccggacgggttaccttaccccggtacccggggtacttaccgggttacccggggttacccctaaaccggtcttacgtacgttcggaaccgtgggtccgggtaccgtaggggaacccttcgtttacnccgttctacctacctacgtacgacgtccacggtccgtacggacgacggtacggtaagtaaccggttaggtcggttaaccggtacgtttaaacggttttaccttaacggttcgtaaccggacgttaaacctaacgtttacgtttaactttaacccgtttccgtttaccgtcggtttaacccgtttcgggggaacggttaaccgggaaaccgttagggtacggtaacttacgtaaacccggtaacgttaacggttggtaaccgtcgtaacctacgacccgtttacttccggttacgtcccttaaccggtccc

SEQ ID NO: 66222 - DNA, 612 bp, Homo sapiens
  misc_feature: GYAE6OF02IZ9W9.31.78.H01.1.454.CMB.1.raw
  modified_base (190)..(190): a, c, t, g, unknown or other
  misc_feature (190)..(190): n is a, c, g, or t
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (410)..(410): a, c, t, g, unknown or other
  misc_feature (410)..(410): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaggggacatcgtgatgagccagtttccagactcccgtggctgtgtctntgggcgagaggccaccatcaatgacaagtccagcctagacgttgttttattcggcccctaacaataacaactacttagcttggaccagacagaaagtaggacagcctactaaactctgatttcgnggcttcgaccgggnacgtccgggttacaaacgtnttcattggcaggcggtctgggaaccgntttcacgtctacacactcgagctaagcctgacgngactgaaagtacgtgtcggatagtttatacgtgtacacgtacaaactagttaacttactttcgtttaccgactacgttttccggaacgggtacgaaccgtaacggttggaacgtactaaacggtaaaccggtaacgttgggtaacgttacgtacggtaaccgtacccgttaagttcccgttagttaccgttaccttaaccgg

SEQ ID NO: 66223 - DNA, 739 bp, Homo sapiens
  misc_feature: GYAE6OF02JGF0Y.31.78.H01.1.454.CMB.1.raw
  modified_base (716)..(716): a, c, t, g, unknown or other
  misc_feature (716)..(716): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagtacctccctggctgtgtctcgtgggcgagacgggcccaacataccgaactcgacgtaacgtcccagcctaaggtacgtttaggttttttaacttccggacccccctaaacctaaacttaaacgtaaacttaaccttaaggcctttacgggtaaccccaggaccaaaggtaaaacggttacggaaccacgtacccctaacccttaaaacctcccgtagtaacttttacggtacgggtccttacccggtaacccgggtctaccggttaccccggggttaccctaaaccggtattcctaggttcggactacggggtcggttacgtacgggtaacccgtctttaccgaccttcgttaccacctgtaccgagcccgtaacgccgttagaccgtaggtcgttacggaagtacgttggacggtaccgtttaagtttacttacgtacgtcacgtactaactaacttattacttcctttacgtcttacgttcggacggtacgtaacgacggtagacgactaccggtaaacgacgtggtacgactacgacncgtacttcgtacgtctacgtacc

SEQ ID NO: 66224 - DNA, 671 bp, Homo sapiens
  misc_feature: GYAE6OF02HAA6M.31.78.H01.1.454.CMB.1.raw
  modified_base (206)..(206): a, c, t, g, unknown or other
  misc_feature (206)..(206): n is a, c, g, or t
  modified_base (370)..(370): a, c, t, g, unknown or other
  misc_feature (370)..(370): n is a, c, g, or t
  modified_base (460)..(460): a, c, t, g, unknown or other
  misc_feature (460)..(460): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactcccgtggtctgtcgtctcgtgggacgaggngggcccaccatacaactgaccaacgtccagccaggtacgtttgtttttacttccgacccccaacctaaataaccaacttacttagccttaggaccagacaagaaagtagacagtccctaacctaaactcctagtatttacgtcgggtaccttaccgacccgggnttacggtccccggggtttacaaccggtacttccgtagttcggctcggggtcgggtcgtacgggaccttacgtttcaccgtcctacgaccngtcacgcacgccngcacggntacgaancgtgtacggcttaacgtttatactcgtacacgtactaacttaattacttacctttcgtttccgtacgttaccgtttcggggaccggttaacggtaaccgtaaggtacggtacgagtttaaccgaaacggttaacgtcggtaggccgttacgactccgtactcgttccgttactccgttaacccg

SEQ ID NO: 66225 - DNA, 612 bp, Homo sapiens
  misc_feature: GYAE6OF02FRR6K.31.78.H01.1.454.CMB.1.raw
  modified_base (336)..(336): a, c, t, g, unknown or other
  misc_feature (336)..(336): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagagggccaccatcaactgcaacgtccagccagtagttgttttattcggcccacaataacactactgcttaggacagcagaaagtagacacgcctacctaaactcctagtatttacgtgggccttaccgtacccgggntacggttcccggggttacctaaccgtattcacgttggcgaggtcgggtcgtacggggaccctatttcaccttctacctaccatccgagcacgtccgtgcgtacggtctaggaagtagtgtacggtacgttagtttacgttacgtgtacgaacgtactaactatttacttacctttcgtttcgttctacgttcgggacggtacggacgtaaggtacgacgtagtaacgaaacgtacgtcgtacgtcgtacgacacgtacgttcgtcgttctcgtacc

SEQ ID NO: 66226 - DNA, 886 bp, Homo sapiens
  misc_feature: GYAE6OF02IP3XK.31.78.H01.1.454.CMB.1.raw
  modified_base (728)..(728): a, c, t, g, unknown or other
  misc_feature (728)..(728): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctcttgttgctctggactctctggtcgccgtacgggacatcgtagagtgtagcctagtttccaggtacctcccgtggtctggttcgtcctacgtcgggacgacggaaccgggccaccgtatacacgtcgacctaacgtccacgtaccgtagtacgtttacgttttacgttaccggaccccctaactaaacgttaacctacgttaacgtttaaccgtccgtttacggaaccccgagtaaccgaaggttaaaacgggtacgtaaccgacggttaaccccttaacccgttaaaccttccgtttaggttaaccgtttttacgggtcccgggttaacccgttttcccggtaacccggggtaccttaacccgggtttaccccggggttaaccccgtttaaacgttccgtttacgtacggtttacggacccgttacgggtaccgggtttcgaaccgggggtaccgtttaaaccgttttccgaacgtttacccctaccggaaccttaaaccggttccgaaccggttacgtaccgacccgtacggtacgtaccggtacgtaacgggtaaacgttacggttacggtccggttacgttaacgttttaacgtacttcccggtanaaccgttacgtaacttacgttctttaacctttcgtttacttacgttacggttaccgggaggtacggtaaccgtaggtacgtacgtaagtaaccgttaacggtacgttcgtcgtccgtacgttaccgacgttacgttccttcgttaccgtacttacccg

SEQ ID NO: 66227 - DNA, 733 bp, Homo sapiens
  misc_feature: GYAE6OF02HUJ5Y.31.78.H01.1.454.CMB.1.raw
  modified_base (437)..(437): a, c, t, g, unknown or other
  misc_feature (437)..(437): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggcccaccagtaccaactcgaccaacgtcccagaccgaagtagtttgttttacgttccggacccccaactaaactaactaaaccttacgttacgtacgttacggtaaccagacgtaaaggtaaacggtacggaacacgtacccttacctaaaccttccgtagttaacgtttaccggtcggtcctttaccggaccccggtctaccggtttcccgggttaaccctaaacgttnttcgacgttcggacgtacggtccgggttaccgtacgggtaccttacttccaaccgttcctaccgaactctacgacgccgtacgtcctacgaccgtagtacgtagaagtgcgtacggtacttaagtttactacgtcgtacgtactaacgtaacttaatttaccgtttactttcgtttacgtaccgttaccggttcgggaaccgggtacgtaacgtagggtacgtacgtaaccgtaacgaacggtacgtgtcggtacaccggtctaacccgtagttcctaacgttctaccgttacccg

SEQ ID NO: 66228 - DNA, 748 bp, Homo sapiens
  misc_feature: GYAE6OF02II9EO.31.78.H01.1.454.CMB.1.raw
tcagcagtagacgtcacgaccggtgctcgatttagtgtgagtagtttgggtttgggggagctacaacaggcaggcagggcagcaagatggtgttgcagacccaggtcttcatttctctgttgctctggattctcgtggtgcccgtacggggacatcgtgatgacgcctagtttccagacctcccgtggctggtcttcgtcgtgggcgaggacggcccaccataccaacgtcgacaacgtccgagaccgagtaggtttcgtttttacgttccggacccccaactaaataaacctaacttacttaacgtacgttacggtaaccagaacgaaacggtaaaggtaacggacctacgtaccctaacccgtaaccttccgttagtactttacggtcgggtaccttaccggtacccggacttaccgggtcccggtttaacctaaccgttattaccgagttcggacgacggttacgggtccgtacgggaccttacgttaccacgttcacctaaccactacacgaccacgtcccgtacgcgagtactaggtaagacgttagtacgtagttaactttacttacgtacgtacgtacgtaactaacttagttaacttacgttttctttaccgttaccgttacgggtttaccgggaccgggtaaccggtaaaccgtagggtacgtaacgtacgtaaccgtaacgtacggttggtacgtcgtaccgacctacgtattcgttacgtttccctacgttacccgg

SEQ ID NO: 66229 - DNA, 793 bp, Homo sapiens
  misc_feature: GYAE6OF02J0UAH.31.78.H01.1.454.CMB.1.raw
tcagcagtagacgtcacgaccggtgctcgatttagtgtgagtagtttgggtttgggggagctacaacaggcaggcagggcagcaagatggtagttgcagacccaggtcttcatttctctgttgctctggactctctggtgccgtacggggacatcgtgatgacgcctagtttccagacctccctggctgtcgtctcgtggcgagacggccaccagtacaacgtgacgaacgtccgaagtccgaaggtacggtttcggtttttacgtttaccgggacccctaaacgtaaactaaaccgtaaacttacgttaacgtccgtttacggtaacctacgtacgtaaacggtaaaaggtaccggtaacgtacggtacccttaacctaaaccgttccgtacgttaacgtttacgtcgggttccttaccgggtaccccgggtcgtacggtttaccccggggttaccttaaaccggtcgttactaacggtttcggaccgtacggtccgggttacgttcgggtaaccgttacgttaccgacttaccgactacgtacgtacgacgtccgtacgtcctacgtacgtacgtcgtaagaacgtcgttacgttcggtacttaagtttaccgttacgttacgtcgtaagtacgtacttaactttacgttacgtttacgtttacctacgttaccgtttacgggccggttaaacggtacgtaagggtcgtaagtacgttaacggtaacggtcgttaacggtcgtacgtccgtaaccgttaccgagtttccgtaggttaccttacgttacccg

SEQ ID NO: 66230 - DNA, 771 bp, Homo sapiens
  misc_feature: GYAE6OF02G0PFQ.31.78.H01.1.454.CMB.1.raw
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcccgtacggggacagtcgtgatgagcctagtttccagacctcccgtggtctgtgtctcgtgggacgaggacgggccaacactcaactgacctaacgtccagccgagtagtttcgttttagttcggacccccaactaactaaactaacgttacttagtccttcggtaaccagacaaggtaaaggtacgacctacgaccctaccgttaaacctccgtagttaacttttaccgacgggtcccttaccggtaccccgggtataaccggttccccggggtttaaccccttaaccgtntttaccgtaacgttcggacccgtacgggtccgggtaccgtacggggtacccttacttttcccgtaaccgtccctttacccaaccttacgtaccaacgtaccgtacgtccctacggacgtacgggtcctaaggaacgtagttggtacgtattagtttacgttacgtgtacgtacgtaactaacgtttattacctttaccgtttaccgtttcgtacttaccgggttaccgggaacgggtacggtaagttaacgggtgggtacgtaacgtaacgaaacccggtagtacggtcggttaccctaggtcccgtaagtccttcgttaccgttcttaccgttacccg

SEQ ID NO: 66231 - DNA, 850 bp, Homo sapiens
  misc_feature: GYAE6OF02F59GV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagttccagactccctggctgtgtctctgggcgagacggccacatcaactgcagtccagccagtagttagttttacgttccggaccccactaaataacctaacgttaccttaggacctttacggtaaccgaggaccaaggtaaaaggtacggtaaccgaacgtcccgttaaccccttaaaaccgttccgttacgtaacgtttttaccggtcggggttaccttttcccggttaaccccggggtctaaccggtttacccggggtttaccccgttaaaccggtaacgttttccaaggttttccggaccgtaacggggtcccggggttccgttacgggggtaaaccccgttagtttttcccgaaccgtttacccgtacccggtaacccttacgtcccgttaaggcccgttaaccgaccccggtttcggaacccggttcgggacccgttaaggtaaccgtaaggttcgggtcggtacgttaagtttaaccgtttacgtacgtttccgacgtaacctaacgttaactttaacgttacctttttacgtttaccggttacctttaccggtttaccggggtacggtaaccgggtaccgtaacggggttacggagttaaccgtacgaaacggttcggttacggtccggtacacgtaccgtaaccgtacgttccgttactttccgttacttaccccgg

SEQ ID NO: 66232 - DNA, 677 bp, Homo sapiens
  misc_feature: GYAE6OF02IIJPG.31.78.H01.1.454.CMB.1.raw
  modified_base (468)..(468): a, c, t, g, unknown or other
  misc_feature (468)..(468): n is a, c, g, or t
  modified_base (479)..(479): a, c, t, g, unknown or other
  misc_feature (479)..(479): n is a, c, g, or t
tcagcagtagacgtcacgaccggtgctcgatttagtgtgagtagtttgggtttggggggagctacaacaggcaggcaggggcagcaagatgggtgttgcagacccaggtcttcatttctctgttgctctggattctctgggtgcctacggggacattcgtgatggagcctagtttccagacctccctggctgtgtctcgtgggcgagagggccaccatcaactgacaagtccacgccaggtagttgttttacttcggcccccaacaataacaactacttagcttcggaccagcaaggaaagtaggacacgtacctacctaaactccgtgtaactttacgtgggtccttaccggtacccgggctaacgttcccggggttaccctaaccgtatttcagttcggcagggtccgggtcgtacgggaccttagtttctaccgtctaccaccataccagccacgccgtcgacgnggtctagaagntggtcggtattacgttttatacgtgtacacgactaactaattacgttacctttcgttttccgtacgttaccggtttccgggacggggtaacgggtaaccgtaaggggttacggtagtaacgtaaccgtaaacggtaacggttgggtaccgggttctaggtcccaacgttcgttacctacgtttcccgttactacccgg

SEQ ID NO: 66233 - DNA, 830 bp, Homo sapiens
  misc_feature: GYAE6OF02J0MDI.31.78.H01.1.454.CMB.1.raw
  modified_base (190)..(190): a, c, t, g, unknown or other
  misc_feature (190)..(190): n is a, c, g, or t
  modified_base (250)..(250): a, c, t, g, unknown or other
  misc_feature (250)..(250): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatccgtgatgagcctagtttccagtacctcccgtggctgtntctccgtggcgagacggccaccgatccagtgcaacgtccacgcctagtaagttcgttttnttaccggacccctaaccgtaaataacctaacgttacttacggtacttaggtacccaagtccgtaaagaaacggttaggacctacgtacccgtaaccctaaaccgtccttagtacgtttacggacggtacctttaccggtaacccggtctacggtttacccgggttacccgtaaaccgttcgtaacctcgttaacggcgtaaccgttcggggttacctacggggtaaccttaacgttacctcgttacgtaccgtaaccgtatttaccggacgtaccgtacggtaacctacgttagtaaccggtaacgggttcctaaagggtaacttaaccgggttgtacgggtaaccgtttaacgtttaacgttcccgttaggtactaaacccggaagttaacctttaaagtttacccgtttaccgtttcctttaaaccggttccggtttaacgtaccgggtcggttaaaccggttaaccgggtaaggtagggttaaccgtaacccggtaacgttaaccggttaaccggttacggttaaccgttacgaccggttacgaacctttcggtaccgttcgtttaaccttaaccgg

SEQ ID NO: 66234 - DNA, 612 bp, Homo sapiens
  misc_feature: GYAE6OF02GQCAL.31.78.H01.1.454.CMB.1.raw
  modified_base (325)..(325): a, c, t, g, unknown or other
  misc_feature (325)..(325): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggccaccatcaactgcaagtccagccagtagttgttttattcggacccctaaccaataaccaaaccttacttagacttacggtaccagcaagaaagtaggacagtccctactaactccgtanactttacgtgggccttccgtacccgggctacgtcccggggttaccctaaccgtacttcacttggcaggtcgggtcgtacgggacccgtatttccactcctaccacctatccagcacgcctgcnggctgaagngtgtcggatagtttatacgtgtacgagtacaatattacttacctttcgtttactcttaccgtttacggacgggtacggtaaccgtagggtacgagtactacgtaaacggtacgtggtacggcgtcgtacacgtactccgttacgtcttctacccg

SEQ ID NO: 66235 - DNA, 968 bp, Homo sapiens
  misc_feature: GYAE6OF02ILBXF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggactctctggtgccgtacggggacatcgtgatgagcctagtttccagtacctcccgtggccttgtcgtctcggtcgggcgaggacgggcccaaccgtatacctaaacgtcgaaccgtaacggttcccaggtacccgtaggtaaggttttcgttttttaacggttaccgggacccccctaacgtaaaactaaacctaaaccgtttacgtttaacggtccgttttacggggtaaacccacggaaccgtaaaggtaaaaaggttacgggtacctaaccgttaccccttaacccgtaaaacccgtttcccggttagttaacgttttaccggtcgggttaccctttcccgggaaccccgggtcttaccggggttttaccccggggttttaaccaaaaccccggttgtttccgtaaggtttccggacggtaaccggggtcggggggtttaacccttacggggggaaccctttacttttaccggacccttacttaacccgtaacccgtagtaccgacggtaccgtaccgtacgtaccgcgtaacgggtccgtaagggtaaactcgggttacggttccgggtaacgttttaacggttttaacgtttacgtacggtacctaacggtaacctaacgtttaaggttttaacctttaccgtttaaccgtttccgtttacccgttaaccggttttcccgggggaaacggggttacggtaaaccggtaagggtttaccggggaacttaaccggtaaccggtaaaaccgggtaccgttttagggtaccgggtaacttaccggtaccctaacggtttacctttaccggtttaccgtttcggtaaccccgttaccgg

SEQ ID NO: 66236 - DNA, 657 bp, Homo sapiens
  misc_feature: GYAE6OF02JZZUI.31.78.H01.1.454.CMB.1.raw
  modified_base (283)..(283): a, c, t, g, unknown or other
  misc_feature (283)..(283): n is a, c, g, or t
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgcctacggggacatcgtgatgagccagtttccagactcctggctgtgtctctgggcgagagggccacatcaactgcaagtccagccagacgtgtttattgccccacaatacaacttatagcttggtaccagcaagaagttacgacngacctaccaactcctagtacttacgtcgggccttacgacccggtntaacgttccggggttacctaacgactttcaagttcggtacgaaggtcggtcgtacgggacctaatttcgaacttcaccgaccgtattccgaagtcaggcccttgcaacggtcgtaagagtacgtaggtcggtacttacgtttagtacgttaacgtcctaaaggtacctaaaccgttagtaacgtttaccctttcgttttaccggtaccgttaccgttttaccgggacggtaaccgggtaacgtacgggttacggacgtacgtaaaccgtaacggtaacgttgggtacgtcgtacggtacctacgtacgttctacgttaccttcgtaccc

SEQ ID NO: 66237 - DNA, 886 bp, Homo sapiens
  misc_feature: GYAE6OF02JKWQ2.31.78.H01.1.454.CMB.1.raw
  modified_base (313)..(313): a, c, t, g, unknown or other
  misc_feature (313)..(313): n is a, c, g, or t
  modified_base (578)..(578): a, c, t, g, unknown or other
  misc_feature (578)..(578): n is a, c, g, or t
  modified_base (699)..(699): a, c, t, g, unknown or other
  misc_feature (699)..(699): n is a, c, g, or t
tcagcagtagacgtcacgaccggtgctcgatttagtgtgagtagtttgggtttggggagctacaacaggcaggcaggggcagcaagatggtgttgcagacccaggtccttcatttctctgttgctctggatctctggtcgccgtacggggactagtccgtgaatgagtcctaggtttccagacctcccgtggctgtgtctcgtggcgaggacggccacacgtcacgtcgaccgaacgtccagccaggtacgttgttttacgttccggacccctaacgtaaataaccacttacgttcggtccttcggtaacccnggacaaacggtaaacggtacggactaccggtacccttacgttaaacccgtccgttaagtaacgttttaccggcgggttaccctttacccggtaacccggggtaccgttaaccggttacccgggggtttaacccctaaacggttacgtttacccgttaaacggttcggtaccgtaccggggggttaccgggtttaccggttaaccgggggtaacccgttaacggttttcccgaaacccctttccgttaaacccgaaaccccggttntaacccggtacggtcccgaaccgggtccgttaccgggtaccggtaacgggtaccgttaaacggtaagtacgggttcggtacgggtaacttttaacggtttaacctttaccggtccgttaanaaccgttaaccgtaaccggtttacttaacgttttaccgtttcccgtttaaacggttccgttaccggttacgggaaccgggtaaccgtacggtaacgggttactacggtaacaccggttaaacggtcgttacgtccgggactaccggtcgtaacccgtcgttaccgtccggttacctacccgttaccg

SEQ ID NO: 66238 - DNA, 772 bp, Homo sapiens
  misc_feature: GYAE6OF02FSKUI.31.78.H01.1.454.CMB.1.raw
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagaggccaccatcaactgacaacgtccagccaggagttgttttagttcggccccaacaataaaccaactactagtcttaggaccagacaagtaaacgtaggacagtccctacctaaactcctagtactttacgngggtcctttaccgacccggggacttaccggttcccggggtttaccctaacccggtatttaccgtaagtttcgggacctaggggtccggggttaccgttacgggggaacccgttaattttccgaaccgtttcctacccgtaaccctacgttaccgaaacgtccgtaacggtccctcggaaccgtacgggtcgtaaaggaagttaacggtcgggtaccgggtactttaaggttttaaccttacgttacggtacctaagttaccctaaattactttaacgttacctttttaccgtttacccggtactttacccggttttacggggaacgggtaccggtaaaccggtaaggggttacgagtaaccgtaaaccgtaaacggtaacgttcgggtacgcgtttaacggcctaaccgttagttccggaccgttttacctcgtaacccg

SEQ ID NO: 66239 - DNA, 872 bp, Homo sapiens
  misc_feature: GYAE6OF02HTETE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggacacgtcggtgacgtggacgccgttacgtttccgacgtacctcccgtgggtcttcggtcgttccgtcgtcgggacggaggacgggccaaccgtactaaccgaacgtcgacgtaacgtccgaacggtacctaggtacgttttacggtttttaccgtaccggaccccctaaacgtaaacgttaaaccgtaaaccgttacgttaacgtacggtttaccggtaaaccgacggtaaccgtaaaaggaaaacggttaccgggaaacctaccggttaaccctttaaaccccgttaaaaccgttcccgttaaggtttaaccgtttaaccgggttaccggttaccgttaccggtaaccccgggtacgttaaccggtttccccggggttaaacctaaccgttactttaccgtaacggttcggtaccgtacggggtccggttaccggtacggtaaccctacgtttccgaactccttaaccgaacttcgtaacgaccgtacgacgtacccggtacgaacgtcgtaacgagttaaagtcgtggttaacgtaacgttacgtttaacgttacggtaagtaaccaagtaccttaaacggttatttaaccgttaactttccggtttactccggttaaccgttccgggaaacggacggtaaccggtaaggacgtacgtagtaaccgtacggtaacgcggtaccgaagttccacgttacgtctacgtctacctacgtaccc

SEQ ID NO: 66240 - DNA, 1023 bp, Homo sapiens
  misc_feature: GYAE6OF02HVT0N.31.78.H01.1.454.CMB.1.raw
tcagcagtagacgtcacgaccggtgctcgatttagtgtgagtagttgggtttgggggagctacaacaggcaggcaggggcagcaagatggtgttgcacgacccaggtcttcatttcgtctgttgctctggatctctggtgccgtacggggacatcttagatgagcctagtttccagacctccctggtctgtgtctcgtgggacgtagacgggacccgaaccagtacctaaacgtcgaccgtaaacggttcccgaacggtcccgtaaggtacgtttaggttttttaacgtttccgggaacccccctaaccgtaaaacgttaaaacctaaaccgtttaaccgtttaacggtaccgttttacgggttaaaccctaacggaaccgtaaacggtaaaaacgggttacgggaaccgtaaacccggttaccccttaaacccgttaaaaaccgttccccgttagggttaaacgtttttaaccggttccggggttcccgtttaaccccgggttaacccccggggtacgttaacccggggttttacccccggggttttaaaccccgttaaaaccccggttagtttacccgttaacggggtttaccggggacccggttaacggggtacccgggggttaaccggtaccgggggtaaaccccggtttaacgtttttacccggaacccgttttacccgttaaccccgtaaacccggtaacgttaccgggtaacgtaaccggtacgttccccggtacgaacccgggtacggtaccgttaaggtaaacggttaacggttcgggtacgggttacttttaaacggttttaaccgttacgttaacggttaaccgtaacgtaccgaaacctttagtttaaacctttccgtttacccgtttacgtaccgttacgggtttccgggaaccggtaacgggtaccgttaagggtccgtaagtacctaaccggtaaacgttcggttacggtaccggttactaccggtactaaccggtccgtttccgttacggttacctccgttaacccg

SEQ ID NO: 66241 - DNA, 834 bp, Homo sapiens
  misc_feature: GYAE6OF02FKZ4L.31.78.H01.1.454.CMB.1.raw
  modified_base (681)..(681): a, c, t, g, unknown or other
  misc_feature (681)..(681): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgccgtacggggacattcgtgatgagccagtttccagtcctccctggctgtgtctcgtgggcgaggacgggcccaaccgactccgtaaacgtcgaccgaaacgttccacgaccgaaggtacggttttcgtttttaacgtttccggtaccccccctaacgtaaaactaaactaaaccctttaaccgttaggttcgtttaaccggtaacccgaggtaaccgaaaaggtaaaacgggtaacgggaaccgtacgtaccccgttaaccctaaaacccgttccccgtagtttaacgtttaaccggtacgggtacccgtttcccggtaaccccgggtaccggtacggtttaccccggggtttaccctaaccggttaccttacgtacgttccggacgtacggtacgggttccgtacggggtaccgtacgttttaccaccgttccctacgaacctacgtaccgtagaccgaccgtccgtcgaccggacggtacgtacggtaaacgtacgttacggtcgggtaccgttagttttaccttaacggttaccgngtaacttaccgtaaacgttacttttaacgttacctttaacgttttaccgttacttccgggtttacgcgggtaacgtccggtaagcggtacgaacgtaacgaaacgtgtagtgtaccgtagaccgtacttacctgtaccttcgtaccgttaccc

SEQ ID NO: 66242 - DNA, 647 bp, Homo sapiens
  misc_feature: GYAE6OF02GP9QP.31.78.H01.1.454.CMB.1.raw
  modified_base (417)..(417): a, c, t, g, unknown or other
  misc_feature (417)..(417): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcctggctgtgtctcgtgggcgagaggccacatcaactgacaacgtccagccagtagttgttttattcggaccccaacaataacaactacttagcttaggtaccagacaagaaagtaggacagaccctacctaaactcctagtactttacgtcggtccttaccgtacccggctacggtccgggttaccctaacgtacttcagttcggctaggcggtacgacgggtaccgtactttcacttcnctaccacgtcagacacgtaccgtcgacgtaggacgtagaaacgtgttagtacggacttaagtttaacgttcgtcgtactaacgtactaaactatttaacttaccttttcgtttacgtccgttacggtttacggacgggtacggtaacgaagggttcggaagtaagtaaccgtaaacggtagttacggtcgtaactacgacctacgtacgttcctagttccgttactaccg

SEQ ID NO: 66243 - DNA, 848 bp, Homo sapiens
  misc_feature: GYAE6OF02I0XX9.31.78.H01.1.454.CMB.1.raw
  modified_base (670)..(670): a, c, t, g, unknown or other
  misc_feature (670)..(670): n is a, c, g, or t
  modified_base (679)..(679): a, c, t, g, unknown or other
  misc_feature (679)..(679): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtgaccgtacggggacagttcgtgatggacgccgttacggttttccaggtacccttcccgtgggtccttggtcgttcgttccggtagggccgacggaaccgggtcccaaccgtataccgtaacgtcggacaacggttaccccagacccgaggttaacgttttgtttttaccggttcccggacccccaaactaaacgttaaccctaaacgttaccttaacggtcgttacggaaccctagaccgaaagtaaaccggtagacctacgtacccgtaacttaaacgtcctaggttacttcggtcggtaccttaccggtacccgggtacttacggtacccgggttaccttaacggtcttaccgtaagtcggaccgtacggggtccggttcggttaaccgggtacttacggtttaccaccgttaccgtaccgtaaccgtactcgaacggtcctaaccgtccgtaaggccgtggtaccttaaggacgttaacggtcgtaccggttaattacggttttacacgtttagaccgtaccggttnaaacgtttnttaccgttttaacttcccgtttacgtttacggtaccggttttaccggggaacgaccgggttaaacttaggggaccgacggtttaacttaacccgggaaaccgttcgtaggttacccggtacccgtgaacccgttaccgtacgttacctcggtttacccgtacctcccgg

SEQ ID NO: 66244 - DNA, 732 bp, Homo sapiens
  misc_feature: GYAE6OF02GWXN2.31.78.H01.1.454.CMB.1.raw
  modified_base (356)..(356): a, c, t, g, unknown or other
  misc_feature (356)..(356): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagtacctccctggctgtgtctcgtgggcgaggacgggccaccatccaactgacaagtccagccagtagttgttttattcggaccccaacaaataacaacttacttagcttacggtaccagacaagaaagtacggacacgtcctaacctaactcctagtactttacgtcggtaccttccgacccggntacggttccgggttacctaaccgtattcgtagttcggcgtacggtcgggttacgtacgggtaccttacgttttaccacgttcctacccaaacctacgtaccgaacgtaccgaccgtcccgtacggtaccgtacgggtaccgtaagtaaacggtacgttacgggtaccggtatttaacggtttaacgtttaccgttacgtaccgtaagtaacctaacgttaactttaacgtttacctttccgttttacgtaccgttaccgtttcgggaacgggtacggtaacgtaacgggtacggtacgttaacgtaacggtaaaccggtagttacggtacggtacgtacgtaccgtactacgttaccttcgttaccttactacccg

SEQ ID NO: 66245 - DNA, 788 bp, Homo sapiens
  misc_feature: GYAE6OF02F4HRC.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctcggatctcgtggtcgcctacgggacagtcgtgatcgagcctagtttccagtacctcccgtggctgttgtcttcgtgggccgaggacgggccaaccagtacaactgacctaacgtccgacgccgagtacgtttagttttcgttaccggccccaacctaaacgttaacctaaacgttaccgtaggtaccgttacggtaccaggtacgaaaggtaaaggtaacggacacgtcccttaaccgtaacctccgttagtacttcggtcggtccttaccgtcccggactaccgttccgggttaccctaacggtacttcgtagttcggcgtacggtacgggttcgtcgggtaacccgttacgttccaaccgtccgtacccaaccgttacgtccgacgacctaccggtcgttacggaacgcggtacggtacgtaacgttagggttcgggtcgttaaccggttaatttttacgtaccgttacggtagaaaccgtttactaatttaaccgtttacgttacccgttttactttaaccgtaccgtttaacggtttccggggacggtaaacggtacgtaaccgggttagaccgttaacgaacgtaaacgggttccagggttcccggattaccggaccttaaccgtcgtttaccgttaccgtcgtttaccccttacgg

SEQ ID NO: 66246 - DNA, 763 bp, Homo sapiens
  misc_feature: GYAE6OF02HTUBK.31.78.H01.1.454.CMB.1.raw
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtcgccgtacggggacatcgtgatgacgctagtttccagtacctcctggctgtgtctcgtgggcgaggacggccaccatacaacgtgacaacgtccagaccaagtagttgttttacgtcggaccccctaaagaaataaaccaaaccttacgttacgtaccgtttacggaaccaggtacgaaaggtaaaacggtaggaactacgtacccttacctaaaacttccgttagtaactttacggcggtccttaccggtacccggtctacggttcccgggtttaacccaaacggtattccgtaagttcggacgtagggtccgggttacgtacggggtaacccttacgtttacgccgtaacctaccgtaacctagtaccgtaacgtaccgtacgtaacccgtcgaaccgtacggtaccgtaggaaaacgtcggtacggttacggtaccttaagttttaacgttagtccggttaacacgtaactaaaacgttgttaaccctttacgtttccgtaacgttactaccgggtttacgggaccggtaaaggaaccgtaagggtacgacgttaaccgtaacggaaacgttactggtccggtactaccgacctacgtaccgttacgtcgttacctcgtaacc

SEQ ID NO: 66247 - DNA, 820 bp, Homo sapiens
  misc_feature: GYAE6OF02G25U6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggcggccaccatcaacgtgacaacgtccacgccaggtagtttgtttttacgttcggaccccctaactaaataacctaacttacgttagccgttacggtaaccagacctaaaggtaaaggtacggaactacgtaccctacctaaaacctcctagtaactttaccggcgggtacctttaccggtaccccgggattacccggttacccggggtttacctaaacccggtatttaccgaagtttcggaccgtacgggtccggggttaccgtacgggggtaaccctttacttttacccgaaccgtttcccgtaaccctaacccgtaacttccgtaaccggtaccgtacccggtcccgttagggaccccggtaacgggtacgttaacgggtaaagtacggttcgggttacggtacgtttaaggttttacgtacccgttaggtaccgtaaagtaccctaaactttaacgtttactttacccttttaccgtttaccgttaccgttaccggtttacgggaccggggtaaaccggtaacggtaacggggtaggtaacgtacgtaaccgtaaaccggacttcgggacgtacctacgtacctaaccgtcgttaccgtacttacctaccttaccg

SEQ ID NO: 66248 - DNA, 771 bp, Homo sapiens
  misc_feature: GYAE6OF02GWFZ8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggctgtgtctcgtgggcgagaggccacatcaatgcaagtccagccagtagttgttttaattcggaccccaactaataacaactacttagcttacggtaccagacaagaaagtagacagcctacctaactcctagtactttacgtggtacttccgaccgggctaccggttcccggggttacctaaccggtattcagttacggctacggtcgggtacgtacgggtaccgtacgtttccacttcctacgacctaacgtccgaacgaccgacgtacccgtacgaccgacggtacgtaggtaaacgtagttcgggtacggtacctttaacggttttaacgttaccgttcggtaacctaacgtaacgtaaacctttaagtttaaccgtttaccgtttttaccgtttttacccgttaaccggtttacccggtttaaccggggtaaccgggggtaaccgggttaacccggtaaggggtacggggtaaccgttaacggttaaccgtaaaccgggttaaccggtgggttaccggaccggtttaccgaaccgttaaccggtaccgtttaccgttacggtttacccttaaccgttaccccg

SEQ ID NO: 66249 - DNA, 695 bp, Homo sapiens
  misc_feature: GYAE6OF02IKGRE.31.78.H01.1.454.CMB.1.raw
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtcgtctcgtgggcgaggacgggcccaacactcaacgtgacaacgtccagccaaggtagttcgtttttacgttcggacccccaacctaaactaaactaaccttaactttaacggtccgttacggtaacccagaccgaaaggtaaaggtacggaaccacgtaccctaccctaaaccttccgttagtaactttacgttcgggtaccttccgtacccggggctacggtttcccgggttaccttaaccgtntttacgagtttcggaccgtggtccgggtcgtacgggtaaccgtacttttcgaccttctaccactacgtcacgctacgccgtgcgacgtcgtagagtagtcgtgacttagttactttacgtctacacgtactaacttagttaacttacgtttttcgtttaccgtacgttaccgttcgggaacgggtaaccggtaccgtaaggtacgtagtaacgtacgaaacgtacgtggtacgtctcgtacacgtctacgtcgttactactcg

SEQ ID NO: 66250 - DNA, 813 bp, Homo sapiens
  misc_feature: GYAE6OF02FXZAZ.31.78.H01.1.454.CMB.1.raw
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacattcgtgatgagcctagtttccagtacctccctggactgtgttccgtcgtggggcgaacggacgggcccaaccgatactaacgtacgacaaacggttccccaagccaagtacggtttagtttttaacgttcccggaacccccaactaaactaaacctaaccgttaaccttaaggcctttaacgggtaacccagtaccgaaagtaaaaggtacgaaccaaggtacccctaacccttaaaccnccgttaagtaacgtttaaccncgggtacctttaccggtaccccgggataccgggtttccccgggttactaaaccggtattaccaaggttcggacgtaagggccggttacgtcggggtaacctacgttttccacgttaccactaccgaactccgaagccaacgtctacggtacgacggtacgtaacggtagtacgtacggtacgtacgttacggtttaacttacttcgtacgtaccaacttaaactaacgttacttaaccttttaccgtttacgttaccgttaccggtttaccgggtaaccggtaacggtaaccggtaagggtaccgggtaactaacgtaacgtaaaccggtacgtacgggtaccgtacgtaccggtaccgtaaccgttaccgttacgtaccggtttacctacgttaacccg

SEQ ID NO: 66251 - DNA, 818 bp, Homo sapiens
  misc_feature: GYAE6OF02FZ4YK.31.78.H01.1.454.CMB.1.raw
tcagcagtagacgtcacgaccggtgctcgatttagtgtgagtagtttggtttgggggagctacaacaggcaggcagggcagcaagatggtgttgcagacccaggtcttcatttctctgttgctctcggatactcgtggtgccgtacgggacatcgtgatgagcctagtttccagacctccctggcgtgtgtctcgtgggcgagacggccaccagtcaactgacaacgtccagaccagtacgttagttttacgttccggacccccaacgtaaataaccaaacgttacttacgtccgtttacggtaacccagtacctaaaggtaaacgttacggaaccacggacccttaacccgtaaaccgttcccgttagttaacctttaccggtacgggtacccgtttaccggtaccccgggtagttaccggtttccccggggtttaaccctaaccggttacttaaccgtaacgttacggacgtacggtaccgggttaccggtacgggtacccgttaacgttttccaaccgttcccgtacctaaacccgtcgttaccgacgtacccgtacgtccgtacggtacccgaagggtacgtaaggaaacggttacggtacggttacggtaccgtttaacgttttaacgttaccgttacgttaccgagtaacctaactttacgttactttacccgtttcgttaccgttaacgttaccggttaacggacgggaacgttaccggtaaggtacgtacgtaactaacggtaaaccgtacgtacggtagtaccctacggtacctaaccgtagtttccgtacgtttcctaccgttacccg

SEQ ID NO: 66252 - DNA, 755 bp, Homo sapiens
  misc_feature: GYAE6OF02I9TAU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcccgtacggggacatcgtgatggacgcctagtttccagacctccctggctgtcgtctcgtgggacgaggacggccacctatacaacgtcgactaacgtccgacgccgagtacgtttgttttacgttcccggaccccctaactaaactaaacctaacgttacgttacgtccgtttacggtaacctaggactaaaggtaaaacggtacggaaccaccggttaccccttaacccgtaaaaccttccgtaagtaacttttacggtcggttaccctttaccgggtaacccggtcgtacccggttttaccccggggttaactaaccgactttacgaacggttcggacacggggttcgggtaccgttacgggtaccgttactttccgaccgttacctaccgtactacgtccaacgtctccgtccgtacgaccgtagtcgtaagtagtacgtggtcgtacttagtttacgtcttacgcgtaacgtactaacgttatttacttacgtttcgtttacgtaccgtcgttacggacggtacggaaccgtagggtagtacgacgttaacggaacgtatcgggtacgtaccgtagaccgttactaccgttcgtacttacgtaccttccgg

SEQ ID NO: 66253 - DNA, 804 bp, Homo sapiens
  misc_feature: GYAE6OF02IYBD2.31.78.H01.1.454.CMB.1.raw
  modified_base (796)..(796): a, c, t, g, unknown or other
  misc_feature (796)..(796): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagtacctccctggctgtgtctcgtgggcgagacgggccaccataccaactggacaacgtccagccagagttgttttattcggccccctaacaataacgtaactacttagcttacggtaccagccaagtaaacgtaggaacacgtacctaccgtaaactccgttagtaactttaaccgtcgggtcctttacccgtaccccgggtacgtacggttaccccgggggtttacccttaaacccggtatttaccggtaaacgtttcgggaccgtaacggggttccccggggttacggttaccgggggtacccgttaacgttttttacccgaaccgtttacccgttacccgtaaaccctaacgttacccgtaaacggtcccgtaacggtaccccgtaggtacccgaagggtcccgttaaggaaaccgtaggttcgggttacggtactttaacgggttttaaacttcgttccgtacgtacgtaccgtaaacttacgttttaacttaaccttttccgtttacgttaccttacgtttccggggacggttacggaaacgttacgggtcggtagtacgtaaccgtaaacggtccttgggtaaccgtcgtacgacgtaccgtacttacgtcttaccgtnttaacccg

SEQ ID NO: 66254 - DNA, 705 bp, Homo sapiens
  misc_feature: GYAE6OF02G3ZH7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagacgggccacatcaactgcaagtccagccagtacgttgttttacgttcggcccccaactaaataaccaactacttagcttaggtaccagacaagaaagtacggacacgcctacctaaactcctagtactttacgtgggtcttccgacccggctacggttcccgggttacctaaccgtattcgagttcggacgaggtcgggtaccgtgggtacccgtactttcaaccttcgtacctaacctatccgaacgccgtacgtccctaggccgtacggtcgtaagaacggtagttgggtacggtactttagttttacgttacgtcgtacgaacgtaccgtaaacttaactttaacttaccttttcgtttaccgttaccgttaccgttttacggggacgggtaaacgggtaaccgtaaggggtacgacgttaacgtaaccggtaaacggtaacgttcggtcggtaaccgtcggacctaaccgtagttccgttacgttaccttaccgtacccg

SEQ ID NO: 66255 - DNA, 803 bp, Homo sapiens
  misc_feature: GYAE6OF02FT2GF.31.78.H01.1.454.CMB.1.raw
  modified_base (443)..(443): a, c, t, g, unknown or other
  misc_feature (443)..(443): n is a, c, g, or t
tcagcagtagacgtcacgaccggtgctcgatttagtgtgagtagtttgggttggggagctacgaacaggcaggcaggggcagcaagatggtgttgcagacccaggtcttcatttctctgttgctctggatctcgtggtgccgtacgggacatcgtgagtgagtccctagtttccagtaccgtcccgtggctgtcgtcgcgtgggcgaggcggcctacagtccaactgacacgtccagcctagtgtttagttttacgttcggacccctaacgaaataaccgtaaccttaacgtttagtccgttacggtaacccgacgtaacgaacggtaaacgtacggaacctaccgacctttaccgtaaacctccgttaagtaacttttaccggtcggtacccgttaccggacccggtactaccggttttccccgggtaaccttaacccggtnttaccgtaaggttccgtacgtacgggtaccgggttccgtaccggggtaccttacgttttcccgacgttaccctaccgtaacccacggttccgaacgccgaccgttaccgcggtaccgtcggtacgtagtaaaccgtgttaccggtacggtacgtttacggttttattaaccgtcggttaacccgtcaacggtttaacctagttttaacccttggttttaaccctttcgttacccggtttacggttcgtaacccgggtagtaaaccgtagggtaacgtactaacggtaacgtaaccggtaagggtcgttaacggccttaaggcccgttaacgtcgttccggtcttaccggttcgttacccg

SEQ ID NO: 66256 - DNA, 773 bp, Homo sapiens
  misc_feature: GYAE6OF02GX3V8.31.78.H01.1.454.CMB.1.raw
  modified_base (748)..(748): a, c, t, g, unknown or other
  misc_feature (748)..(748): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagacctccgtggctgtgtctcgtgggcgaggcgggccaccatcaactgacaacgtccagaccagtagtttgttttacgttccggccccaactaacgttaacctaaccttacttaacggtccgttacggtaaccaacgtaccgaaggtaaaggtacggaaccacgtaccccttacctaaaccgtcccgttagttaccgttttaacggtcgggtacctttaccggaaccccgggtctaccggttaccccggggtttaccctaaacggtactttccgtaggttcggacgaacgggtccgggtacgtacggggtacccttagtttaccacttccgtaccaccgtagtaccgacgtcgacgtccgtacgcgtacggtacgtaaggaacgtaggttccggtagtaaccgttaggttttacgttacgtggttaccgacgtaacctaacttacgtttaactttacctttcgtttaccgtaccgtttaccggttaccgggacgggtaaacggacggttaggggtacgtaagtacccgtaacggtaaaccgtacgttgggtaccggcgttacgacctaaccgttntcccggtttacgttcctacgttccc

SEQ ID NO: 66257 - DNA, 789 bp, Homo sapiens
  misc_feature: GYAE6OF02FHM52.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatacaacgtgacaacgtccagccagtagttgttttagttccggaccccaactaactaaaccaactacttagcttacggacctagcaagaagtaggacacgccctaccgtaactcctagtactttacgtcggtccttccgtaccccgggactaccggttcccgggggtttaccctaaccggtacttaccgtacgttcggacgacggtcggggtaccgtacggggtaaccgtacgtttaccaaccttcctaccgaacctagttccaacggtaccaacggtcccgtacggaccgtacgggtcgttaaacggtaacgtacgttcgggtacggtacgtttacggttttaataccggttagtacccaacgtacctaaaccgttattttaaccgtttaactttttcccgtttaccgttacccgtttaccggtttaccgggtacccggggtaaacgggttaacccgtaaggggttacgggtacgtaacgttaaccggtaaaaccggttaccgttacggggttcccgtacggttaccgtaaccgttacccgtacgttccggttaccgtttacctacccgtttaacccg

SEQ ID NO: 66258 - DNA, 823 bp, Homo sapiens
  misc_feature: GYAE6OF02G71B7.31.78.H01.1.454.CMB.1.raw
  modified_base (758)..(758): a, c, t, g, unknown or other
  misc_feature (758)..(758): n is a, c, g, or t
  modified_base (763)..(763): a, c, t, g, unknown or other
  misc_feature (763)..(763): n is a, c, g, or t
  modified_base (775)..(775): a, c, t, g, unknown or other
  misc_feature (775)..(775): n is a, c, g, or t
tcagcagtagacgtcacgaccggtgctcgatttagtgtgagtagtttgggtttgggggagctacaacaggcaggcagggcagcaagatggtgttgcagacccaggtctctattctctgttgcttcgtggatctcgtggtcgccgtacggggactacgttcggtagtagtgaacggcccttacgtttacccgacgtacccgttcccgttggtcgttcggttcgtcgtcggtcgggacggaaggacgggacccaaccgtactacgaaccgttcggaaccgtaaccgttacccacggtaccaaggttacggttttacgtttttaacgttcccggacccctaaaacctaaacgtaaacctaaactaaccgtttaggtaccggttacggtaacccaggtaaccgtaaggtaaacggttacgaaaccgtacccggtaccccttaaacccgtaaacccgttccgttacgttaacgttcgggttaaccgggtcccttttacccgggaaccggggtccttaaccgggttaccccgggtttactaaacccggttacttaccgtaggttacggaccttacgggtccggtaccgtacggggtaacctcttaacgccttctaccgacacgtaccgacgcctacgaccgtggacgtccgtgaacggtaagagtttagggtactacggttagtttacctacgttgtaccatacctaagttaccttacgtttcctcgtacttacgtacgggtactacgggacgtagtacggtanacgtnaaccggtaacgngtacgtcgaactcgtaacctacgttacctgtaccttccgtactaaccg

SEQ ID NO: 66259 - DNA, 770 bp, Homo sapiens
  misc_feature: GYAE6OF02GCJFI.31.78.H01.1.454.CMB.1.raw
  modified_base (308)..(308): a, c, t, g, unknown or other
  misc_feature (308)..(308): n is a, c, g, or t
tcagcagtagacgtcacgaccggtgctcgatttagtgtgagtagtttgggtttgggggagctacaacaggcaggcaggggcagcaagatggcgttgcagaccaggtcttcatttctctgttgctctggatctctggtgccgtacgggactatcgtgactgacgcctagtttccagtactcccgtggcgtgtcgtctcgtggacgaggtacggccacgatacaacgtgacacgtccacgccgagtagtttcgttttacgttccggaccccaactaaactaaccaacttaacttgtacgttcggtaaccncgtacgaagtaaagtacggacacgtacccttaacctaaccgtcttcggtacttttaccggacggtccgtttaccggtaacccgggtccgtaacgggttttaccccggggttaacctaaccgttatacggttacgtccggtacgtaacggtcggggttaccggtaccggggttacctactttacgaaccttcgacctaaccgtacgtacacggtaccgtacgtacccgtagaccggtacggtaccgttaggaaacgtacggttcggtaccgggtacgtttaagtttacgtttacgtacgttcgaacgtaactaacgttacttacgttactttccgtttacgtcgtttaaccggtcgggtacggaacggtaggtaaccggtgtacggttaacgtaaccgtaaacggtacgttcggtcggtacgtacgtaccgtacttaacggtcttacggttctacgttacccg

SEQ ID NO: 66260 - DNA, 813 bp, Homo sapiens
  misc_feature: GYAE6OF02HZD2E.31.78.H01.1.454.CMB.1.raw
  modified_base (460)..(460): a, c, t, g, unknown or other
  misc_feature (460)..(460): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagttcgtgatggacgtcctacgtttccagtaccctccgtggtcttggtcgtctcgtgggacgaggacggacccacgtatacaacgtcgaccgaacgtccgacgaccgtaagttagtttaggtttttaccgttccgaacccccgtaactaaaacgttaaacctaaccttacgttacgtcgttacggtaaccagtaccgaaaggtaaacggtacgacctacgtacccgtaaccttaactccgtaagttaagttccggtacgtttaccgtaccgtacccggcgttacggttacccgggttacctaaccgtntaccgtagtcggacgtcggtcgggtacgtcgggtaaccttcgtttaacaccgtctacccgtaactgtaaccgtcgtaaccgcgtcgtaggaccgtacggacgttaagacgtacgtagtcgttaaccttaagtttacgtacgtagttaccaacgttactaaaacttacgttaacctttacgttaccgtttaccgttaccggtaaccggttcggggtaaaccgggttacggttaacaacgggggtacgtaagttaccgtaaaccggtaacggttaagttaccgggtaccggttacgtaacccgactttaaccccgggtagtttacccggtttacttaccgttacccgttacccgg

SEQ ID NO: 66261 - DNA, 849 bp, Homo sapiens
  misc_feature: GYAE6OF02IJTG1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctcttgttgctctggatctctggtgcctacggggacatcggtgatgagcctaggtttccagacctcccgtggctgtcgtctcgtggggacggtaggacgggcccaaccgatcgtaaactgacaacgtccgacgtccgaaggtacgttgtttttacgttcggacccccctaacaaactaaacctaacttacttacgtcgttacgtaacctagacgaaagtaaaggtacggacacgtaccctaccgtaaactcctagtatttacgcggtccttccggacccggtatacggttcccgggtaccttaaccgtagttacctaggttacggccgtacgggtccggggttacgtaccggggtaaccttaacgtttccgtaaccttcccgtacgtaccctaacggttcccgtacgggccggtaccgtcggtacggaccggttacgaacgggtaaggtccggttggtaccggtagtttaacggtttaaccttacggttacgttacgtaacggactaaaacgtttaacggtttaccttttaccggtttaacccgttttccgtaccgttttaaccggttccggggtaccgggtaaccggggtaaacccggtaacggggttaacggtaccgttaaaccgttaaacgggtaaacccggttacggttccgggttaacggtacccggtaggtaaccctaccgtttacgtacggttaacccttccggtttaccgtaccgtttacccccgg

SEQ ID NO: 66262 - DNA, 744 bp, Homo sapiens
  misc_feature: GYAE6OF02JDITF.31.78.H01.1.454.CMB.1.raw
  modified_base (189)..(189): a, c, t, g, unknown or other
  misc_feature (189)..(189): n is a, c, g, or t
  modified_base (489)..(489): a, c, t, g, unknown or other
  misc_feature (489)..(489): n is a, c, g, or t
tcagcagtagacgtcacgaccggtgctcgatttagtgtgagtagtttgggtttgggggagcctacaacaggcaggcaggggcagcaaggatggtgttgcagacccaggtcttcatttctctgttgctctggatctctggtgcctacggggacatcgtgatgagccagtttccagactcccgtggctgtntctcgtgggcgagacggccacatcaactgacaagtccagaccagtagttgttttacttcggaccccctaacgaactaacaaccttacttaaggtcgtttacggtaaccaagtacaaggtaaacggtacggaacctacgacccttaccctaaaacctccgttagtactttacggtacggtcctttaccgacccgggctaacggttcccggggttacctaacgtattaccgacgttcggcgtaacggtcccgggttacgtacggggtacctacgtttccgaaccgtttcctaccgaaccctntaccgaacgtcctaaggtcccgttcgaccgtaacgggtccttaggtaaacgtacgttagggttaccggtacgttaacgttttaacgttacgttacgacgtacgtaccgtaaactttcgtttaacttaccgtttcgtttaccgtaccgttaccggtttacgggaccgggtaacggtaccgtaagggttacgagtacgtaacggtaaccgtacgtggtacgcgtacggactaccgtattccgtgttacctgtacccg

SEQ ID NO: 66263 - DNA, 742 bp, Homo sapiens
  misc_feature: GYAE6OF02FUNMX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgagacggccacatacacgtgacaacgtccagccagtagttgttttagttcggaccccactaataactaacctacttacgcttacggaccagacagaaagtacgacacgcctactaacctctagtacgtttacgtggtccttaccggtacccggactacggttacccgggttacctaaccgtacttactagttcggacgtacggtccgggttctcggggtacctactttacgaccttccacctaactacgttccgagacctacgaccgtcggaccgacggtacgtaggtaacggacgttcggtacggttacgttaacggttttacgttaccgttggtacccaacgtaacctaacgttaacgttttaaccttaacccgttttccgtttaaaaccgtttccgttaaccgggtttaccgggtacgggtaaccgggttaaccgtaagggtacggtaacgtaccgtaaccggtaaacggtacgttacgggtacgtccggttacctaccgtcccgttaacgttaccgtttacttcccgttacgtaaccg

SEQ ID NO: 66264 - DNA, 678 bp, Homo sapiens
  misc_feature: GYAE6OF02H0AQI.31.78.H01.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
  modified_base (464)..(464): a, c, t, g, unknown or other
  misc_feature (464)..(464): n is a, c, g, or t
  modified_base (666)..(666): a, c, t, g, unknown or other
  misc_feature (666)..(666): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccctacggggacatcgtgatgagcctagtttccagtactccctggctgtgtctcgtgggcgagngggccacatcaactgacacgtccagccagagttnttttagttcggaccccacaataacaactacttagtcttggtaccaggacaagaaagtggaacncgccctactaaacctccgtagtactttacgtggtccttccgtacccgggctacggttcccgggtacctaaccgtnttcaggttgcgtaggtcggtcgtcgggacctactttcactcctacaccgatccagtactacgccgtgacgacggtcgtagaacgtacgngggttcgtacgttagtttacttacgtcgtactacgactaaacgttacttaactttaccgtttccgtttaccgttccgttaaccggtttccgggaaccggggtaaccggtaaccgtaaaggggtcgtaaggaacgttaaccgaaaaccggtacgttacggcggttaaccgtcgaccgtaccgaacgtttccgtaccggttttntaccgttaaccg

SEQ ID NO: 66265 - DNA, 771 bp, Homo sapiens
  misc_feature: GYAE6OF02HZFCA.31.78.H01.1.454.CMB.1.raw
tcagcagtagacgtcacgaccggtgctcgatttagtgtgagtagtttgggtttgggggagctacaacaggcaggcaggggcagcaaggatggtgttgcagacccaggtcttcatttctctgttgctctggatctctaggtgccgtaacggggacatcgtgatgagcctagttccagacctcctggctgtgtctcgtggcgaggacgggccaccataccaacgtgaaccgaagtccagaccaggtagtttgtttttacgttccggacccctaacaaataaaccgtaaccttacttaacggtactttacggtaaccaaggtaccgaaaggtaaacggtacggaacctacgaccccttaacctaaaacttccgtagtaactttacgtcgggtaccttaccggtaccccgggctaccggttcccgggttacctaaaccgtcttacgtacgttacggacgtacggtcgggtacgtacgggtaccttatttccacttcctacctacctacgtaccacggacctacgtcctaggaccggacggtaacgtaggtaaagtacggtcgggtacgtacgttaacggtttaacttacgtacgttactaaacgtacctaaacgtttactttaaccttacctttaccgtttacgttaaccgttacggttaccgggaacgggtacggaaccgttaagggaacggtaacgtacgtaaacgaaacggttaacgttggtcgtaacgtcggtaacccacgttacgttacgttacgttacttaccgtaccg

SEQ ID NO: 66266 - DNA, 704 bp, Homo sapiens
  misc_feature: GYAE6OF02JWAUP.31.78.H01.1.454.CMB.1.raw
  modified_base (211)..(211): a, c, t, g, unknown or other
  misc_feature (211)..(211): n is a, c, g, or t
  modified_base (508)..(508): a, c, t, g, unknown or other
  misc_feature (508)..(508): n is a, c, g, or t
  modified_base (669)..(669): a, c, t, g, unknown or other
  misc_feature (669)..(669): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctcgtgtgccgtacggggacatcgtgatgacgcctagtttccagctcccgtgctgtgtctcgtggcgagacgggcctacngtcactgcaagtccagaccgagtagttgttttacttccggacccaaccaattaaacaaccttaacgttcgtaccttggtaccagcgaaagtaaacggtacgactacgtacccttaccgtaactacctagtactttacgtcggtcttccgtaccggcgtacggttaccgggtcctaacggtcttatgtacgcgtaggcgggtactcggacgtcttacgttctactccaactctcgaacgtctacgtctcggacgtaacgtcgtaacgaaggtatgggcgttacgtagttttaaccgtntaggtccgtaacgtactaacttagttacttttaccgtttccgtttcctaccgttacgggtttaccggggaaggtaccgggtaacgttacgggtacggtaaagtcgttaaaacccggaaactttaaccggttggtaaccggtgttaacccgacggttaaccncggttttcggttaacgtccgtttcccgttaacccg

SEQ ID NO: 66267 - DNA, 1006 bp, Homo sapiens
  misc_feature: GYAE6OF02GD944.31.78.H01.1.454.CMB.1.raw
  modified_base (203)..(203): a, c, t, g, unknown or other
  misc_feature (203)..(203): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggngggccacatcaacgtcgacaacgtccagccgaagtacgttagtttttacgtttccggacccccaaccgtaaataaacctaaaccttaacgtttaagtccgtttacggtaacctacgtaaccgaaaggtaaaagggtaacgggtaaccaacggtacccttaacccgttaaaaccttccgttacgttaacgttttaccggttcggggttaccttttaccggtaaccccggggtcgtaaccgggtttccccgggggtttaacccctaaccggttaactttccgttaagtttaccgggtccggtaaccggggtccgggggtttaacccggttacggggggtaaccccggtttaattttaccctaacccgttcccgttaccaacccgttacgtaccgaccggtaccgaccggtaccgtccggtaacccgagggttacccgtaagggtaaacggaccgtttcgggtacgggttaccgttaacggttttttacgtaaccgtttacggttaccctaaaccggtacctaaaccgttttaaactttttaaccgtttaacccgttttttaccgttttttacccggtttaaccggtttttaacccgggttttacccgggggtaaccggggttaaccggggttaaaccgggttaaaaggggtttacggggaacgttaaaccggtttaacccgtaaaaaaccggtttaaccgggttacgggggttcccggttaaaccggtccggttaacccccgttaaaccgtttaaccggtttacccgtttaacccggttttacccgttaacccgttttaaccccg

SEQ ID NO: 66268 - DNA, 810 bp, Homo sapiens
  misc_feature: GYAE6OF02FVS6M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggcgggcccaccgataccaactgacaagtccagccaggagttgttttacgttcgacccctactaataacactacttagcttaggtacagcaagtaaagtaggacagccctacctaaactccgtagtactttacgtcgggtaccttaccgtaccccgggctaccggttacccggggttaccctaaccgtacttaccgtaggttccgggacgtacgggtccggggttccgtacgggggtaacccttaacgttttccgaaccgttacccgttaccaaccccgtagtccgaacgtaccgaggtaccccgtgaccgggtacgggtctacggtaaacggtacgttcgggttacgtacccgttaaggtttttaaccgttacgtacgtaccgtaacgtaaccgtaaacgttaacgttttaacgtttacccgttttccggttttaccgtttaccggttaacccggttttaccggggaaccgggttaaccgggtaaccgggtaaggggttacgggaccgtaacgttaacccgggtaaaccggtaacgttcgggtaaccggtccgttacggtaaccctaccggttaccgttccgtacggttttacccgtcgtttaaccccg

SEQ ID NO: 66269 - DNA, 967 bp, Homo sapiens
  misc_feature: GYAE6OF02FJBX2.31.78.H01.1.454.CMB.1.raw
  modified_base (139)..(139): a, c, t, g, unknown or other
  misc_feature (139)..(139): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatcgtctggngccgtacgggctatcgtgaatgacgtcctagtttccagtacctcccgtggtctggttgtactccgtggggaccgagtacgggccctaaccacgtacgaaccttggacctaaccggtacctaagcccgtaaggtacgttttaggtttttaaccgttaccgggaacccccctaaacctaaaagttaaaacccctaaaccgttacgtttacggtaaccgttttacgggaaccccaaggtaacccgaaagggtaaaaacggttacggaacccgtacggtacccctttaaacccgtaaaacccgttccgtaaaaggtttaccttttaacccggtcggggtacccgtttaccccgggtaaaccccggggtccgttaaccgggttttacccccggggggttaacccttaaaacccggttacgttttaaccgaacggttttccgggaccggttaacggggttcccggggtttaccgttaaccgggggtaaccgttactttttacccggaccgttaccttaaccgacccgttaatccggtaacggtccgtaaccgtccgtaggaacccgtaggtaccgtaaaggaaacgttcggtacgggttacgtaacgtttacgtttaagtacccgttaggtacgtaacgtaccgtaacttacgtttaacgtaccgtttaccgtttacgtaccgttaccggtttacccggggaaggtaaacccggttaagaccggggttaacggtaacgtaccggtaaccgtaaacggtaaccggttcggtaaccggttaccgttacgacccgttaagttaccgttacggttaccgttacctttacccggtaccc

SEQ ID NO: 66270 - DNA, 641 bp, Homo sapiens
  misc_feature: GYAE6OF02JYTYG.31.78.H01.1.454.CMB.1.raw
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
  modified_base (616)..(616): a, c, t, g, unknown or other
  misc_feature (616)..(616): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttaccagtacctcccgtggctgtcgtctcggtggcgaggacgggccaccactcaactnacaactccagcaagngttgttttactcggccccaacaataacactacttacgcgttagaccanacgaagtaagagacacgtacctacctaactcgtntacttcgtggtccttccggaccggactacggttccggttacctacgtcttacgtatcggacgacggtcggtccgtggacccgtatttaccgcttaccaccgtacactacgacgtccacgtccctggacctacggcaggtaacgtaggtcgagtacggttatttactacttcgtacgtaatacctaacgttatttacttacctttccgttacgtacgttacgttacgggacggtaacggacgtacgtacgagtactaaccgtaggtaccgtggtaccgtcgaacgactaccgtnttaccgtcggttaccttcgtacccg

SEQ ID NO: 66271 - DNA, 950 bp, Homo sapiens
  misc_feature: GYAE6OF02JPD4C.31.78.H01.1.454.CMB.1.raw
tcagcagtagacgtcacgaccggtgctcgatttagtgtgagtagtttgggtttgggggtaggctacaacaggcaggcaggggcagcaagatggtgttgcagacccaggtcttcatttctctgttgctctggatctctggtcgcctacggggacatcgtagagtgcgtcctagttccgtagactcccgtggctgtgtctcgtgggcgagagggcccaccgctacacgtagctaacgtccaaggcctaaggtagtttcgttttaacgtttcggacccccctaactaaactaaaccgtaaccttaacgttacgtaccgttacgggtaccccaagacgaacggtaaaaggttaccgggaaactaccggtaccctaacccgttaaaacccgttcccgtttaaggttaaccgtttttaaccggttacgggtacccggtttaacccggttaacccccgggggtaaccgtacccgggttttaaccccggggggggtttaccccccttaaaaccggtaacctttttacccggaacgtttaccgggtacgtaccgggggtaccggggtttaccccggtacggggtttaaacccgtttaccgttttacggaaccccctttcccttaaacggtaacccctacgttacccgaacggttacccggtaaccgggtcccgtaccgggccgggtaacgggtacccggttaaggaacggttaacggttaacggttccgggaacgttttaacggttttaacctttaacgttacgggttaccctaaaacgggtaacccttacgttaaacgttttaccttaaacccgtttcgtttacccgttacgttaaccggttttacggggaaccggtaaacgggtacccggtaaggttaccgggtagaacccgttacgaaacccgtaaggttcgaccgtgtacctacccgtaagccttacgtaccttacgtatacccg

SEQ ID NO: 66272 - DNA, 773 bp, Homo sapiens
  misc_feature: GYAE6OF02GZU7C.31.78.H01.1.454.CMB.1.raw
  modified_base (426)..(426): a, c, t, g, unknown or other
  misc_feature (426)..(426): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcccgtacggggacatcggtagatggacgcctagtttccagtacctcccgtggctaggtgtctcgtgggacgaggacggccacctatacgaactgacaacggtccagccagtagtttcgttttacgttccggacccctaacaaataaaccgtaacttaacgttacgacgtttacggaccagtaccgaaggtaaagtacggaccaacgtcccttaacctaacctcctagtacgtttacgtcggtacctttaccggaccgggtctaacggttcccgggtacctaacgtnttcgagttcggcagggtcggttccgtagggtacccttatttaccacgttacctaccgaacccggtattaccgaacggccctacggtcccgtcggaccgtacggtacgtaaggtaacgtacggttggtaccggtaacgtttaggtttaacttacgttacggacctaacgtactaaacttaacgtttacttaccgttttcgttaccgttaccgttacggtttcgggaaccgggtaaccggtaacgtaggggtaccgtagtaccgtaaacgtaacgggttaccttacggggtaaccgtaccgtaggacccttaaccgtacgttaccggtttcttccgttacctaccccgg

SEQ ID NO: 66273 - DNA, 775 bp, Homo sapiens
  misc_feature: GYAE6OF02HQ8FT.31.78.H01.1.454.CMB.1.raw
  modified_base (303)..(303): a, c, t, g, unknown or other
  misc_feature (303)..(303): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgcctacggggacatcggtgatgagccagtttaccagacctccctggcttgtgtctcgtgggcgaggacgggccaccatacaacgtcgacgaacgtccagccaaggtagttgtttttagttcggccccaacaactaaaccaacttacttagcgttacggtaaccngacaagtaaaggtacggacacgcccttaacctaaacgttccgtgttactttacggtcggtacctttaccgacccggggtactacgggttacccggggttacctaaacccgtcgtttaccgtaaggttcggccgaacgggtccgggttacggtacggggtaaccccgtttatttacccgacgttacccttaccgtaaccccgtacgtaccgaaccgaccgtaccgtcccggttaacgacgggaaccgtaccgggtaagtaaacgggtaacgtcgggtacgggttaaccgtttaagttttaacgttaaccgtcgtaacgtcgtaaaccttaacgttattactttaccgtttcgttccgttaccgttacgtccggggtaaccggaggtaacggttagcggaactacgtaacgaacgttcgtacgggtacgtaccgtcgacctacgtaacgttcgtaacggttcctacccttaccg

SEQ ID NO: 66274 - DNA, 759 bp, Homo sapiens
  misc_feature: GYAE6OF02GA9FN.31.78.H01.1.454.CMB.1.raw
  modified_base (542)..(542): a, c, t, g, unknown or other
  misc_feature (542)..(542): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcctggctgtctctcgtgggcgaggtacgggcccacataccaactcgactaacgtccacgccagtacgtttgttttacgttccgggaccccaactaacgtaaaaccaacttaacgttagtaccgtttacgggtaacccagaccgtaaaggtaaaggtacgggaacacgtacccttaaccgtaaaccttcctaggttacttttaaccggtgggtaccttaccggtaccccggggtctaaccgggttccccggggtttaccctaaccgtactttactacggttcggaccgtagggtccgggttacggtcgggggtaaccctttagtttccgacctttaccgtaccacccgtacgttaccacggtaccncggtacccgtcggtacgacggtacgtacgtaacggtaagttcggaggtacttaacgtttattaccgtggtacctaggactaacgttacttattaccgtttacgtttcgtacttaccggttcgggtaccggaacggttacgtagtacggagtacgtaacgtaacgtacgtacggtgtactcgaacctacgtccgttagtacgttactacttaccccgg

SEQ ID NO: 66275 - DNA, 760 bp, Homo sapiens
  misc_feature: GYAE6OF02I6EPQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagccagtttccagtacctcccgtggctgtgtctcgtgggcgaggacggacccaccatacaacgtgacaacgtccaacgcctaaggtacgttgtttttacgttaccggaccccctaacgtaaataaaccgtaaccttaacgttagaccgtttacggtaacccagacaaggtaaaagtacggaactacgtacccttaaccgtaaacctccttaggtaactttaccggtcgggttacctttacccggtaacccgggacctacggtttaccccggggttaacctaaaccggtactttccgaagtttcggcgtaacggtccgggtactacggggtacccttattccgactccgtaccactacgtacgagtacgtacgccgtcgtacgacggtacgtagaacgtgtggtacgtacgttagtttacgtacgtcgtacgaacgtactaacttacttacttaccgtttctttacgtccgttaccggtttaccgggacgggtaacggtacccgtaagggtacgtacgtaacggttaaccgtaaacggtcgttagggttcgtaccgtacgtaccgtaccgtacgtttcccggtacgttccgttacttacccg

SEQ ID NO: 66276 - DNA, 851 bp, Homo sapiens
  misc_feature: GYAE6OF02FIDW7.31.78.H01.1.454.CMB.1.raw
  modified_base (327)..(327): a, c, t, g, unknown or other
  misc_feature (327)..(327): n is a, c, g, or t
  modified_base (386)..(386): a, c, t, g, unknown or other
  misc_feature (386)..(386): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccacatcaacgtgcaacgtccagccagtacgttgtttttagttcggaccccaaccaaataaacctaacttaacttaagtctttacggtaacccaggtaccgaaggaaaacggtacggacaacncccgttaacctaaaaccttccagttactttacgtcgggtcctttaccgtaccccgggtntacggttcccggggttaccctaaaccggtacttacgtaacgttggaccgtagggtccggggttacgtacgggggtaacccttagtttaccgaccttactacccgtaacccaagttacccgacgtaccgtaaccggtccttacggaccgtaacgggtacgtaacggtaaacggtaacggtgggtacgggtactttaacggttttaaactttaaccgttcggttacctaacggtaacctaaaccgttaacttttaaacgttaccgtttttacccgttttaccgtttacccgttaacccggttttaccgggggaacccggttaaaccggggaacccggttaaagggttacgggtaacgttaaccgaaacccggttaaaacggtaaccggttaccggtacgggtaacccgtaggtaaccccgtaaccgttaaccgtttaacccgtacgttacccgttaccgttacccgg

SEQ ID NO: 66277 - DNA, 762 bp, Homo sapiens
  misc_feature: GYAE6OF02FNFSS.31.78.H01.1.454.CMB.1.raw
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcaggggcagcaagatggtgttgcagacccaggtctccatttctctgttgctctggatctcgtggtcgccgtacggggacatcgtgatgagcctagtttccagacctcccgtggctgtcgtctcgtggcgaggacggccacatcaactcgactaacgccagccgaagtagtttgttttaacgttccggacccctaactaaataaaccgtaaacttaccttagccgttaggtaccagaccaaggtaaagtacgganacgtacccttactaaacctcctagtactttacgtgggtcttaccggtaccgggctaccggttccggggttaccctaacggtacttctagttcggactacggtccggggttcgtaccgggtaccgtagttttcccgactttcccgtaacacctaattaccgacggtacctaacggtccgtacgacggtacggtacgtacggaaagtcggtcgttacggacgtttaaggtttacttaaccggttcgtaaccggtaacgtacctaaacgtttagttaaccgtttacctttcggtttaccttaccggttaacgtttcggggaacgggacggttaaccggaagggtacggtacggtacctaaccggttaaacgtacggttcggtaccggtccgtagacccgttacgtcgttaccgtttcgtttaccgttaccttacccg

SEQ ID NO: 66278 - DNA, 765 bp, Homo sapiens
  misc_feature: GYAE6OF02HICWY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatgacgcctagtttccagacctcccgtggcttgtcgtctcgtgggcgaggacggccacctatccaacgtgactaacgtccacgccgtaagtagtttcgttttagtccggacccctaacaataaccaacttacttagtccgttacggaaccagtacgaaaggttaaacgacggacacgtacccttaccctaaacgtccgtagtacctttacggtcggtaccttcccggtacccgggtctaccgggtttcccgggttacctaaccgtacttcgtaggttccggaccgtagggtccgggttacgcgggtacctacgtttccacgttccgtacaccgtacgtaccgacgtaccgtaccgtaccgttgaccgggtacggtaacggttaacggtaaacgtggttacggggtacggttacccgttaagttttaaccgtttaacggttctaacgtaacgtacgtaaaccttaacttttaccgtttaccttttaccgtccgttaccgttacggtttaccgggacgggttaacggtacgtagggtacgacgtaacgtaaccgaaacggtcgtagggtactccgacgtactacgtcgttcttcgttcctacttcccg

SEQ ID NO: 66279 - DNA, 769 bp, Homo sapiens
  misc_feature: GYAE6OF02JIO1C.31.78.H01.1.454.CMB.1.raw
  modified_base (200)..(200): a, c, t, g, unknown or other
  misc_feature (200)..(200): n is a, c, g, or t
  modified_base (380)..(380): a, c, t, g, unknown or other
  misc_feature (380)..(380): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgagtgagtccgagttttccagtacctccctggtctgtgtctcgngggtcgagacggccacatcaactgacagtccagaccagattgtttatcggaccctacagtaacattactcgtactacggtacagcgaaggaagtacgacagtaccctaccgtaactccttagtactttacgtacggtccttaccgaccgggtataccggttcccgggttaccttaaccgngtttacaggttcgacgtaggtcccggtattacggggaccttagttacctaccttccggtaccctaccgtagttaccgacgaccgtacgaccttacgggcctaagggtacccttagggaaacgtacgttcgggttcgtaaccggtttagttttaaacgtccgtttacggttaccgtacgtaacccttaaacgttacttttaaccggtttccctttaccgttttcgttaccgtttaccgggtttaccgggtaccgggtaacgggtaaccgtgggggttaacgtacgttaaccggaacccggtttaaaccgaccggttacggtacgggtaccttacggtaacccgttaccgtaaccgttttccggtaacccgttccggtactttaacccggg

SEQ ID NO: 66280 - DNA, 731 bp, Homo sapiens
  misc_feature: GYAE6OF02FU9K4.31.78.H01.1.454.CMB.1.raw
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagaggccaccatcaactgcagtccagccagtagttgttttattccggccccaacaataaccaacttacttagcttaggaccagctaagaagtaggacagccctacctaacttcctagtactttacgngggtcctttccgacccgggctacgttccccggggttacctaaccggtnttctagttcggactacggtccgggtcgtacggggaccctacgttttaccaccgttcctacccgaaccctgttacccgaagtccgaccgtccctgaccggacggtccgtagaaacgtacgttacggttacggtacgtttaagttttaactacgttacgtaccgtaacgtacgtaaaccttagttttaaccgttactttttccgttttaccgttaccgttaccggttttaccggggaaccggtacgggtaacccgttaaggggtacggtaacgtacgttaaccggtaaacggtacgttccggtacggtaccgtaccgtacctaacccgtacgttcgtttaccgtttccgtacgttacccg

SEQ ID NO: 66281 - DNA, 739 bp, Homo sapiens
  misc_feature: GYAE6OF02FVWIO.31.78.H01.1.454.CMB.1.raw
  modified_base (237)..(237): a, c, t, g, unknown or other
  misc_feature (237)..(237): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccacatacaactgacaagtccagccagtagttntttattcggccccaaccaataacaacttacttacgtcttaggtaccagcaagaaagtaggacacgccttacctaaactcctagtactttaccgtggtccttaccgtacccgggctacggttcccggggttaccttaaccggtattcgacttcggacctcggtcggggtcgtacggggtacccgttaatttccaaccgttctacctaaccctacgtccgaacgtccgtacgacccgtacgccggaaggtcgtaaggaacgtagtacggttacggtacgtttaattttacgttacgttagtaccgaacgtactaacgttaactttaacgttaccttttaccgtttaccgttaccgttaccggtttaccggggaacggggttacggtaacccggtaaggggtacggtaacggtaacgtaaccgtaaaacgggtaaccgttcgggtacggtaccgttaaccggaccctaaccggtacgttccgtacggttacctttacctaacccg

SEQ ID NO: 66282 - DNA, 539 bp, Homo sapiens
  misc_feature: GYAE6OF02FP7EJ.31.78.H01.1.454.CMB.1.raw
  modified_base (389)..(389): a, c, t, g, unknown or other
  misc_feature (389)..(389): n is a, c, g, or t
  modified_base (411)..(411): a, c, t, g, unknown or other
  misc_feature (411)..(411): n is a, c, g, or t
  modified_base (536)..(536): a, c, t, g, unknown or other
  misc_feature (536)..(536): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgttttattggccccacaataacaactacttagcttggaccagcagaaagtaggacagcctcctaaactcctgatttacctgggcttcgtacccgggctagtccggggttcctaaccgattcattggctagcgggtctgggaccatttcactctcaccntacagcagctgcagctagaagntgtggctagttacttactgtacagccaacattactactttcttacgttctacgtttacggcgtacgggacaagggtgagtatacgtaaacgacgtagtcggctagacgtaccattctagtccttntac

SEQ ID NO: 66283 - DNA, 746 bp, Homo sapiens
  misc_feature: GYAE6OF02IUVJD.31.78.H01.1.454.CMB.1.raw
  modified_base (139)..(139): a, c, t, g, unknown or other
  misc_feature (139)..(139): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtnccgtacgggacatcgtgatgacgcctagtttccaagcctcccgtggctgtcgtctcgtgggcgaggcggccacctatccaactcgactaacgtccagccagtagttcgttttacgtcggacccctaacaataaaccgtaacttacgtagtacttacggtaaccagactaaaggaaacgtacgacacgtaccctaacctaaactcctagtaactttacgcggtccttaccggacccggtactaacggtttccccgggttacctaacgtactacgtacgttcggacgacggtcgggttacgacgggtacttacgttctaacctccgtacaccgtacgtcaacggtccacgtccgtaacgcggtacggtacgaacggtaaagtacggtacgggtcgtaacctttaagtttacgtttacgtacggttagaacgttaaccgtaaccttaattacctttaacgttttccgttaccgttacggttaccggtttaccgggacggaaacgggttaccggtaagggttaccggactaacggttaacgtaaaccggtactggtaacgtcgtaccggtacctaacgtccgtttaggtacctttacccgtactttacccg

SEQ ID NO: 66284 - DNA, 770 bp, Homo sapiens
  misc_feature: GYAE6OF02JXWNP.31.78.H01.1.454.CMB.1.raw
  modified_base (237)..(237): a, c, t, g, unknown or other
  misc_feature (237)..(237): n is a, c, g, or t
  modified_base (383)..(383): a, c, t, g, unknown or other
  misc_feature (383)..(383): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgcctacgggacatcgtgatgagccagtttccagacctccctggctgtgtctcgtgggcaggtcggccctaccatcaacgtgcaacggttccagcctaagngttgttttattcggccccaacaaatactaactacgttagcgttacggtaccaggacaaacggtaaagtaggtaactacgtaccccgtaaccctaaactcccgtagttaaccgtttacgtcgggttaccttccggtaaccccgggtntaacccggttccccggggtttaaccctaaccggactttacgtagttacggctacgggtcccggtagtacggggtaccttagtttccacgttctacgaccctaactcgtacgtctacggcctaggtcgagtcctaagggaatcgtcgtacggtctactttacgttacgtcgtaacgcgtaaacctacttaaagtttccgtttaaccgttttcgtttcccgttaaacggttccccgggttttacgggacccgggttaaccggtaaccgaaaaggggtttcccgaagtaaccgttaccgtaaaacccgggttaagttcgggtaaccgttacccgtcgtaaaccgtaccgtaccgtttcggttacccgttaacgttttcccgttaacccgg

SEQ ID NO: 66285 - DNA, 726 bp, Homo sapiens
  misc_feature: GYAE6OF02GEW4F.31.78.H01.1.454.CMB.1.raw
  modified_base (357)..(357): a, c, t, g, unknown or other
  misc_feature (357)..(357): n is a, c, g, or t
  modified_base (695)..(695): a, c, t, g, unknown or other
  misc_feature (695)..(695): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcggtgatgagcctagtttccagtactccctggctgtgtctcgtggcgaggcggccacatcaactgcagtccagccagtagttgtttattccggaccccacaataaaccaacttacttagtcgttaggtaccagacaagaaacgtaggacacggtaccctacctaactcctagtatttaccgtgggtaccttccggtacccgggtntacggtttccccggggttaacctaaccggttagttaccgtacgtttcgggactacgggtccggggttccggtaccggggtaacgttacgttttaccacccgttacctaccgtaaccctagttaccgaacggccctacggcccttacggacgtacgtaccggttaggaaacggtagttggtaccggtactttaaacgtttgttacgtgtaacgtacgtaacctaacgttacttaaacgtttcccgtttcgttttacgtaccttaccggtttagggcccgggtaaacgggtaaccgttaggggactacgtaaccgtaacgtaaacggtcgtaacggtcgntacgacttaccgtgtcttcgtcctcgtaccg

SEQ ID NO: 66286 - DNA, 639 bp, Homo sapiens
  misc_feature: GYAE6OF02GR498.31.78.H01.1.454.CMB.1.raw
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggtctgtgtctactgggcgagacgggccaaccagtcaactgacaacgtccagccagagttcgttttattcggaccccaactaataaacctaaacttaccttaagcgttacgggtaacctagaccaagaaaacggtaggaaccacgtaccctaacccttaaactccgtagtactttacgtggtccttccgtaccgggctacgtccggggttacctacgtacttcattcggctaggcgggtcgcgggtactnttcgactctacaccatcagcacgcctgactggacttcggaaactggtggtacggtacttaggttttaacttacgttactaacgactacgttaaactactttaacttaccgtttcttttaccgtacgttacgtttacggcggtaaaccggtacgtaacggtgagacttaacgaacgtacgtcgtggcctgactacgtactctcgtactgtac

SEQ ID NO: 66287 - DNA, 536 bp, Homo sapiens
  misc_feature: GYAE6OF02JA45R.31.78.H01.1.454.CMB.1.raw
  modified_base (312)..(312): a, c, t, g, unknown or other
  misc_feature (312)..(312): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttaattggccccaacaagtaacaactactagcttggtaccagcagaaagtgacagcctcctaaactcctgatttacngggcttcgtacccgggcatcccgggtctaacgattcattgcagcgggtctgggaccgatttcactctccacntccagcagcctgcngtctgaagatgtggactaggtttattacgtgctagntaacgtattacttacttcttttcgactacttttcgggcgtagggaccaaggtcgagtatacgaaacgtactggtaggctgaccactatcttcgtcttctacc

SEQ ID NO: 66288 - DNA, 774 bp, Homo sapiens
  misc_feature: GYAE6OF02FNFPH.31.78.H01.1.454.CMB.1.raw
  modified_base (235)..(235): a, c, t, g, unknown or other
  misc_feature (235)..(235): n is a, c, g, or t
  modified_base (343)..(343): a, c, t, g, unknown or other
  misc_feature (343)..(343): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagagggccaccatcaactgcaagtccagccagagttnttttattcggaccccacaataacaactactagcttggtacagcagaaagtacgacagtaccctacctaaacctcctacgtaatttacgtaggtcttccgtacccgggntacgtccgggttacctaaccgtattcctagtcggacgacggcggtacgtagggtaccgtattaccactacctacaaccgacttaccgacgtaccgacgtacccgtacggaccgtagggtaacttaggtaaaacgtacggttacggtacgggttaccgtttaaattttttaaacgttaaccgtttcgttaacctaacgggtaacctaaaacttaacgttttaaccttaaccgttttaccgtttaccgtttacccgttaaccgggtttttaccgggaaaccggggtaaccgggttaaacccggtaacgggggttaccggtaacggtaaccggttaaacccgtaaaaccgggttaacggtaacgggttaccggaccggtttacgaaccgttaacccgtacgttacctttacgggttaccctttacgtaacccgg

SEQ ID NO: 66289 - DNA, 678 bp, Homo sapiens
  misc_feature: GYAE6OF02ILLOW.31.78.H01.1.454.CMB.1.raw
  modified_base (441)..(441): a, c, t, g, unknown or other
  misc_feature (441)..(441): n is a, c, g, or t
  modified_base (650)..(650): a, c, t, g, unknown or other
  misc_feature (650)..(650): n is a, c, g, or t
tcagcagtagacgtcacgaccggtgctcgatttagtgtgagtagtttgggtttgggggagctacaacaggcaggcaggggcagcaagatgggtgttgcagacccagggtcttcatttctctgttgctctggatctctaggtcgccgtaacgggggacagtcgtgatcggacgtcctaggtttccaacgtacctcccgtgggccttggtgtcttacggtggggaccgacggacgggtcccaaccgtataccgaacgttcgacctaaggtcccaacggccaaggtaggtttgtttttacgttccgggaccccctaactaaacttaaaccaaccttacgttacgtccgttacggtaaccagtacgaagaaaggtacgacacgtacctaccgtaaactccgtagtacttacgtggtcctcgaccgctacggtccgttacaacgtnttcagtgcgagtcggtacgcgggtacctattccgactccgtacacctaacgtcaggtacctacgcgtacgcgtaggtactaggagtgtagtcgattacgttattacgtagtacactactacttaagttcttaactttcctgtaccgttcggttacggacggtaacgaggtaggtgtagtaacggtactaacggtactcgacgtacgacncgtacgtcctacgtacgttctacttccg

SEQ ID NO: 66290 - DNA, 955 bp, Homo sapiens
  misc_feature: GYAE6OF02JOKIH.31.78.H01.1.454.CMB.1.raw
  modified_base (139)..(139): a, c, t, g, unknown or other
  misc_feature (139)..(139): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctgatctctggtnccgtacggggacagtcgtgagtgagcctaggtttccagactccctggctgtgtctacgtgggcgaggcgggcccaacctagtccaaacgtcgaccgtaaacgtcccagcccgaggtacgttggtttttaacgtccggaccccccaactaaaacgttaaactaaaccgttacctttaaggtacccgttttacggtaacccgtaacggtaccgtaaaggtaaaacggttaacgggtaacctaacggtaccccttaacccgtttaaaaccttacccgttacggttaaaccttttaacccggtgggttaaccccgtttaccggtaccccccgggtactaacccggggttttccccggggtttaaccccgttaaacccggttacgtttacccgtaaggtttaccggtacccggtaacggggttcccggggttaccggttaaccggggggtaaccccgttaaccggttttttacccgaacccgtttacccggttacccgttaaaaccggtcctaaccgggtaccgtaccgtacccggttacccgttcggaccggtaccgggtaccgtaacggtaacgtacggtaccggttacggtaccgtttaaaggtttaccgtttacggttaccgttaccggtaacgtaccgtaaacgttacgtttaactttaccgtttaaccgtttcgttaccgtttacgttaccgggtacggtacggtaacccggttagggacggtacggaacgttaaccgaaacggtaccgttaggttaccggtaccgtcgtaacccgtacgtaccgttcgttaccgtttaccgttacccgttaccg

SEQ ID NO: 66291 - DNA, 756 bp, Homo sapiens
  misc_feature: GYAE6OF02FRNQQ.31.78.H01.1.454.CMB.1.raw
tcagcagtagacgtcacgaccggtgctcgatttagtgtgagtagttttgggtttgggggagctacaacaggcaggcaggggcagcaagatggtgttgcagacccaggtcttcatttcctctgttgctctggatctctggtcgccgtacggggacatcgtgatgacgcctagtttccagacctcccgtggctgtgtctcgtgggcgagacggccaccatacaactgcaacgtccacgccagtagtttcttttagttccgaccccaactaataacctaactacttagtccttaggtaaccaagcgaaacgaaaggtacgaccacgtacccttaacctaacctccgtagtacgttacgtcggtccttacccgtcccggacgtaccgttcccgggttaccctaaccgtacttcgtacgttcggcgtacgggtccgggttcggttaccgggtacccgttactttaccgtacccttacctacccgtaacctcgtaccgaacgtaccgtaacgtcccgtacggaccgtacggtcgttaacggaagttcgttaggtccggtactttaacggttttaacgttaccgtaggtacctacgtaaaccttaacgttactttaaccgtttacgttttcccgttacgttaccggttacgtttaccgggaccgggtaaccggtaaccgggtaaggtacgtaacgtacgttaccggaaacgttacggtcggtacgcgtacgtacacggttactccgtcgttaccttcgtaccc

SEQ ID NO: 66292 - DNA, 808 bp, Homo sapiens
  misc_feature: GYAE6OF02IRDZJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggcctgtgtcgtacgtgggccgaggacgggcccaccgatcaacgtcgacaacggtccaagccaggtagttagttttacttcggaccccctaacgtaaacttaactaaacttaacgttagaccgtttacggtaaccaggtacgtaaacggaaaagtacggacctaacgccctaacctaaacgtcccgttagtactttacgtcggtcttacccggtacccggctaccggttacccggggttacctaaaccggtcttaccgtagttcggccgtaacggtccggggttaccgtacggggtaacccttacgtttctaaccgtccgtaccgaaccctacgttacgaacgtcgaccgtccgtacggaccgtacggtaccgtacgtaaaggtacgtggtacggtacgttaacggttttaacgttacgtaggtacaacgtataaccggttaatttacgttacccgttttcgttaccgtacccgttacggtttaccggggacggttaaggacccgtaaagggttcggtaacgtaacgtaacccggtaaaccgtaacggttacggggtccgtaacccggtagtccccgtaaaccgtacgttaccgttaacccggtttcgtaacccgttaaccccg

SEQ ID NO: 66293 - DNA, 654 bp, Homo sapiens
  misc_feature: GYAE6OF02HAN5K.31.78.H01.1.454.CMB.1.raw
  modified_base (338)..(338): a, c, t, g, unknown or other
  misc_feature (338)..(338): n is a, c, g, or t
  modified_base (378)..(378): a, c, t, g, unknown or other
  misc_feature (378)..(378): n is a, c, g, or t
tcagcagtagacgtcacgaccggtgctcgatttagtgtgagtagtttgggtttgggggagctacaacaggcaggcaggggcatcaagatggtgttgcagacccaggtcttcatttctctgttgctctggatctctggtgcctacggggacatcggtgatgagccagtttccagactccctggctgtgtctcgtgggcgaggacggccaccatcaactgacgaacgtccagccagagttgttttacttccggaccccaactaactaaacaacttacttagtccttaggtaccagacaagaaaggtaggaccagccctaccgtaaactcctagtattcgnggtccttaccgacccggcacgttccgggtacctaacggtnttacgtagttcggacacgggtcggtaccgtagggtaaccgtcttttaccgactcgtacaccctagtcacggtcgacgtcctgcacggtcgtacgaagtcttagggtcgacgttaagttttacgttacgtcgacgtaagtacctaaactatttacttacctttcgtttacgtcgtttaccgttcgggacgggaacggtacgtaagggtacgactagtaaccgtaaacgtaacgtggtcggagtccgaccgtacgtctccgttgttaccttacgtacc

SEQ ID NO: 66294 - DNA, 695 bp, Homo sapiens
  misc_feature: GYAE6OF02JFE8P.31.78.H01.1.454.CMB.1.raw
  modified_base (482)..(482): a, c, t, g, unknown or other
  misc_feature (482)..(482): n is a, c, g, or t
  modified_base (510)..(510): a, c, t, g, unknown or other
  misc_feature (510)..(510): n is a, c, g, or t
  modified_base (530)..(530): a, c, t, g, unknown or other
  misc_feature (530)..(530): n is a, c, g, or t
  modified_base (564)..(564): a, c, t, g, unknown or other
  misc_feature (564)..(564): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtagatgagcctagttccaacgcctccgtggctgtgtctgtcgggacgaggacggccaacatcaatgcaacgtccagtccaggtagttgttttacttccggacccctaacaaactaaactaaccttaacgttacgtacgttaggtaacccaagacgtaacgaaaaggtacggaacgacgtaccgtacctaaaccgtcttaagtacttacgtcggtaccttccgtaccggacgtacgttaccgggtacctaaaccggtattccgtagtaccggacgtacggtacgggtcggtacgggtacctagtttccaacgtccgtacaccgtacncgaacgtcctacgccgtaggcaagggtntaacgaagtcgtacgggtanacgttgttaataaccgttgctacgaacgtaactnttaacttacgttcgttactcgtaaccggttgaaccgggtagaacggtacgagtacgaaccttaacggaaacggttaagcggtaccgtagtaccgaaccgtctaacttccggttattaccgttacgtaaccg

SEQ ID NO: 66295 - DNA, 768 bp, Homo sapiens
  misc_feature: GYAE6OF02FT1C8.31.78.H01.1.454.CMB.1.raw
tcagcagtagacgtcacgaccggtgctcgatttagtgtgagtagtttgggtttgggggagctacaacaggcaggaaggggcagcaagatggtgttgcagacccaggtcttcatttctctgttgctctggatctctggtgcctacggggacatcgtgatgagcctagttccagcctccctggctgtgtctcgtgggcgaggacgggcccaccatccaacgtgacaagtccagccagagttgttttattcggccccaacaactaacaactacttagcttacggtaaccagtacaaggtaaaggtacggacacggtaccctacctaaacctccgtagtactttacgtcgggtccttaccgtacccgggctacggttccccggggttacctaaccgtgttaccgtagttcggaccgtagggtccgggtaccgtacgggggaacccttagtttcccgaccgttcctacccgtaaccctacgtaccgacgacgtaccgtcccgtacggaccgtacgggtacgtaaggtaaacggtagttgggttacggtaccgtttaagttttaacttaccgttacgttacctaacggtacctaacgttactttaactttaccgtttacttttacccgtaccgtttacggtttccgggacgggtaacggtaaccgttaacgggtacgtaggtaaccgtaacgtaaaccggttcgtagggtaccggtacgtaccgtaccgtaaccgttcgttaccggttacctccgttacctccgttacccccgg

SEQ ID NO: 66296 - DNA, 846 bp, Homo sapiens
  misc_feature: GYAE6OF02H88TA.31.78.H01.1.454.CMB.1.raw
  modified_base (200)..(200): a, c, t, g, unknown or other
  misc_feature (200)..(200): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgccgtacggggacatcgtgatgagccagcttcagactccctggctgtgtctcgtgggcgagngggccacactacaactgaccgaagtccaagcccaggtagttgtttttacgttccggacccctaacaaataaccaaacgttaaccttagtccgtttacgggtaacccaggaccgtaaaggaaacgttacgggaacctacgtaccccttaccttaaaacctcccgttaaggtaacgtttttacggtcggggttaaccctttcccgggtaacccgggtactaccggtttccccgggggtttaacctaaacccggttattaccgtacggtttcggcctacggggtaccgggtcgtttacgggacccgttatttcccgacttcctaccgtacccgtacgtcgtacgtaccgacgtcccttacggaccgacggtaccgtaaggaacgtaagttcggtagttaccgtttagtttttaacgttaaccgttacgtacgtaaccggaaccttaaaccgttagtttttaaaccgtttacccttttttaccgtttaccggttaccctttaaccggggttttaccgggaaccggggtaaacgggttaacccggtaaggggttacggtaacgttaaacgtaaccggtaaaaccgtttaccgggtaggttacgggacttccggaccgttaaccgtacgttcgtttacggttaccttacccg

SEQ ID NO: 66297 - DNA, 868 bp, Homo sapiens
  misc_feature: GYAE6OF02F8T42.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggagggcccacatcaactgacaacgtccagccagagttgttttattcggaccccacaataacaactacttagcttggtaccagacaagaagtaggacacgcctacctaaactcctagtactttacgtgggtcttaccgtacccgggtctacgttcccgggggttaccctaaacccgtatttaccgtacgtttcggaccgtacgggtaccggggttcgttacgggggtaacccgttacttttacccgaaccttacccgtttacccgtaaaccctaacttaccgaaccgtaccgaacggtcccgttcgccgtaacggtcgtaacggtaaacgtaggtcgggttaggaacccgtttaggttttaacgtttaccttacgggttaccaacggtactaaaaccttaacgtttttaacttaaccgttttttacccgtttttacccggttaccgtttaacccgggtttttaccggggaaccggggttaaaccggggtaaaaccccggtttaaggggggttaaccggggtaaggtttaaaaccgttaaacccggtaaaaaccggttaaaccggttttacggggttaccgggttaaccgtttaccggaacccggtaaccccgtttaacggttttacccggtttacccgttttacccggttttacccttttaaccccgg

SEQ ID NO: 66298 - DNA, 904 bp, Homo sapiens
  misc_feature: GYAE6OF02J1QYL.31.78.H01.1.454.CMB.1.raw
  modified_base (173)..(173): a, c, t, g, unknown or other
  misc_feature (173)..(173): n is a, c, g, or t
tcagcagtagacgtcacgaccggtgctcgatttagtgtgagtagtttgggtttgggggtaggcttacaacaggcaggcaggggcagcaagatggtgtgcagacccaggtcttcatttctctcgttgctctggatctcgtggtgccgtacggggactagtcggtagagtggacncctacgtttccagtaccgtccgtggcgttgtcgtctcgtcgggcgtagtacgggtcccacctacacgaaccgtcggacctaaccggtacccgaaccgacccgtaggtaggtttacggtttttttaaccggttccgggtaccccctaacctaaattaaaccctaacctttaaccgtttacggtaaccggtttaccggtaaccccagaccgtaaacggtaaaggttacggaacgtacgtaccgtaaccctaaaccgtccgtgtaactttacggtcggtaccttccgtaccgggtactacccggttacccgggtacccgtaacgtacgttactcgttacggacgtacggtacggggttcggtaccgggtaacccgttacttaccgtaccgttcctaccgtaacccttatccgtaaacgtccgtaccggacccgtacgtaccggtacggtaaccggttacgaacgggtaacgttacgggtacggtacgtttaacggttttcgttaaccgttaacgttaccgttacgtaaaccgttaacgttactttaaccgtttaccgttaccgtttttaccgggttccgttaccgggttttacccgggaacgggttaaacccgggtaccggttaaacgggtcgtacggttaaccgtaaccggtaaacgtaacgggttacggttacggtacccgtaacggtacccgttccggtaacctttcggaaccggttccttaccgtacccg

SEQ ID NO: 66299 - DNA, 747 bp, Homo sapiens
  misc_feature: GYAE6OF02JTE9Z.31.78.H01.1.454.CMB.1.raw
  modified_base (151)..(151): a, c, t, g, unknown or other
  misc_feature (151)..(151): n is a, c, g, or t
  modified_base (349)..(349): a, c, t, g, unknown or other
  misc_feature (349)..(349): n is a, c, g, or t
  modified_base (671)..(671): a, c, t, g, unknown or other
  misc_feature (671)..(671): n is a, c, g, or t
tcagcagtagacgtcacgaccggtgctcgatttagtgtgagtagtttgggtttgggggagctacaacaggcaggcaggggcagcaagatggtgttgcagaccaggtcttcattctctgttgctctggatctcgtgggtgccgtacgggacntcgtgactgacgcctagtttcacgctccgtgccttgtcgtcgtcgtgggcgaggacgggccacactacaacgtcgcgtaacgtccaagccaggtagttagttttctacggccccaacgtaactaaccgaacttacgttacgcgttacggtaaccacgacgaagtaacggtacggactacgtacccgtacctaacgtcncgtaatttaccggagggtacctccggtaacccggctacgggttaccccgggtcttaaccggcgttactacggtccggtcggtaacggtccgggttcggacgggttacccgtacttaccgaccgttttcccgaaacctaacccggtgttacccgaacggtcgtacccggccggtcgtacccggtaggtaccggtagaacggttacggtcggtacggtacgtacgtttacgtattcgtacacgtacgtaactacgttactaccgttactttacgtaccgttacgtaccgggtacggtaccggtaacggtacggtacggttacgngtaaccgtaacggtacggttacggtgaccgttacgacgtacctacggttaccgttacgttacggttacttacccgg

SEQ ID NO: 66300 - DNA, 800 bp, Homo sapiens
  misc_feature: GYAE6OF02IMWM2.31.78.H01.1.454.CMB.1.raw
  modified_base (774)..(774): a, c, t, g, unknown or other
  misc_feature (774)..(774): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcccgtacggggacatcgtgagtgagcctagtttccagacctccctggctgtcgtctcgtgggcgaggacggcccaccatccaaactgacaacgtcccagaccaggtgtttggttttacttccggacccccaactaaataaaccaaccttacgttagtcgttacggtaccagtacaagtaaaggtagacacgtccctacctaacctctacgtaagttacgtcggtcttaccggtacccggtctaccggtttccccgggttaaccctaaccgttagttccgtagttccggacgtacggggtccggggttacgtacggggtaacccttacgtttccgaccttccgtacccgaaccgtacgtaccgtacgaccgtaaccgtccgtaccggtaccgtacgggaccgtaaggtaacgtacgggtacggttacggtaccgtttaaaggttttaaccttcggttaacggttaccgttaacgtaacccgaaacgtttaacttttaaccgtttacccttttacccgttttacccggtaccgttaccgggtttaccggggaaccgggtaaggtaaccggtagggtaacgtacgtaacggttaaccgaaacggttacgttggtaccgtacgtccgaaccgtaccgtntttacccgtcgttcctacgttacccg

SEQ ID NO: 66301 - DNA, 904 bp, Homo sapiens
  misc_feature: GYAE6OF02HADYH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggacgaggacggccaccgatcaacgtgacaacgtccacgccaggagtttgtttttaagttccggacccccaaccgtaaataaacctaacttacgtttacgtaccgtttaccgggtaacccaggaccgaaacggtaaaaggtacggaaccaacgtccctaaccttaaaccgtccgttagtaactttacggtcgggtacctttcccggacccgggtacgtaccggtttcccggggttacccttaaacgtactttcgtacgttcggaccgtacgggtcgggttcggacgggtacccgttaatttacccgtaacgttccctaccgaacctaccgttccgaacgtacccgtacgtacccgtcggaccggtacgggtacctaacgggtaaacgttaacgggtaccggggtttacggtaaccggttttaaaggttttaaaccgtttaccggtttacgtaaacccgttaaacgtaaccgttaaacttaaacttttaaccgttttaacccgtttttcggttttaaccgtttacccggtttaccggttttaccgggggtaaccggggttaaacccggggtaaccggttaaaccggggtaggttaacgtaaccggttaaaacccggtaaaaccgttaccgggtttaccggtaggtacccgttcggaacccgttaccggtaacgttttcggtttaacccggttacctttccgttaacccccgg

SEQ ID NO: 66302 - DNA, 875 bp, Homo sapiens
  misc_feature: GYAE6OF02J1TNM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatggacgcctagtttccagcctccctggcttgtgtctcgtgggcgaggacgggcccacgataccaactgcaacgtccagccgaagtgttagttttacgttccggacccccaacctaaataaaccaacttactagtccgttaggaaccagacgtaaggaaagtacggacaccgtacccttaacccgtaaaccgttccctaggttaacgttttaaccggtcgggttacccctttacccggtaaccccggggtcttaacccgggtttacccccgggggtttaacccttaaaccccggtacttaaccttaacggggttccggaacgtccggggtccggggtttacggtccggggtaaaccccggttacttttcccgaaccttacccgtaccctaaccgtacgttaccgacgaccgtaccgttcctaacggacccgttaagggaccctaggtaaacggtcgttacgggtacgggttaacgttaaacggtttttactacccgtaggttacccgtaactaacccgtaaactttaactttaccttaaccgtttccttttaacccgtacgtttaaacccgggtttcgggaaacccggggtttaaacgggtaaccgtaggggttaccgggacgttaaacgtaaccggaaacggtttaacgtcgggtacggaccttaaccggacccgttaacctaacggttcctttaacgtacccgttccttaacccg

SEQ ID NO: 66303 - DNA, 644 bp, Homo sapiens
  misc_feature: GYAE6OF02GTYN7.31.78.H01.1.454.CMB.1.raw
  modified_base (181)..(181): a, c, t, g, unknown or other
  misc_feature (181)..(181): n is a, c, g, or t
  modified_base (504)..(504): a, c, t, g, unknown or other
  misc_feature (504)..(504): n is a, c, g, or t
tcagcagtagacgtcacgaccggtgctcgatttagtgtgagtagtttgggtttgggggagcgtacaacaggcaggcaggggcagcaagatggtgttgcagacccaggtcttcatttctctgttgctctggatctctggtgcctacggggacatcgtgatgagccagtttccagactcccgnggctgtgtctcgtgggcgaggagggccaaccgatccaaactgctaacgtccaagccaagtacttgttttacttcggccctaacaaagtaaccaacgtacttagacttacggtaccagacaaggaaagtacggacagtccctacctaaactccgtgtaactttacgtcgggcttcgaacccggtctacggtccgggttaccaaccgtattcgtagttcggcgtaggcggttcacggggtacctaatttccacttccacctaccgtagtccgacgtccagcccgtagcgtaggctagaagtatgtagtactaagtttactacgtntacgtagtactaagtatttacgtactttcgttacgttaccgtcgtttaccgggaggtacgtaacgtagggttagagtctaacggaacgtacgttggtaccgtataccgactcgtaacgttcctcgttaccttacgtaccg

SEQ ID NO: 66304 - DNA, 845 bp, Homo sapiens
  misc_feature: GYAE6OF02FU358.31.78.H01.1.454.CMB.1.raw
tcagcagtagacgtcacgaccggtgctcgatttagtgtgagtagtttgggtttgggggagctacaacaggcaggcaggggcagcaagatggtgttagcagacccaggtcttcatttctctgttgctctggatctctggtgcctacggggacatcttgatgagccagtttccagacctccctggctgtgtctcgtcgggcgaggacgggcccacgactcaactgacaacgtaccagccagtagttgtttttagttccggcccctaacaaataaacctaacttaacttagcgttaggtaaccagacaagaaaggtaggacagcctacctaaactcctagtatttacgtcggtccttaccgtacccgggctacggttcccggggttaccctaaccggtctttaccgagtttcgggacctacggggttccggggttccgttacgggggaacccgttacgtttttaaccgaacccgtttaccgttaccgtaaaccctacgtttaacccgaacggtacctaaccggtcccgtacgggtaccgtaacggggtaaccgtacggggtaaaagtagttaccggggtacggttaccgtttaacgtttttaacgttaccgtttagggttaaccgtaccgttaaccgtaaactttaacgttttaacgttacccgtttttaccgttttacccggtttaaccttaccgggtttttaccgggggacggttaaaccgggggtaaccgtaaaggggttacggtaccggtaacgtaaccggtaaaacggtaccggtttacggtaccgggtcttaaccggcccgtaaccgtacctttcgttacggtttcccttacgttaccccgg

SEQ ID NO: 66305 - DNA, 734 bp, Homo sapiens
  misc_feature: GYAE6OF02HPOTG.31.78.H01.1.454.CMB.1.raw
  modified_base (472)..(472): a, c, t, g, unknown or other
  misc_feature (472)..(472): n is a, c, g, or t
  modified_base (618)..(618): a, c, t, g, unknown or other
  misc_feature (618)..(618): n is a, c, g, or t
  modified_base (703)..(703): a, c, t, g, unknown or other
  misc_feature (703)..(703): n is a, c, g, or t
tcagcagtagacgtcacgaccggtgctcgatttagtgtgagtagtttgggtttgggggagctacaacaggcaggcaggggcagcaagatggtgttgcagacccaggtcttcatttcctctgttgctgtcggtatctcgtggtcgaccgtacggggacatcgtgatcgagcctaggtttccagtacctcccgtggcttgtcgtctcggtcgggacgacggacggcccacctacgtacaacgtcgaccgtaacgtccgaacggccgtaaggttacgttttgtttttacgttaccggaccccctaaactaaactaacctaaacttaccgttacgttcgtttacggaacctacggtacaaaggtaaacggtacggaacgtacgtacccgttaacctaaaccgttccgtaggttacgttaaccggtcggtaccttcccggacccggtctacgggttacccgggttacctaacggttnttacgacgttcggcgtacgggtccggtacgtacggggtacttacttccgacttaccgaccgtactacgttagaccgtacgtcggccctacggtcacgggcgtaaagaggtacgtggtacgtacgtttaagtttactagtccgtaanacgttactaaacttgttaacctttcgtttacgtctacgtacggttcggaggacgtagtagagtacataacgtaagcgttgacgtntaccacgtgtaccttgttactaccttctacg

SEQ ID NO: 66306 - DNA, 883 bp, Homo sapiens
  misc_feature: GYAE6OF02HA9XD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccgtggctgtgtctcgtgggcagacgggccaccatcaactgacaagtccagccagtacgttgttttattccggcccccaacgtaataacctaacttacttagccttaggtaaccaagcgtaagaaagttacgggaccaacgtcccttaaccttaaacctccgttagtaacgttttaccgcggggtcctttacccgtaacccgggactaccggttcccggggtttaccctaaaccggttacttacagtttcggctaacgggtccgggttacgtacggggtacccgttagtttccacgttcctaccaaccgtattacccgacggtaccacggtcccgtacggtaccgaacgggtacgttaaggaaaacggtacggttacgggttaccggtaccgttttaagggtttttaaacctttacggttaccgttcggtaaacggtaaccctaaaacctttacgttttaaaaccctttacccgttttttaccgttttacccgttaacccggtttaaccggtttttaacccgggggtaacgggttaaaccgggtaaaccggttaaaggggtttacggggaaccgttaaccgttaaaacccgggtaaaccgggttaaccggtttacggggtaccgttaccgggttaaaccggccccgtttaaaccggttaccgtttaccccggtttagggttttaaccccttcccgtttaaaccccgg

SEQ ID NO: 66307 - DNA, 822 bp, Homo sapiens
  misc_feature: GYAE6OF02IWSTG.31.78.H01.1.454.CMB.1.raw
  modified_base (126)..(126): a, c, t, g, unknown or other
  misc_feature (126)..(126): n is a, c, g, or t
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
tcagcagtagacgtcacgaccggtgctcgatttagtgtgagtagtttgggtttgggggagctacaacaggcaggcaggggcagcaagactggtgttgcacgacccaggtcttcatttctctgttgntctgatctcgtggtcgaccgtaccgggacatcgtagntagngaccgtacgttaccagtacctccgtggtcgtntcgtccgtcggngggtcgaacggttacggccgactacactaagtcgacgtacgtaccgaggtacccgtaggttacggttttagttttacccgttaccgacccccgtaactaaacgttaacctaaccttacttacggtaccggttacgaaccgagtaccgaagaaacgttacgaccaaccgtaccttaaccttaacgtacgtacgttacgttacggttacggtacccgttccggacccggttcggtaccggttaccccggttacgtaacgtcgtagtacgcggtccgtacgggtccggtacggttacggtaccctttactacccgttactacccacttaccgtacgaccgtaccaccgtacgtccgtacgtagacggtacgtaacggtaggtaccggttgtaccgggttattaacgttagttaccttaacgtacgtaaataccgttaacttagtttaccgtttccgtttaccgtttaccgtttaccgggaaaccggttaaccgggtaaccgggtaacgggtaccgtaaggtcgtaaccgtaacgttcccgtaaagggttacccgtagtggtaaccgtccgttaacgttaccgtacgtttcctacggtaccgttttacgtacccg

SEQ ID NO: 66308 - DNA, 791 bp, Homo sapiens
  misc_feature: GYAE6OF02GI4DU.31.78.H01.1.454.CMB.1.raw
  modified_base (130)..(130): a, c, t, g, unknown or other
  misc_feature (130)..(130): n is a, c, g, or t
  modified_base (757)..(757): a, c, t, g, unknown or other
  misc_feature (757)..(757): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggntctctggtgcctacggggacatcgtgatgacgccagtttccagactccctggctgtgtctcgtgggcgagagggccacctatccaacgtgactaacgtccacggtccagtagttgtttttacgttccggccccctaacctaataaccaacgttaccttaagtccttagggtacccaggtacaaagggtaaaacgttagggaacctacggtaccccttaacttaaaaccttccgtaggttaacttttaccgttcggggtccttttaccgggaaccccgggtagttaccggtttacccgggggtttaccccttaaaccggtacttcctaacgttcgggacctacggggtacgggttccggttacgggggtaacccttacgttttacgaacccttccgtaaccctaaccgtaacgttccgaaaggttcccgacggtacctcggaccggtaacggcttacggaaacggtgttcggtaggtacgttaggtttaccttacggttcgtacctaacggacttaactagtttacttacctttccgttacgttcgtaccgtttcgggacggtacgtaacggtacggtagtacgtactaccggtaaacgtaccgtcggttacggtctaccggttaccnccgttaacgtccgttcgttacccgtcttaacccg

SEQ ID NO: 66309 - DNA, 946 bp, Homo sapiens
  misc_feature: GYAE6OF02H6N8H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatggacgacccgtagtttccacgtacctcccgtgggtccttgtcgtccgtcgtggggacgaggacgggcccaccataccaacgtgacaacgtccacgaccgaggtagttagtttttacgttccggacccccctaactaaacttaacctaaccgttacttaggtaccgttacggtaacccagaccgaaggtaaaacggtacggacctaaccgtacccttaaccccttaaaacgttccttaggtacgtttaccgtcgggtacctttacccggaccccgggtactaccgggttaccccggggttacctaaaccggtatttaccgtagttcggaccgtacggggtccggggttacgtaccggggtaccttacgtttccgtaaccccgttctaacccgacccttagtaccgaacggtcccgtaacggtcccgttcggaacccggtacggggtaccgttaaaggtaacggttacggttaccgggttaggttaaccgttttaacggttttactttaccggttacgttacgaacgttaccttaaacgtttacgttttaacgttttacccgttttccggtttttacccgttaccggttttaaccggggttttaccgggggaaccggggttaaaccgggttaaaccgggtaaggggttaacgggtaaccggttaaccgttaaccgggaaaaccggtttaccggtttacggggtaccggttaaccgttacccggacccttaacccggttaccgtttaacccggttttccgtttacccccgtttacgttaccccccgg

SEQ ID NO: 66310 - DNA, 739 bp, Homo sapiens
  misc_feature: GYAE6OF02IXOLD.31.78.H01.1.454.CMB.1.raw
  modified_base (193)..(193): a, c, t, g, unknown or other
  misc_feature (193)..(193): n is a, c, g, or t
  modified_base (263)..(263): a, c, t, g, unknown or other
  misc_feature (263)..(263): n is a, c, g, or t
tcagcagtagacgtcacgaccggtgctcgatttagtgtgagtagtttgggtttgggggagctacaacaggcaggcaggggcagcaagatggtgttgcacgacccaggtcttcatttctcttgttgctcgtggattctcgtggtcgccggtacgggatagtcgtagatggcgccgttagttccagtccctccgnggtcttcggttcgtcgtcgtcgggacgaacggccggacccacgtataccaacgcggactaaccgtcacgnggtaagttcggtttacgttttacgtaccccgaaccctaaactaaacttaaacctaaccgttacttacgtacgttacggtacacgacgaagtaaggtacgactacgcctacctactactacgtactcgtcggtactccggtaccggtacgtacgttaccgggtacctaacggtctaccgtgtccggacgtacggtcggtaccggttccggcgtaccgtttacctactccgtacgtaccacgtacgccgtacgtccgaccgtcggacgtacggtacgacgtacggtcgtcggtaaggttcgttaagtttactagtccgtacgacgttactaacgttactttagtaccgttttaccgttccttaaccggtcggtttaccgggaggtaaccggtccgtaaggtacgtacgtaacggtaacgtaacggtacgtggtaccgtacgtacgaccgtactactttcggtaccttacgttcctccg

SEQ ID NO: 66311 - DNA, 184 bp, Homo sapiens
  misc_feature: GYAE6OF02HGBUG.31.78.H01.1.454.CMB.1.raw
  modified_base (137)..(137): a, c, t, g, unknown or other
  misc_feature (137)..(137): n is a, c, g, or t
  modified_base (144)..(184): a, c, t, g, unknown or other
  misc_feature (144)..(184): n is a, c, g, or t
tcagcagtagacgtcacgaccggtgctcgatttagtgtgagtagtttgggtttggggagctacaacaggcaggcaggggcagcaaggatggtgttgcagacccaggtcttcatttctcgtgttgctctggtactctntcgggtnnnnnnnnnnnnnnnnnnnnnnnnnnnnnnnnnnnnnnnnn

SEQ ID NO: 66312 - DNA, 729 bp, Homo sapiens
  misc_feature: GYAE6OF02HS73Z.31.78.H01.1.454.CMB.1.raw
  modified_base (330)..(330): a, c, t, g, unknown or other
  misc_feature (330)..(330): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgaccgtacgggacagtcggtgatgacgcctacgtttccagtcctccgtggctgtcgtcgtcgtcgggcgaggcggccacctatacaacgtgactaacgtccagtcgaagtagttttgttttacgtccggacccccaaagtaataacctaacgttactagcgttacggtaccagacgtaaggaagtcgacncgtaccctaactaactcgtagtacgttcgtcggtaccttcggaccgggatcgggttcccgggtacctaacgtattcgtagtcggtacgtcgggtccggttacgtaccgggaacttacgtttcaccgttcaccgtactcgagtaccgctcgtctcgacgacgtacgtagtaacgtacggtcggtacgtactttaacgtttcgtacgttcgtaacgtacgtaaccgttaaacgttatttaacccgttacgtttacccgtttaccgtccggttaaccggttcgggaaccgggtaacggtaaccgtaaggggttacccgacgttaacgtaaccggaaacggttacggtacgtcggtaccgtacgacgtaaccgtgttaccgttacttaccggtacctacccgg

SEQ ID NO: 66313 - DNA, 666 bp, Homo sapiens
  misc_feature: GYAE6OF02FINHH.31.78.H01.1.454.CMB.1.raw
  modified_base (198)..(198): a, c, t, g, unknown or other
  misc_feature (198)..(198): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (366)..(366): a, c, t, g, unknown or other
  misc_feature (366)..(366): n is a, c, g, or t
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagacctccctggctgtcgtctcgtggcgngaggccacatcaactgcaagtccagccagtagttgttttatccggccccaactaataaccaactactagcttaggaccagcaagtaaacgtacggacacgtccctacctaaactctntaactttacgnggtcttccgacccgggntacgttcccgggtactaaccgtnttctagtcggcaggtccggtgcgggtaccgtactttcacttctacccacnctccgagaccacgtcgtacgcgtacgcgtaaggaacgtacgttaggtcggtacgtttaacgtttacgttacttacggtacacggtacctaaacttatttaacgtaccttttacccgtttccgtaaccgttacggtttccgggaacggttaccgggtaccgtaagggtacggtacgtaacgtacgaaaacggtacggtacggtggtaccctggaccctaaccgacgttacgtcgttacctaccgttaaccg

SEQ ID NO: 66314 - DNA, 899 bp, Homo sapiens
  misc_feature: GYAE6OF02GH82Y.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcattctcctgttgctctggatctcgtggtcgccgtacggggacagtcgtggatggacgtcctaggtttccagacctccgtggctggtcgtctcgtgggacggaggacgggcccacgtaactacgaacgtcgaccgtaacgtaccgtacggacctaggttacggtttacggtttttacggttacccggtacccccctaaaacctaaaacgttaaaaccctaaaccgtttaaccgtttacggtaccgttttaaccggtaaccgaacggtaaccgtaaaagggtaaacgggtaacggtaacccgtaaccgggtaccccttaaaccctaacccgttaccgtaacgttttaacgtttaaccgggtacgggttacccttacccgggtacccgggtaaccgtttaaccgggttacccccggggttaacttaaaccccggtagtttccgtaacggttccggaccggttaacggggccgggttaccgggtacggggtaaccttacgtttaccgacgttaccaccggttacctaacgccgtaacggaccgtacgtacccgtacgtaccggtacggtcgtaacggtaacgtacgtggttaccggtacgtttaacggttaacttaccgtcggttaaccgtaacgtaaacaccgttaactttaaccgtttacttcccgttttacgtactttaccgggttacggtacgggaaccggtaacgggtagtacggtacgtacgtaacgtaaaggtccgtaggtccgtaacgtcgtaccgtactaccgttactccgtcttacgtaccg

SEQ ID NO: 66315 - DNA, 822 bp, Homo sapiens
  misc_feature: GYAE6OF02IL6WO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggacagtcgtgatgacgcctagtttaccacgtacctcccgtggtctgttcgtctcgtgggaccgaggaccggacccaaccactaccgaacgtcgaccgtaacgtccagaccgtaaggttaacgttttcgttttacgttccggaccccctaaacgtaaactaaaccaaaccttaacgttacgtcgttaacggtaccaacgacgtaaaggtaaacgtaacgaacgaccgtacccctaaccttaaccttaccgtacgttaacgtttaacggtccggttacccttaccggtaccggtaccgttaaccggttcccggttaacccgtaaccgttacttacggttacgttcggacgtaccgggtaccgggttcgtaaccggggtaccgtttacctttaccgtacccgttacccgtttaacccgaactttaccgccgtaacgaacccgtacgtccgtacgggtaccggacggtaacgtacggaaacgttggttaaccggtcgttaacgttaacgttttaactacggttaacgtactaaacgactaacgtttactttactttaccgtttacttcgttaccgttacgttacggtccgggaacgttaccgggagtacggtataccggtaacgaacgtacgtacggtcgtatacctacgacctacgttccgttacgtctcgtaccg

SEQ ID NO: 66316 - DNA, 752 bp, Homo sapiens
  misc_feature: GYAE6OF02J1AUX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacattcgtgatgagcctagtttccagacctccctggctgtgtctcgtgggcgagagggccacatcaactgcaacgtccagccagtgttgttttatcggacccctacaataacctaactactagtcgttaggtaccagacaagtaagtacggactacgccctaccgtaaactcctagtactttacgtagggtccttaccggtaacccgggtacgtacggttcccggggttaaccctaaccggtacgttcgtaacgttggaccgtaacgggtccgggttacgttacggggtacccggttagttttaccgtaaccttaccgtaccgtacccgtaagttaccgaacggacgtaaccggccgtttaggaaccgtagggtacgtacggtaaacggtacgttaacgggtacgtacgtaacttttaacgttaccgttacgtaccgtaacgaacttaaacctaagtttaaccttaccgtttacgtttccgtacgttaccgtttacgggacggtaacggtaaaccggtaggtacgggtactacgtaaccgaaacgtaccgtagtaccggtactacggtccgtaactcgttacgtagtttcctacgttaccccg

SEQ ID NO: 66317 - DNA, 704 bp, Homo sapiens
  misc_feature: GYAE6OF02FY9TX.31.78.H01.1.454.CMB.1.raw
  modified_base (463)..(463): a, c, t, g, unknown or other
  misc_feature (463)..(463): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgcctacggggacatcgtgatgacgccagtttccagacctccctggctggtgtctcgtgggcgaggacgggcccaaccatcaaactgaccaagtccagccagtagttgtttttacttccggacccccaacaaataaacaactactagtcttgaccagcaaggaaagtaggacacgccctaacctaaactcctagtaactttaccgtgggtacttccgtacccgggcaccggttaccggggttacctaaccgtattactagttggacgacggtcgggtacgtcgggacttatttaccacttccacaccactcacgtcacgcctcgngagctagaagtgtcggtcgacttaagttttactacgttcgactagacctaattaacgtttaacttaccgttttccgttttaccgtaccgtttaccggtttaccgggaccgggtaaacgggtaccggaaagggttcgggagtaaccgtaaaccggtaaaccggtaacggttcggggttaaccggcgttacggtaaccctaaccgttacttcccggttactttacccgttaccgttaaccccg

SEQ ID NO: 66318 - DNA, 785 bp, Homo sapiens
  misc_feature: GYAE6OF02IB9GW.31.78.H01.1.454.CMB.1.raw
  modified_base (317)..(317): a, c, t, g, unknown or other
  misc_feature (317)..(317): n is a, c, g, or t
  modified_base (364)..(364): a, c, t, g, unknown or other
  misc_feature (364)..(364): n is a, c, g, or t
  modified_base (433)..(433): a, c, t, g, unknown or other
  misc_feature (433)..(433): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctcgtggtgcctaggggacagtcgtgatgagccagtttccagcctcccgtggctgtgtcgtctggggacgaggagggccaaccgtatacaaactgcaagtccaaggccaggagttgttttacttcggacccccacgaaataaccgaatacctagtactggttaaccagtcaagaaaagttcggaacngtacccactaaactcctgatttaccttggacctttcgaaccccgggntagtacccggggtttccaaaccgtgttacaatttccggaaacgggtcggtaccgtttcgggaaccgttnttcaaccttccgtccaaccagtcaagtccgacgaccctagtaccgtacgggacgttacgaaccggttaagtacggttacggaaccggttactttttaaacgttaaacggtttaccctcggggtttaaacaaccccggtaaagttaactttaaccgttaaccggtttttacttttacccggggttttaaaccttacgggtttttaacccgggcccggggttaaaggtaaccccggtttaaaggggttagacgggtttaaacctaacgggttaaaaacggtaacccggttaaggttccggttaccgacggttacgaccctttaagttacccgggttactcggtttaacttccgg

SEQ ID NO: 66319 - DNA, 674 bp, Homo sapiens
  misc_feature: GYAE6OF02HMS3Y.31.78.H01.1.454.CMB.1.raw
  modified_base (185)..(185): a, c, t, g, unknown or other
  misc_feature (185)..(185): n is a, c, g, or t
  modified_base (482)..(482): a, c, t, g, unknown or other
  misc_feature (482)..(482): n is a, c, g, or t
  modified_base (533)..(533): a, c, t, g, unknown or other
  misc_feature (533)..(533): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccaggacctcccgnggctgtcgtctcgtgggcgaggacggccacctatcaactggacaacgtcacgccagtagttgttttacgtccggccccctaactaaataaaccgaacttacgttaacgtcgttacggtaacccagaccaaggaaaagtacgggtaacacgacccttaacctaaaccttctagtactttacgtggtacccttcgacccggtcctacggttaccgggttaccaacgtcttacgtagtcggacgtacggtcgggtcgtacgggccgttacttctaacgtctacaccgtatccgatcgacncgtacgacgtgtaccgagaacgtagtcggcgttagtacgtttaacgttcgngttacacgtaactacgtattaacgtttcttactttccgttacgtcgttcggaacggtacggtaacgaggtacgaagttactaacggaacttaaggtcggtaacgctcgacccgtacggtattccgtagttcctacgttacc

SEQ ID NO: 66320 - DNA, 756 bp, Homo sapiens
  misc_feature: GYAE6OF02IO0Z6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattggccccacaataacaactacttagcttggtaccagcaagaaagtaggacagcctacctaaactcctagtactttacgtgggtccttccgtacccgggctaacgttccccgggggtttaccctaaaccggtatttaccgaagtttcgggaccgacggtaccggggttaccgtcgggggaaccccgtattttcccgaaccgttccttacccgaaccctactaccgaacgtaccgtaacgtcccgtacggaccgaacgggtaccgtaggaaaggtagttcgggttagggacctttaaggttttaacgtttaaccgtggttaccgaagaacctaaacgttaacgttttaactttaaccttttccgttttaccggttaccttaaccgttttccggggaccgggtaaacgggtaacccgtaaaggggtcggtaacgtaactaaccggaaaacggtaaccggtggttaacggtccgttacgacctaacccgtaacgttccgttacggttaccttacgtacccg

SEQ ID NO: 66321 - DNA, 896 bp, Homo sapiens
  misc_feature: GYAE6OF02G08TD.31.78.H01.1.454.CMB.1.raw
  modified_base (684)..(684): a, c, t, g, unknown or other
  misc_feature (684)..(684): n is a, c, g, or t
tcagcagtagacgtcacgaccggtgctcgatttagtgtgagtagtttgggtttgggggagctacaacaggcaggcaggggcagcaagatggtgttgcagaccaggtcttcatttcgtctgttgctctggatctcgtggtgccgtacgggacatcgtgatgacgtccagtttccacgtaccgttcctcggtctcgtcgttccgttcggtgggacggacggacgggcccaaccgacttacaacgtcgtacgaacgtaccgacgcctaaggttacgttacgtttttacgttccggaccccctaacgtaaacttaaaccgtaacttacgttaacgtaccggtttacggaacccctagaacgtaaacgtaaacggtacggaactaccgtacccgttaacccgtaaaaccttccgttagttactttacggtacgggtaccctttacggtaaccccgggtatacccgggtttcccgggttacccttaaacccggtactttacgtacggttccggtacgtacggggtacggttccggtacggggttaccctactttacccggtctttacccgtctaaacccgtacttaccggacgtacccgtcgtactacggtacgtacgggtaccgagggtaacgttaccggtgggtccgtacggtttaacgttttacgggtaacttaggtaacccgtaanaacccgtaattttacttaaccgtttaactttttacccgtccggttacgtttaaccgggtcggttccgggaaaaccgggtttaccgaaagggggttacctacgtaaccgggtaacgttaaaacccgggtaacggtttaacggttccggtaaccgttcccggtaacgttacccgtagtttaccccgttaacgggtttacctccggttaaccccg

SEQ ID NO: 66322 - DNA, 840 bp, Homo sapiens
  misc_feature: GYAE6OF02FOYDT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtgccgtacggggacagtcgtgatgagcctagttccagtacctccccgtggtctagtcgttctcggtgggccgtaaggacgggcccaaccgtactacctaacgtcgacgtaacgtaccgacgccgaagtaggtttgttttacgttaccggaccccaaaccgtaaaactaaactaaccttaacgtttacgtaccgtttacgggaaccctaggaaccgaaggtaaaaggtacggaccaacgtacccttaaccgttaaaccctacgtacgttacgtttaacgtacgggttccgtttaaccgacccgggacgttaaccggtttcccggggttaacccttaaaccggtacttacgttacggttaccggtacggtaacgggtaccgggtaccgtacgggtacccgttacgttttaaccaccgtttacccgtacctaacccgaacttacccaggtaacccacggtcccgtacgaccggtaaccggtacgtacggaaacgttagggttcggtaacggtacgtttaaacgttttacgtacggttcgtacgaacgtacctaaccgttatttaaccgttacgttactttcgtaaccgttacggttccggacgggtaacggtaacgaagggtacgtacgaacgtaaccgtaaacggtcgtaacggtcgttaactcgacccacgttaccgtccgttacgttcccttaagttcccc

SEQ ID NO: 66323 - DNA, 908 bp, Homo sapiens
  misc_feature: GYAE6OF02IK5FS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccataccaatgacaacgtccagccaggtagtttgttttacttccggaccccctaactaataaaccaacttacgttagccgtttacggtaaccagacaaggtaaaaggtacggaaccacgtaccccttaccgtaaaaccttcccgttacggttaatttaacccggtcgggtaccgtttacccggtaaccccgggggtactaccgggtttacccccggggttttaccctaaacccgttacgtttctaggtttcgggacctacggggtccggggttaccgtccgggggtaaaccccgttacgtttttaccgacccgtttacctacccggaaccccttaactccggtaaacggtcccgtaaccggtacccgttcggaccgtacgggtaccgtagggtaaaaggtcggttacgggttacgggtacgtttacgtttttaacgttacccggttagttaccgtaagtaaccgtaaacgtttaatttaacctttaccggtttttacccttacggttacccgtttaccggtttaccgggggaacccggggtaaccgggttaaaccgtaacgggggttaacggtacggtaaaccggttaacccgtaaaaacgggttaaccgggtacggttaaccggggtaccttaccgggaacccgttaaccgtttaccggttaccgttaccggttttacccttaccgttaaccccgg

SEQ ID NO: 66324 - DNA, 793 bp, Homo sapiens
  misc_feature: GYAE6OF02HX8WO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacagtcgtgatgacgcctagtttccagacctccgtggctgtgtctcgtgggcgaggaggccaccgatcaactgacaagtccagccaagtagttgttttacgttccggacccccaacgaaataacctaaacttacttagcttggaccagacaagaagtagacacgtacctaccttaaactcctgttacttacgcggtcctccgtacccggctaccggtcccgggttacctaaccggtattccgtagttcggacgaggtcgggtctacggggaccttagttaccgtaccttccgtacctaccgtacgtcgacgtaccgacgtcccgtcggacgtacggtacttacgggaaacgtggtacggttagggtctttaaacggttttacgttaccgttcgtaccggtaaacgtaccgtaaaacgtttaactttaccgttttaacccgttttccgtttttaacccgttacccgttttaaccgggttttccggggtaaacccgggggttaacggtaaacccgggttaagggtaacggttaccggtaaacggttaacccggtaaaacggttaaccggttgggtacccggtacgtaccggtaaccgtaaccccgttagtttaacccggttcggttaccttttccgtaaccccgg

SEQ ID NO: 66325 - DNA, 604 bp, Homo sapiens
  misc_feature: GYAE6OF02JQBM5.31.78.H01.1.454.CMB.1.raw
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
  modified_base (390)..(390): a, c, t, g, unknown or other
  misc_feature (390)..(390): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggcccccacaataacaactacttagcttaggtaccagcaagaaagtaggacacgccctactaaactcctagtatttacgngggtcttccgaacccgggntacgttcccggggttacctaaccgtattcacgttggccaggcgggttacngggaccgtatttcgactctacaccatcgagtcacgcctgcacggctagaagtatgtacggctagtttatacgtnanacgtacaacttattaattcctttccttcgtaccttacgtttcgggacggtaacgggacctaagggtcgtagtaacgttcgaaaacgtacttgggtaacgccgttagaccgtccaacgttcttcggttacttccgtacc

SEQ ID NO: 66326 - DNA, 862 bp, Homo sapiens
  misc_feature: GYAE6OF02IHZQG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggactctcgtggtcgcccgtacggggacagtcgtgatggacgcctagtttccagtacctcccgtggtctgtcgtctcgtgggacgaacggacggcccaacctacgtaccgtaaacgtgaaccgtaacgtcccgaaggtacccgtaaggttacggttttacggtttttacgttaccccgggacccccccttaaaccgtaaaattaaaccctaaaccgtttaacgtttaacggtccgtttacggtaaccgaggtacgaaaggtaaacggtacggaccgtaccgtacccctaccttaaacctccgttagttaacgtttaccgcgggttaccttaccggtaccccggtctaaccgggttccccgggttaacctaaccgtgttacctagtcggaccgtacgggtccggttaccggtacgggtacctttacttttaccgaccgttacccttaccgaacccgtagtaccgtaccgtaccgtaccgtccgtacgaccgtacggtacgtaaggtaacgtacgttacgggttacggtacgtttaacggtttaccgtacggttcgttaaccgacgtaaactaacgtttaactttacctttacctttaccgttacccgttaccgtttaccggttcgggaaccgggttaacggtaacccggtaggtacgtacgaacgttaccgaaagtcggtacgtaccggtctaaccgtacccgtacttagtccgttacgttcctacccgttaccg

SEQ ID NO: 66327 - DNA, 828 bp, Homo sapiens
  misc_feature: GYAE6OF02HD66D.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgaccgtacgggacatcgtgagtgacgcctagttccagcctcccgtggctgtgtctcgtcgggcggacgacgggcccaacctataccaaacgtgacaacggtccacgaccaggtagtttgttttacgttccggacccccaactaaactaaacctaactacttacgtcttacggtaaccacgaactaaaggtaaacggtaacggaacgtacctacccttaaccctaaaacctttacctttaacgtttaaccgtccggtacctttaccccggtaacccccgggtaccgtaaccggttccccgggggttaaccctaaaccggtacgttaccaacggtttcggaccgtagggtcccgggtacggtacgggtaaccgttaccttctaaccgtcctaccgtaaccacgttaccgacgtaccgaccgtcgtaccgtacgacgttaccgaggtaaacgtcgttagggtcggaacgtttaggtttaaccttacgttacgtacgaacaacttaacgttaactttaacgttacccgttttaccgtcccgttaccgttaaccggttccgggaaacgggttaccgggaaacggtaaagggtacggaacgtaacgtaacccgtaaacggtaccggtaggtaccggtacccgtaggacccttacgtacgttccgttaccggtttacctccttaccgttacccccgg

SEQ ID NO: 66328 - DNA, 763 bp, Homo sapiens
  misc_feature: GYAE6OF02GBCZL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagtactccctggctgtgtctcgtgggcgaggacgggccaccatcaactggcaacgtccagccagtagttgtttttattcggacccccaccgaaataaccaactacttagcttacggaccagacaagaaagtaggacacgccttacctaaacctcctagtatttaccgtgggtccttccgtaccccgggctaaccgttcccggggttaccctaaccgtacttcgtacgttcggaccgacgggtcgggttaccgtggggtacccgttacttttccgactccgtaccaaccctacgttccaacggcccgtcgtacccgttcggacgtacggtacccgttaaggaaacggtacgttgggtacggtacgtttaagtttttacgttacccgttggtaccgtaacggtacctaaacttaacgttttaccgtttaccttttccgttttccgtaccgtttaccggtttaccggggtaaccgggtacgggtaaccgtaaggggtacgggtaacgtaaccgtaaccgtaaaacggttaccggttaggtacgttaccgtacgtaccgtacccttacgtaccgtttccgttaccttaccgtacccg

SEQ ID NO: 66329 - DNA, 706 bp, Homo sapiens
  misc_feature: GYAE6OF02I7O7U.31.78.H01.1.454.CMB.1.raw
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggactagtcggtgatggacgtcctaggtttcccaggtaccttcccgtggtctgtcgtctcgtgggcgaggacgggtcccacctagtaccaactcgaccgacgtccagccgtaggtagttgttttagtccggaccccaataaacgtaacaaccttacgtagtcttacggtaaccagcgaagtaaagacggacacgccctaactaaaccgtctgtaactttcgnggtcctacgacccggntacgtccgggttacctaactntgtatcggcgaggcgggttcgagggtactacgttcactccgtacactaacgtcgacgcgacgcgtcgacgcgtacgtacggaagtacgtacgtggtacttagttaagttcgtaagttcgacgtaaccgtaattacttaacttacttaccggggggtttacttaccggttacgttaacgggtacgggttaacgggtaaccgttaagggttaccggtacgtaacgtaaccgtaaaccggtaacgttacggtacggtcgttacgtccgaccgtaacgttcgtacgttccgttacgttacccg

SEQ ID NO: 66330 - DNA, 781 bp, Homo sapiens
  misc_feature: GYAE6OF02G83QI.31.78.H01.1.454.CMB.1.raw
  modified_base (134)..(134): a, c, t, g, unknown or other
  misc_feature (134)..(134): n is a, c, g, or t
  modified_base (207)..(207): a, c, t, g, unknown or other
  misc_feature (207)..(207): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctntggtgccgtacggggacatcggtgatgagcctagtttccagacctcccgtggactgtcgtctcgtgggcgagnggtccacatcgaactgacaacgtccacgccgagtagttgttttacttccggaccccaactaactaacctaactacgttagtccgttacggtaccagacgaagaaggtacggaccacgtacccttacccgtaaacctccgttagtaacgtttacggtcgggtacctttaccccggtaccgggctaccggttaccccgggtttaccctaaccggtattcgtacggttcgacgtcgggtcggtccgtacgggaccttagtttccaccttcgaccctaccgactccgaacgtcctaagtcccgtacgacgtacgggtactaagggaagtagttggtaccggttagttaacgttttacgtacttaccgtagtaccgtaacgttaaaccgttattttaaccgtttactttacccgtttaccttaacggtttcggtttacccggggaaacggttaccgggtaagggttaaaccggggtcggtaaagtaacccgtaaacccgttaaacggggtacccttagggtaaccggttccgaccggtaccctacgttaccgttcgttacgttacctaccgttaacccg

SEQ ID NO: 66331 - DNA, 748 bp, Homo sapiens
  misc_feature: GYAE6OF02HKYLJ.31.78.H01.1.454.CMB.1.raw
  modified_base (190)..(190): a, c, t, g, unknown or other
  misc_feature (190)..(190): n is a, c, g, or t
  modified_base (350)..(350): a, c, t, g, unknown or other
  misc_feature (350)..(350): n is a, c, g, or t
  modified_base (482)..(482): a, c, t, g, unknown or other
  misc_feature (482)..(482): n is a, c, g, or t
tcagcagtagacgtcacgaccggtgctcgatttagtgtgagtagtttgggtttgggggtaggctacaacaggcaggcaggggcagcaagatggtgttgcagacccaggtcttcatttctctgttgctctggatctcgtggtcgccgtacgggacatcgtgatgacgccagtttccagctccctggctgtntactgtagggcaggacgggccacacgtcaactgcaagtccaagccagtagttgttttacttcggaccccaactaataaaccaacttacttagcgttacgtaaccagactaagaaaagttgggaactcgacctacccgtaaaactcaagttactttaacgnggttcctttacggacccggacctacggttaccgggttaccctaaacggtcttaccgtagttggcccgaaggtccgggttacgtaccggggtaacgttaactttccgtaacctcttacccaacgtaacccgtnaaacgccgtaacgtccgtacgtcgacgacgtaggaaacgtagtacggtaggtacgttaacgtttacgtttaactacgttacgacgtactaaaccttaagtttaacctacgttttacccgttaacgttccgttaacgtttacccgggtacgggtaaccgtaaccgggtaagggttcggacgttaagtaccgtaaaaccggtaacggtacgttacgggaaccttacgtaccgaccgtaccttaaccgttggtacccttggttaacccc

SEQ ID NO: 66332 - DNA, 599 bp, Homo sapiens
  misc_feature: GYAE6OF02JRQX5.31.78.H01.1.454.CMB.1.raw
  modified_base (141)..(141): a, c, t, g, unknown or other
  misc_feature (141)..(141): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (451)..(451): a, c, t, g, unknown or other
  misc_feature (451)..(451): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggactctcgtggtnccgtacggggacagtcgtgatgacgcctagtttccagtacctcccgtggctgttcgtctacgtcgggcgaggacggcccaccgtatacgactcgacgtaacggtccacgactaggtacgtttagttttacgtccggaccccaactaaacttaacaacttacttgcgttacgtaccacggtacaagtaacgtgacacgtcctactaacncgtagtcttagngtctcgccgntcgtccgtctacntctagtcgngcgtcggtnacggactntcactcncacntcngcncgcgtngtcgnagagtagtgcgtntattctagcgtacagtacatattacgtacttacttcgtcgtacggttacgtaccggagtaccgtagcgtagttaccgaacgaaacggttcgtacggtccgtacgtccgaaccgtaccgtacgttacctacggtttacctcgttacccg

SEQ ID NO: 66333 - DNA, 666 bp, Homo sapiens
  misc_feature: GYAE6OF02IZQNS.31.78.H01.1.454.CMB.1.raw
  modified_base (337)..(337): a, c, t, g, unknown or other
  misc_feature (337)..(337): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttcagactccctggctgtgtctcgtgggcgagacggccacatcaactgcaagtcagccagagtgttttatcgccccacaataacaactacttagcttcgtacagacaagaaagtagacagccctacctaaacctcctaggtactttaccgtggtccttacgtaccccggganacgttcccggggttacctaaccgtattacgagtttcggacacggtccggtctacggggaacctgtttaccacgtctaccgaacctagtcctaagcgaacgtctcgacgaggtactacgaagtagtacgtcggaccttaggttaacttcgttacgtactaacgtactaaacgtactttacttacgttttacctttgttacctacggttttaccggacgggtaaacggtaccgtaagggttacggacgttaactaaacggaaaccggtaaacttcggtagtaccgtaagtaccgtaacctaacggttcgtttacgttacgttacttacccg

SEQ ID NO: 66334 - DNA, 808 bp, Homo sapiens
  misc_feature: GYAE6OF02FR0RF.31.78.H01.1.454.CMB.1.raw
  modified_base (60)..(60): a, c, t, g, unknown or other
  misc_feature (60)..(60): n is a, c, g, or t
  modified_base (469)..(469): a, c, t, g, unknown or other
  misc_feature (469)..(469): n is a, c, g, or t
tcagcagtagacgtcacgaccggtgctcgatttagtgtgagtagtttgggtttggggganctacaacaggcaggcaggggcagcaagatggtgttacagacccaggtcttcatttctctgttgctctggatctctgggtacgcctacggggacatcgtgatcggagcctaggttccaaggcctcccgtgggctgttcgtactcgtcgggacgaggtacggccctaaccgagttaccaaactgggtacaaacgggtacccacgtaccgtaaggtaagtttacggtttttaacgttccggaaccccccctaacaaaattaaccgtaaaccttaacgttaacgacgtttacgggtaaccacgggactaacggaaagtaaccggaacgtacgtacccgttacctaaaaccgtacctgtaactttacgacgggtcttacgtacccgggctacgtccgggttacctaaaccggtnttacagttcggacacggtacgggtcgttaccggacggtaactttccgaacgttctaacccgtaacgactttacggaccgtacgtaccgacccggttcgaccggtacggtacctaagggtaaccgtaacggttacgggtacgtacgttaaacgggtttaacttacgtacgttaccgaacgtacgaaacctaacgtttattaccgtttaccttacgtttcaacggtttcgggaacgggtaaccgtaacggagggttaacgacgtacgtaacgtaaacgttacggtacgtacggtcgtacgtaccgtacgtcgtacgtccggtacgttacgtacgttccccg

SEQ ID NO: 66335 - DNA, 993 bp, Homo sapiens
  misc_feature: GYAE6OF02FPLR7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgcttgtgtactctcgtggtcgtaccggtacgggtactacgttacgtacgtagtacggaccgtaccgttaccgtttacgaccgtacccttcccggtcggtccgttaggttccgttcgttcgggtcgggacggacgggaccggacccaaccgtacgtaccgaaccgttacggaacgtaaccgtaccgaccgacgtaacggttagttttacggttttacgtaccccggaaccctaaacgtaaacgttaaccttaacgttacggttcgttaccggtttaaccggaacctacgaacggtaaaggtaaacggtacggtacctaccgtaacccgttaaacccgtacccttaagtacgtttaacgttttccgggccggttaccgtttaacccggggtacccggacgttaccggggttttaccccgggttaaacctaaactttcggttacgtacgggttacgacggttacggggttccgggtcggtaacccggtacgtttaacttccctaacggtcgtaaccctaagtccgtaccgtacgacgtacccgtacgtcgggtacgtacggtacggtaacgaacggttacgttcggtacgggtaaccgttttaaggttttaacgtcggttaaccgtacgtaaaccgttaaccgttaaactttaaccgtttacgttttaacccgttttaccgtttaccggtttaccgttaacgggttttacccggggaaccggggttaaacccgggtaaccgggttaacggggtaccgtaacgggtaccgttaaaccgggttaaccgtaaccggtttacgggtaaccgtacccggttaaccgtaacccgtaccggttaccgttaccgttacccgttttaccgtaccgtttacccg

SEQ ID NO: 66336 - DNA, 570 bp, Homo sapiens
  misc_feature: GYAE6OF02GTDR8.31.78.H01.1.454.CMB.1.raw
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
tcagcagtagacgtcacgaccggtgctcgatttagtgtgagtagtttgggtttgggggagctacaacaggcaggcaggggcagcaagatagtgttgcagacccaggtcttcatttctctgttgctctggatctctggtgcctacggggacatcgtgatgagccagtttccagactccctggctgtgtctctgggcgagacgggccaccatcaactgcaagtccagccagagttgttttattggccccacaataacactacttagcttggtaccagcagaaagtggacagcctactaaactcctgatttacgtggcctttcgtacccggggctacgtcccggggttacctaaccggattcagttggacaggcgggtctgggaccctntttcactctcacatcagtcagcctgcaggntagaagngtgtggactaggtttatacttgtcagactaactatttattactttcgttcgttacctacgttttcggacggtacgggactaagggtgagacgttacgaaacggtacttggtcggatcgaccaacttcgtccttggttaccctcgtac

SEQ ID NO: 66337 - DNA, 800 bp, Homo sapiens
  misc_feature: GYAE6OF02GULY8.31.78.H01.1.454.CMB.1.raw
  modified_base (152)..(152): a, c, t, g, unknown or other
  misc_feature (152)..(152): n is a, c, g, or t
tcagcagtagacgtcacgaccggtgctcgatttagtgtgagtagtttgggtttgggggagctacaacaggcaggcaggggcagcaagatcggtgttgcagacccaggtcttcatttctctgttgctctggatctctggtgaccgtacggganatcgtgatggagccagttccagactcctggctgtgtctcgtggacgagacggccacagtccaagtcgctaacgtccgagaccaaggtacgttagtttttaacgtttccggccccctaaacgtaaaataacctaactaacgttaagccgttaggtaacccaagcgaaaggtaaacgtacggtacaacgtcccttaacctaaacgttccgtacgtaacgttttaaccgtcgggtacctttaccggtaaccccgggtctaaccggttcccggggtttaacctaaacggttcctttactaacggtttcgggaaccgtcgggttaccgggttaccgtaggggaaccccgtttagttttacccggaccctttaaccaccgtacccaacgttaccaaggcctacgtccgtacgtccgtacggtacgtaggtaacgtagttaggtcggtacgtttaacgtttaagttaccttgtactaacgactaacttacgtttaacttaccgttttaccgtttaccgttacggttacggtttaccgggacgggtacggtaaccgtaagggtaccggtagtaacgtaccgaaacgttaacggttcggtacggtcgtacggacccgtaaccgttcgtttaccgtacgtttaccgttcgttaacccg

SEQ ID NO: 66338 - DNA, 668 bp, Homo sapiens
  misc_feature: GYAE6OF02FGEM5.31.78.H01.1.454.CMB.1.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (320)..(320): a, c, t, g, unknown or other
  misc_feature (320)..(320): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggactatcgtgatgagcccagtttccagacctccctggctgtgtctcgngggcgagacgggccacatcaactgcagtccagccagattgtttattccggccccacaataacactactagcttggaccagcagtaaagtaggacgacncctacctaaacctctaggtactttacngggtcttcctacccgggctacgttcccggggtccctaaccggacttacagttcggcaggcgggtcgtgggaccctatttcgactcgtcacactcgacgcgacgtacctgcctaaggaccttaggaaagtacgttggtaccgggctttaacgggttttacttaccgtggttaccagtaacccgtaaacttagtttactaaccgttttccgtttaccgtacttaacccgtttgggaccggtaacgggtacctaaaggggtggtacaacgtaccgtaaaaacggtacccgtaggggttaccgacgttacgaccctaacctaccggttcttacggttcctttacctacccgg

SEQ ID NO: 66339 - DNA, 777 bp, Homo sapiens
  misc_feature: GYAE6OF02F3ZU4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggtctgtgtctcgtgggcgagacgggccaccatacaactgacaagtccagccagtagttgttttacttcgaccccaacaactaacaactacttagcgttagtaccagcaagaaagtaggacagacccttaccctaaactccgtagtactttacgtcgggtaccttccgtaccccggggacgtacggttcccggggttaccctaaccgtattccgtagttcggaccgtacgggtcgggtacgtacggggtaccgtagttttaccgacttcctacctaaccctacgtaccaacgcctaccgtccgtcgtaccgacgggtactacggtaaagtagttcgggttacggttacgttaaggtttttaaccttacgttacgttaccgaacgtacctaaacttacgtttacttttaacccgtttaccgtttttaccgtacggtttaccgttttaccggggaacgggtaaccggggtacggtaaacggggttacggtacgtaacgttaaaccggtaaacggttaaccgttacgggttaaccggccgttaccggtaccctaccggttaacgtttcccgttcggtttaccctttcgttaacccccg

SEQ ID NO: 66340 - DNA, 774 bp, Homo sapiens
  misc_feature: GYAE6OF02IFXOD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaggggacatcgtgatgagccagtttccagactccctggactgtgtctctggggcgagagggccaaccatcaactcgcaagtccagccagacgttgtttaattcggccccaacaaataacaactacttacgacttggaacctagtcaagtaaagtacggacagacctacctaaaacgcctagtatttacgtagggccttacgtacccgggacaacgttcccggggttacctaaaccgtatttccgatttacggggacctagggtaccgggtaccgtacggggtaacccggtacttttaccaaccgtcttaccaaccctagttaacaacggacctaacggcccctttaggcccgaaaggggtcctaacggaaacgtacgttacgggtacgggtattaacgggttttaattaaccgttaggactaacgactaaacgtatttaacttaccgtttaccgttttacgtccgttaacgttttaccggggaaccgggtaacgggttaacccaaagggggtttacggaacgtacgtttaaacccggaaaacgttaaacccggttcgggtaacgggttaccttaacgggacccctttaaaccacgtttaacccgtacggtttacccgtttaacgttaacccg

SEQ ID NO: 66341 - DNA, 889 bp, Homo sapiens
  misc_feature: GYAE6OF02JM8KP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcctggctgtcgtctcgtgggcgagacgggccataccactactaacgtcgacctaacgtaccaccgaccgtagttacggttttacgttttacggttcccggaacccctaaactaaaactaaaccgttaaaccttaccgttaacgttacgtttaccggaaccgtacgaacgtaaaacggtaaacggtaacggaaccgaaccgtacccctaacctaaaccgttccgttaacgttacggttacggtccggtaccttacccggtaccgggtacttccgggttacccggttaaccgtaaccgttcgttacgtacgtcggaccggtcggtccggttacggtacgggtaacgttacttaccgtcttacccgtactacccgtagtccgacgtacccgtacgtccgacgtacgtaacgtcggtaacgtaagtggtacgtaggttacgttaaaccggtttttacacggttactaaccgtacgttaaacgttacgttaacccttttaaccgtttacgttttacccgttacccttaccgggttttaaaccgggtcccggggttaaacgggtaaacccggttaaaccggggtaacgggtttaccgtaagtttaacccggtaaaaaccggtttacccggaaagggtttcggtaacccggggttcgtaaccccgtaaccggttacccgttaacccggttccggtttaaacgtttccccccgttaacgg

SEQ ID NO: 66342 - DNA, 1013 bp, Homo sapiens
  misc_feature: GYAE6OF02GA9NX.31.78.H01.1.454.CMB.1.raw
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgccgtacgggactatcgtgatgagccagtttccagacctccgtggctgtcgtcgtcgtcgggcgaggacgggccaccagtccaacgtgacaacgtccagccaagtagtttcgttttacgttccggacccctaactaaacgttaaaccgtaaactttaaccgtttaacgtaccgtttaccgggtaaccctaaggtaccgaaaggtaaaacggtaccgggaacctaccggtacccctttaaccccgttaaaaaccgtcccggtttaacggttaaacgtttttaccccggtaacgggggttaccccttttaacccgggttaacccccggggtaccgtttaaccccggggttttaccccgggggttttaacccccttaaaacccccgggttacgtttttacccgtaaaggttttccgggaacccgtaacggggtttccccggggttaacccggttacggggtaaccccgtttacgtttttaaccgtacccgtttaacccgttaccctaaaccccgttcgttaacccgaaccggtaccgtaaccggtaccccgttacgggtacccgtaacgggtacccggttaaggaaaccggtttaacggtttcgggttaccggttaccggttttaaacggttttaacgtttaacccgttgggttaacccgtagtaaaccgtaaatttacgttttaaactttaccgtttttacgtttaccgtttaacccgttacggttttaccgggaaccggggtaacgtaaaccggttaagggtacgttaaccggtaaccgttaacggtaaaccgggttaacggttacggtacggttaccgtacggttacccgtaacggtttaccgtacgtttaccgtttaccttacctttaaccccgg

SEQ ID NO: 66343 - DNA, 850 bp, Homo sapiens
  misc_feature: GYAE6OF02G50QZ.31.78.H01.1.454.CMB.1.raw
tcagcagtagacgtcacgaccggtgctcgatttagtgtgagtagtttgggtttgggggtagctacaacaggcaggcaggggcagcaagatggtgttgcagacccaggtcttcatttctctgttgctcgtggatctctggtgccgtaggggacatcgtgatgacgtcctagtttccactacctcccgtggtctgtgtcttacgtgggacgtaggacgggaccaccgactcaactcgactaacgtaccgagaccaggtagttggttttacgttaccggaccccaacctaaagtaacctaacttacgttacgtcttacggtaccagacgaagtaaagtacggacaccgtacccttacccgtaaactcgttagttactttacggtcggtaccttcgacccggtctaccggttccgggttacctaaccgttattacgtcgttacgggaccgagggttccgggtacggtaccgggtacggttacttaccggcttacctaccgtaacctacgtaccgaacgttaccaccgttaccgtacggtacccgtacggtaccgtaggaaacggtgttaccgggttacgtaaccgtttaaaggttttaaccgttacgttacggtaacccgttaaggttacccgtaaacttacgtttttaacccgtttacgttttcccggttttaacgttttacccggttaaccggggtttccggggtaaacggggtaaaccggttacggttaagggtaacggttaaccggtaacgttaaccggtaaaaccggtagggttaccgggtcgtaaaccgtttccgaaccggttacccgttaagggtttccctcggttttaacccgttaccgtaccccg

SEQ ID NO: 66344 - DNA, 837 bp, Homo sapiens
  misc_feature: GYAE6OF02GYZK2.31.78.H01.1.454.CMB.1.raw
tcagcagtagacgtcacgaccggtgctcgatttagtgtgagtagtttgggtttgggggagctacaacgggcaggcaggggcagcaagatggtgttgcagacccaggtcttcatttctctgttgctctggatctctggtgccgtacggggacatcgtgatgagcctagtttccagacctccctggctgtgtctcgtgggcgagacgggccacatacacgtgacaacgtccacgccagtacgtttagttttacgttccggacccctaacctaaacgtaaaccaaacttacgttacgtccgttacggtacccaggaccgaaaggtaaaacggtacggaacacggtacccttaaccttaaacctccgtagttaacgttttacggtcgggttaccctttacccggtacccccgggcttaaccgggttcccccggggtttaaccctaaacccgggttactttacgtaacgttcgggtaccgtaacgggtccggggttacgtaccggggtaccgtttaacgtttacccgtaaccttcctaccccgtaacctaccggttccgaacgtccgtaacggtccctacgggccgtaacgggacgttaacggaagtcgttacgggtacggttacgtttaagttttacgttacggtacgtacgtacgaacttaacgttaactttacttaccttttccgtttaccgtccgttacggtttaccggggaacggtaaccgggtaacgaaagggttccggtaagtaccgtaacgtaaaccgggtgttacgggtaccgacggtacgttaccctacgttattaccgttcggttaccttaccggttacccttacccccgg

SEQ ID NO: 66345 - DNA, 755 bp, Homo sapiens
  misc_feature: GYAE6OF02G2BLA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatgacgcctagtttccagacctccctggctgtgtctcgtgggcgaggcggccaccatcaacgtgcaacgtccagccagtagtttgtttttacttccggaccccctaaacctaaacttaaacctaaaccgttacgttacgtccgttacggtaacccacgacgaaggaaaaggtacggaaccgacgtacccttacccgtaaacctcccgtagttactttaccggtcgggtaccttccggtacccgggctaccggttcccggggttaccctaaccgtcttacgagttcggacgacgggtcgggttacgtacgggtacccgtatttccgacgtcctaccgtacctacgtaccacgccgacgtcccgtcggaccgtaggacgtaggaagtcgttgggtacgtacgttaagttttactacgttacgtccgaatacccgtaatttactttaactttaccttttccgtttacgttcccgtttacggtttccgggacggggttaacggaacgtaaggggtcgagttaccgttaaacggaacggtacggttggtacggttcgtcgtaacctaccgtatttcccgtagtttcccttacgttacccg

SEQ ID NO: 66346 - DNA, 763 bp, Homo sapiens
  misc_feature: GYAE6OF02IJ559.31.78.H01.1.454.CMB.1.raw
  modified_base (396)..(396): a, c, t, g, unknown or other
  misc_feature (396)..(396): n is a, c, g, or t
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatgacgcctagtttccagacctccctggctgtgtctcgtggcgagacggccacatcaactgcaacgtccagccgaagtacggtttgtttttaacgttccggacccccaactaaactaaacctaaccgttacgttacggtccttacgggtaaccaggacgtaaagtaaacggtaggaaccacgtccctaaccgtaaacctccgtagtaactttacgtcggtaccttaccgacccggtntaccggttcccgggttacctaaaccggtnttaccgtagtcgggtacaacggggtccgggttntaaccggggtaccttactttaccgaccttcgtacccaaccgttagtacccgaggtacccacggtacccgtcggaaccggtacggtacgtaacggtaacgtaagtcgggtacggttacgttaacggtttaacgttacgtcgtaacgtaaacgtactaacgttaactttaacgttacgtttccttacgttaccgtacggtttaccggacgggtaacggtaacgtagggtacgacgtacgtaacgtaaacggtcgttcggtacgtcgtacgaccgtacgtacgttacgttaccgttacgtacttaccg

SEQ ID NO: 66347 - DNA, 734 bp, Homo sapiens
  misc_feature: GYAE6OF02HW94S.31.78.H01.1.454.CMB.1.raw
  modified_base (583)..(583): a, c, t, g, unknown or other
  misc_feature (583)..(583): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgactgagcctagtttccagacctcctggctgtcgtctcgtggcgaggacggccaccatcaactgactaacgtccacgccaagtagttagttttagttccggaccccctaacaaattaaaccgtaaaccttacgttaacgcgttacggtaaccacgacgaaaggaaacggttacggaactacggtacccttacccgttaaaacgttccgtacgtaacgttttaaccgcgggttacctttaccggtaccccgggtactacggttacccgggggtttaaccctaacccggtatttaccgtacggtttaggaccgtagggtccgggttacgtacggggtaccttatttccgacttccgtacaccgtatcacgactacgcccgtagcgacgcgtacgaagtatggtacggtattaaggtttacgtgttacgtnacgtaactaacgttattaacgttcctttacgtacttacgtacgtttacgggaccgggtacgtacgtaagggtgtaacgtacgtaacgaaacggttcctagggtaccgtcgtaggtcctaccgttagttccggtacgttccgtagttacccg

SEQ ID NO: 66348 - DNA, 718 bp, Homo sapiens
  misc_feature: GYAE6OF02JSBU9.31.78.H01.1.454.CMB.1.raw
  modified_base (360)..(360): a, c, t, g, unknown or other
  misc_feature (360)..(360): n is a, c, g, or t
  modified_base (498)..(498): a, c, t, g, unknown or other
  misc_feature (498)..(498): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctcggatcctctggtgccgtaggggacagtcgtgatgagccagtttccagactccctggctgtgtctcgtagggcgaggagggccaccgatccaactgcaagtccagccagacgttgttttacttcgggcccctaacgtaataaccaacttaacgttaagccgttaggtacccaaggtccaaggtaaagtacggacacgacccttaccgtaaaacctccgtgtaacttttaccgngggtaccttacgtacccgggctaccggttaccggggttaccctaacggtacttacgtaacgttcggacgtacggtcgggtactcggggaaccttagtttcgaacctcgtacctaccgtatccgagtcgacgctgacgngacgtgaatagtgtacggtacttaggtttacttagtaccgtacgtacgtaacaacgtttaagtttccgttaacgttttccgttacgttaccgttaccgtttccggacgggtaaacggtaacggttaaggtacgggtactaaggttaaccgaaacggttaacgtcgggttagaccgtcgtaaccttaccggaagttccgttacggttaccacgttaaccgg

SEQ ID NO: 66349 - DNA, 795 bp, Homo sapiens
  misc_feature: GYAE6OF02FGIJI.31.78.H01.1.454.CMB.1.raw
  modified_base (341)..(341): a, c, t, g, unknown or other
  misc_feature (341)..(341): n is a, c, g, or t
  modified_base (535)..(535): a, c, t, g, unknown or other
  misc_feature (535)..(535): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattggcccctacaataacactacttagcttaggtaccagcaagaaacggtaggacagcctacctaaactcctagtactttactcgggtactttctaacccgggntacggttacccggggtttacctaaacccggtatttccgaagtttcgggacctaacggggtccgggttaccgtttacggggggaaaccccgttacgtttttaccgaaacccgtttccgtaccctaaacccgtaaccgttccgaacgggtacccaccggtaccgtcgtaccgaacgggttcttaaggaaaacggtnttacgggtacgggtaccgttaacggtttttaaccgttaccttaggttacccaaacgggtaactaaaccgttattttaaacctttaaccgttttaccgttttaccggttaccttacccgggtttttacggaaccgggtaaacgggttaaaccgaacgggggtttaagacggttaaacgtaaccttaaaacggtaaccgttagggttaaccggccgtagtaccgaccgttaattccggtacgtttacctttacgtaccccgg

SEQ ID NO: 66350 - DNA, 784 bp, Homo sapiens
  misc_feature: GYAE6OF02G3VDB.31.78.H01.1.454.CMB.1.raw
  modified_base (368)..(368): a, c, t, g, unknown or other
  misc_feature (368)..(368): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacagtcgtgatgagcctagtttccagactccctggctggtgtctcgtgggcgagagggccaacctatcaacgtgcgtaacgtccagccaggtagttgttttacttccggacccctaacgaataaccaacttacttagcttaggtaccagacaagaaagtacggactacgccctaccgtaaactcctagtactttacggtcggtccttaccgtacccgggntaaccggttcccggggtttaaccctaaaccggttacttaccgtagttcgggacctaggggttcccggggtacgttacggggacccttagttttcccgaaccgtttcccgtaaccgaacccttacgtaccgaagtccgtacggtaccgtacggacgtacggtacggtacgtaacggtagtacggtacggtacgttacggtttaacgtttacgttacgtacgtaacgtaactcgttaaaaaaaaaaaactttcgtttaaccgtttaccgtttaccgttacgttaccgtttaccgggtacgggtaaccgggtaaccggtaacggtacggtagtaacgttaacggtaaaccgtaacgttacggtacggtacgtacgtaccgtaccgtacgttaccgttacgttaccgttaccgttacccg

SEQ ID NO: 66351 - DNA, 824 bp, Homo sapiens
  misc_feature: GYAE6OF02HJQBU.31.78.H01.1.454.CMB.1.raw
  modified_base (412)..(412): a, c, t, g, unknown or other
  misc_feature (412)..(412): n is a, c, g, or t
  modified_base (542)..(542): a, c, t, g, unknown or other
  misc_feature (542)..(542): n is a, c, g, or t
tcagcagtagacgtcacgaccggtgctcgatttagtgtgagtagtttgggtttgggggagctacaacaggcaggcaggggcagcaagatggtgttgcagacccaggtcttctattctctgttgctctggtatctcgtggtcgccgtacggggacactcgtgatgagcctagtttccagtacctccgtggctgtgtctcgtggcgaggacggccacatcaactgcaaagtccacgcctaagtagttgtttttacgttcggcccccaaacgtaaactaacctaaacgtacgttaacgtcgttcggtaaccaggaccgtaaaggtaaaacggtaggaaccgccgtacccgttaacccgtaaaaccttccgtacgtaactttaccggtcggtccttaacccggtaaccccggggtntaacccgggttacccgggtttaccccgttaaaccggtattacccgttaaggttccggccgtaacggggtcccgggttcggtaccgggttaacccggttattccctaactcccgttaaccaccgttaaccncgtaacgcccggtacgtccgtttacggacgtaccggacgttaacgaaaggtggtgtacggttacgtagtttaactttcgacgttaccaacgtacctaaacttaagtttaacctttcggttaccttttaccgtacgtttaacccgggttccggtaagggggtacccggtaaacgggtaaacgggttaggtaccggttaacgtaaacccgtaaacggtaaacggtggttccggaaccgttcacccggttacttaacgttccgcggttttcctaacgttaccccg

SEQ ID NO: 66352 - DNA, 785 bp, Homo sapiens
  misc_feature: GYAE6OF02HAN5Y.31.78.H01.1.454.CMB.1.raw
  modified_base (721)..(721): a, c, t, g, unknown or other
  misc_feature (721)..(721): n is a, c, g, or t
  modified_base (762)..(762): a, c, t, g, unknown or other
  misc_feature (762)..(762): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactcccgtggctgtcgtctcgtgggcgagacgggccacagtcaacgtcactacgtccacgcacggtagtttgttttacgtccgacccaactaataacctaacttacgtacgtacgttcggtaaccacgacgtaaagtaaggtacgaccgaacgtccccgttaacctaaactccgtagttaaccgttacggtaggttcccgttacccggaccgggtacttacccgggttaccccggggttaacctaaaccggttctttaacgtacggttacggacgtacggggtccgggttaccgtacgggtaccgttacgtttacccgaccgtaccgtacccaaccggttacttaccgaacggtaccaaccggttcccaacggttacgggaaccgttagtaaaacgggaacgtttcggttaacggggtaccggttaccgttttaaagtttttacccgacggttaccgtacgtaacgttaaactaacgtttaactttacggtttacccgtttcgttccgtaacggttacgttccgggtaacggacgttaaccggtagnggtacctaagaacccggtaagtaggtggtcaccgtgaaccncttagtctttgtacctatccccg

SEQ ID NO: 66353 - DNA, 892 bp, Homo sapiens
  misc_feature: GYAE6OF02GR96Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacagtcggtgatggacgcctagtttccaagtaccctcccgtggctgtgtctcgtgggcgaggacgggccaacataccaaactcgacaacgtccagaccagtagttcgttttacgttccggaccccctaaacgtaaactaaaccgtaaccttaacttagtaccgtttacggaaccaaggactaaaggaaaaggttacggaacctaacggtaacccttaacccgttaaaaccgtcccgtaagttaaccttttaccgggtacggggtacccttttacccgggaaccccgggtaccgttaaacccgggtttccccggggggtttaacccctaaaaccggtttaccgttaccggttaacggtttacccggggacgaaccggggtcccggggtttaccggtacggggtaaaccccgttacttttacccgtaaccgttcctacccgaaactacgttaccgacgtaccgacggtcccgtaggtaccggacggtaccgtaaggacgttaacgttcgggtaacggtaacgtttaagttttaacgttacgtttacggtacctaacggtaacctaaactttaagtttaacgtttacttttaccggtttacttaccggtttaaccgggtttaccgggaccggggtaacggtaaacgggtacggttaggtacgttaaacgtaacggtaaacggtacggttcgccggtaactacggtaccgaaccgttgttaccgttagttccctacggttaacccg

SEQ ID NO: 66354 - DNA, 844 bp, Homo sapiens
  misc_feature: GYAE6OF02FKE0K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgcctacggggacatcgtgatgagccagtttccagacctccctggctgtgtcctcgtgggcgacggacgggccaacctactcaaaccgtggaccaacgtccagccagtagtttgtttttacgttccggaccccctaactaaactaacctaacttacttacgctttacggaccaagccaagtaaaggtacggacacgtacccgttaccctaaaaccttccgtagttaacttttaccgtcgggtctttacccgtaccccggggactaccggtttccccggggttaaccttaaacccggtattaccgtacgtttgggacccttaacgggtccggggtacccgttacgggggtaacccgttatttcccgaaccgttcctacccaacccgtacttaccgacgaccgtaccggtccgtcgtccggaagggtccgtaggaaacgtacgttacggggtagttccgtaaaggtttttacgttaccgttacggtacctaacgtaacctaaacgtttactttaaactttaccgtttttacctttaccgtttaccgtttaaccggttttccggggaaccggttaacggggtaaccggttaaacgggtcgtaacggtaaccgtaaccggtaaacccggttaacgttcgggttcgggtaacctccggtaacccttaccgtaacgtttaccggtacccgttttaccgttaccttaccccgg

SEQ ID NO: 66355 - DNA, 726 bp, Homo sapiens
  misc_feature: GYAE6OF02IO1WW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtgaccgtacggggacattccggtagatggagcctagtttccagcctcccgtggcttgtgtctcgtgggcgaggcgggccaccatccaatcgacaacggtccagccagtagtttgttttacgtcggacccccaacgaataaccaacttacttacgtcgttacggtaaccaggacaaggaaacggtaggaccacgtcccttacctaaacttccgtagtacgttttacggtcgggtaccttaccgggacccggtctaaccggttccgggttaaccctacggtacttcgagttcgggactacggtcggtacgtcgggaccttattccacgtctcaactcgtcacgtcgacgtccacgcgacggacgtagtaacgtggttcggacggttagtacgttttacttacgtacgtaccgtaccgtaacgtaatacgtttaacttacgttttccgtttacgttccgttaccggtttaccgggacgggtaacggtaacccgtaggggtacgtacggtaactaccggtaaacgtaccggttacggtacgtcggtaacggtacctaccgttacgttccggtacctttcgtacccttaccgg

SEQ ID NO: 66356 - DNA, 787 bp, Homo sapiens
  misc_feature: GYAE6OF02GEN3S.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtggcgaggacggccacactcaactgacaacgtccaagccagtacgttagttttacgttccggaccccaactaactaaaacctaaccttacttacgtacttacggtaaccagacctaaaggaaacggttaggaactacgtaccctaacctaaaacctccgtagtaactttaccggtcgggtaccttaccggtacccgggactacggttcccggggttaacctaaccggtactttacgtacgttcggccgtacggggtccgggttacggtacggggtaacccgtagttttacccgacttaccgtacaaccgtaattccgaacgtccaacggtccgtacggccgtaagggtaccgtaaggaaacgtacgttaggacggtaccgttaaagtttttaactacggttacgttaaccgacgttaacctaaagttaactttaacgtttaccttttacgtttacccgttacgttaccggtttacggggaaccggttaaacggggaacccgttaaagggttcgaaacgttacgtaaacgtaaacggtaccgtgggtaacgtcgtacgaccgtactaccggttctacggttactccgttaacccg

SEQ ID NO: 66357 - DNA, 726 bp, Homo sapiens
  misc_feature: GYAE6OF02H4BVG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggacgggcccaccatcaaactgaccaacgtccagccaaggtagttgttttacttccggaccccaacaaataaacaacttacttagtcttacggtaccacgcaagaaagtacggacacgcctaccttaaactcctagtacttacgtgggtcttaccgtacccggtacgtacgttcccggggttacctaaaccgtacttactacgttaggccgaaggtcgggttacgtacggggtaacccgtactttaccaccttactaccgaacctaactccgaacggtaccacggcccttaggaccgtagggtacctaaggaaacgtagttcgggtcggtaccgtttaaaggttttaactttacgtcgttaacgtaacgaccgtaaaaccttaagtttaacttaacccttttcgttttacggtaccttacggtttaccgggacgggtaaacgggtaaccgtaagggttacggagtaactaacggaaaacggttactgggtacgactacgaccacctgtacttcgtacttcctaaccg

SEQ ID NO: 66358 - DNA, 820 bp, Homo sapiens
  misc_feature: GYAE6OF02HOOFJ.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacagtcgtgatgagcctagttcagacctccgtggctgtgtctcgtgggcgaggacggcccacatacaacgtgacgaacgtccaagcctagtagttgtttacgttcggaccctaaccgtaaataaacctaacgttacttaacgtcgtttacggaacctagacaaggtaaacggacggtacaacgtacctaaccttaaacnccgtagtacttacgtcggtaccttaccgaccggctacggttaccgggttaccctaacggtattaccgtagttacggcgtaacgggtaccggggttaccgtacggggtaacccgttaagtttacccgtaccttaccgtaccgtaaccgtaacgtccgacgtaaccgtacgtacccgtacggacgaacggtaccgtaaggtaacgtagttaccggttacgtaccgtttaagtttaaccgtacgttaagtaaccggaattacgttaaaaccgttctttaacgtttaacccgtttcgttttaccgtaccgttttaacccggtaccggggttaaccgggtaaacggttaaaccgggtaagggttaaaccgggaggttaaaaccctaaccggtaaaacggtaccggttgttaaccgggtaaccgcgtaaacccgtccgtaacgttccgtttaaccgttaaccgttccgttaaccccg

SEQ ID NO: 66359 - DNA, 927 bp, Homo sapiens
  misc_feature: GYAE6OF02JSNK9.31.78.H01.1.454.CMB.1.raw
  modified_base (63)..(63): a, c, t, g, unknown or other
  misc_feature (63)..(63): n is a, c, g, or t
tcagcagtagacgtcacgaccggtgctcgatttagtgtgagtagttttggggtttgggggganctacaacaggcaggcagggggcagcaagatggttgttgcaagacccgaggtcttctatttctcttgttcgtctctggtactcttgttcgggtgcccggtaacgggggacctacttcggtagagtcggtacgtacccgttaacggttttacccaacggacccctttccccggtggtccgtttcgggttcggtttccgttgggtacggggtccggaacgggacccggggaccccaaccctaacttaccgtaaacgtcgaccgtaaccggtccacggaccgtaggtagtttcgtttttacgtccggacccctaacaactaaacctaacttatacgtacgttacggaacctagactaaacgggaaacggtacgaacctacgtccctaacccttaaacctcgttacgttaacgtttccgttcgggttacctacccggtacccggtaacgttacccgggttaaccccgggttaccgtttaaccgttacttaccgtaacggtttccggaccggtacggggttcccgggtttaccgggtaacgggttacccgtttaactttttcccgtaacgtttaccctcccggtaacacccgtaccgttacgacccgtacgaccgttacggacgggtacgtacggtacgaacggtttcgtacggttcggtactttaacgttacgttaaccgtcgttaacgtacgtacgtaaacttaacgttttctaaccgttttcccgtttacgttccggttaacggttcccgggtacgggtaacggtaacgttacgggtacgtacggtaaccgtaacgtaacggtacttacgggtaccgttcggaccgttacgtacccgtacgtccgtttattcctttaccgtaacccg

SEQ ID NO: 66360 - DNA, 860 bp, Homo sapiens
  misc_feature: GYAE6OF02HWHMH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggactatcgtagactgagcctagtttccagaccttcccgtggcttgtgttcgtcgtgggccgaggacgggcccaccgatccgaacttcgaccgtaacgtccgtaacgccctaaggtacgtttacgtttttacgtttaccgggaccccctaacgtaaaagtaaaccttaaaccgtaacgtttacgtaccgtttacgggtaaccccagtaccgtaaggaaacgggttaagaacccgacggttaacccttacccgttaaaaccgttccgttacggttacgttttaaccggtcgggttcccgttaccggttaaccccgggtccgtacgggtttaccccggggtttacccctaaaccggttacgtttgcggttaacggtcccgtaaggccggggttacgtacggggtacccgttagtttacccgtaacgtcgttacccgtaactacgtacccgaagtaccacggtcccgttacggccggtacggtaccgtaggaaaccgttaggtacggttacggtcgtttaaacggttttacgtttaacgtcgtacgacgtaacgaacgttatttaactttacccgtttactttaccgttaccgttacggttcggtaccggtaacgggaccgttaagggtcgaacgtacggtaaccgtaaaccggtacgtaacgtcgtaacggtccgaccgttacgtaccgttcgttacgttccgttacttacccg

SEQ ID NO: 66361 - DNA, 830 bp, Homo sapiens
  misc_feature: GYAE6OF02IL2TH.31.78.H01.1.454.CMB.1.raw
  modified_base (191)..(191): a, c, t, g, unknown or other
  misc_feature (191)..(191): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgcctctggattctctggtgcccgtacggggacatcgtagaatggacgacctagtttccagtacctccgnggtcgtggtctactcggtgggacgaagggacgggacccaaccatacaacgttgacgtaaccgtacccgacgacctaggttacggtttacgtttttaaccggttcccggaccccctaaccaaataacctaactaacttagtccgttacggtacagacgaagaagtaacgacactaccgtacctaaacttcctagtacgttacggcggtaccttaccgtaccggactaccggttcccgggttactaccgtatttacacggttcggacgtaggtccggggttaccgtacgggacccgttattaccgtacctcctacccgtaacctcgtacccgtaaggtcccaccgtacccgtacgacggtacggtaacgtagtaagtacgttacgggttcgtacgtttaacgttttacgtttaacgtacgtacctaggtaacttaacgttactttaaccggttttacctttccggttttaacccgtttaccgtttaccggggttaaccggggaacggttaaccgggtaaaccgtaggggttaaccgaacttaacggtaaccggtaaaaccggttaccggtacgggttacccggtaccgtacggacccgttaccgtaccgttaccgggtttcgttacccgttacctacccgg

SEQ ID NO: 66362 - DNA, 819 bp, Homo sapiens
  misc_feature: GYAE6OF02JMCER.31.78.H01.1.454.CMB.1.raw
  modified_base (198)..(198): a, c, t, g, unknown or other
  misc_feature (198)..(198): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtaggggacatcggtgatgacgcctagtttccagacctcctggcttgtcgacttcgnggcgaggtcggaccacataccaacgtgacaacgtccacgacgaggtacgtttacgttttacgtccggacccctaactaaactaaccttaaccgttaacgttacgttaccggttaacggtaaccgacgtacgtaaacggtaaacggtacgaccgtaccgttaacccttaaacccgttccccgaactttaccgttaccgtaaccgggtttggacccccttttaccggggaaccccgtcgttaacccggggttaccccgggttaaccttaaccccgggggtattaacccgtaacggtttcgaaaccggttcggggtacccggttacgggtaccggggtttaacccttacgggtttaacccctaacctttaccgaacccttaacccgtacgtaacctacggtacctaaccggtcccgtaggaaccccttgggtaaccgtagtaaacggttacggttaggtacgttacgttaaggtttactaacgggtctacaacgtactaacgttacgttaactttccttacgtttacctacgttaccggtacggacggttacgacggtaagttacggagtaccgaatcgtccgtaaggcttaggtcgacttgcctacgttacgtctagttaccc

SEQ ID NO: 66363 - DNA, 714 bp, Homo sapiens
  misc_feature: GYAE6OF02HN3KH.31.78.H01.1.454.CMB.1.raw
  modified_base (504)..(504): a, c, t, g, unknown or other
  misc_feature (504)..(504): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacagtcgtgatggagccgtagtttccagtacctccctgggctaggtgtcctcgtgggcgaggacggtcccaaccatcgaactgacaaggtccagccaaggtagttgtttttacgttccggaccccctaacgtaaataaccgtaaacttactttacggtaccgtttacgggtaaccaacgactaaaggtaaaaggtacggaaccacgtccctaacccgttaaaacctccgttacgtacgtttaacgtcgggtaccttccgtaacccggggtctaacggttccggggttacctaaccggtattcgtacgttcggcaggtccgggtagtcgggtactactttccgactctacgaacctntacgacgtaccacgtccgtcggcgtacggacgttaggaagtcgttaggcggtacgtagtttacgttacgtgtacagtacaagttacttacgttactttcgttacgtccttacggttccgggaacggtacggaacgtagggtacgagtaacgtacgtaaccgtacgttcggactacgcaccgtactcgtaccgtcgttacctcgttacccg

SEQ ID NO: 66364 - DNA, 758 bp, Homo sapiens
  misc_feature: GYAE6OF02JADR2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttctatttctctgttgctctggatctcgtggtgccgtacggggactatcgtgatgacgccagtttccagacctcccgtgctgtgtctcgtgggcgaggacggccaaccatacgaactgaccgagtaccgacgcagagtttgttttacgttccggaccccaactaataacctaactacttacgcgttcgtaccgagacaacggtaaagtacggaccaagtcccttaacctaacctccgtagtactttaccgtcgggtccttaccggacccggtccgtaacggttcccgggttacctaaccggtcgttacaagttcggacgacggggtccgggtcgtacgggaccgtcgtttccgactcccgtaaccaccgtaagtccgtaacgcccgtacggtaccgtcggaaccgacgggtacgtagtaaacggacgttacgggtacgtacgtttaaggttttaattaccgttggtaaaccctaagtaccggtaactttaacgtttaaccttacctttttacccgttacgtttaaccgtttcggttaaccgggtacgggtaacggtaaccgtagggtaaccggtataacgttaaccgaagtaccggtacggttacgtaccggtatcctaaccgtaccgttcgtacgttactacgttcccg

SEQ ID NO: 66365 - DNA, 762 bp, Homo sapiens
  misc_feature: GYAE6OF02IMZ1K.31.78.H01.1.454.CMB.1.raw
  modified_base (94)..(94): a, c, t, g, unknown or other
  misc_feature (94)..(94): n is a, c, g, or t
  modified_base (157)..(157): a, c, t, g, unknown or other
  misc_feature (157)..(157): n is a, c, g, or t
  modified_base (161)..(161): a, c, t, g, unknown or other
  misc_feature (161)..(161): n is a, c, g, or t
  modified_base (537)..(537): a, c, t, g, unknown or other
  misc_feature (537)..(537): n is a, c, g, or t
  modified_base (542)..(542): a, c, t, g, unknown or other
  misc_feature (542)..(542): n is a, c, g, or t
  modified_base (610)..(610): a, c, t, g, unknown or other
  misc_feature (610)..(610): n is a, c, g, or t
  modified_base (736)..(736): a, c, t, g, unknown or other
  misc_feature (736)..(736): n is a, c, g, or t
tcagcagtagacgtcacgaccggtgctcgatttagtgtgagtagtttgggtttgggggagctacaacaggcaggcaggggcagcaagactggtnttagcagacccaggtcttcatttctctgttgctctggatctcgtgtgtcctagggacattcgngtangaggccaggtttccagtcctccgtggctgtcgtctcgtacgggcgaggacggtcccaactacgtacaacgtgtaacaacggtccagcctagtaagtttcggttttaatcggacccctaactaaactaaacgtaaaccgttaagttacgtacgttacggtaacctaggtaaccgttaaggaaaacgttaaccggactaaccggtaacccttaccggttaaaaccttccgttaacgttaacgttaccggttagggttaccttaccggtaacccggtcttaaacgggttcccggttttaaccgaacgttacgttaacgtacgtcggtacacggtacggttcgtacggaccggttatttaccgacttctaccgacacgtntacgnacgctagtacacggtcgtaagagtgtacgttagacgttaacgtttacgtacgcgttaacgtaccgtanaacggttaccttaaagttaccctttacgttacttaccggttaccgttacgcccggtaaaggaacggttacgtaggaacgttacggacgtaaacgtacggtacgtacgaccgttagaccgtaacccnggttaaccttgggtcctaacctaacg

SEQ ID NO: 66366 - DNA, 807 bp, Homo sapiens
  misc_feature: GYAE6OF02HMPX1.31.78.H01.1.454.CMB.1.raw
  modified_base (249)..(249): a, c, t, g, unknown or other
  misc_feature (249)..(249): n is a, c, g, or t
tcagcagtagacgtcacgaccggtgctcgatttagtgtgagtagtttggggtttgggggagctacaacaggcaggcaggggcagcaagatggtgttgcagaccaggtcttcatttctctgttgctctggatctcgtggtcgccgtacggggacatcgtgatggacgctagtttccaagtcctcccgtggtcgttggtcgtcgtcgtgggacggacggacgggccaacctaagtacaaactggacctaanacccgagaccgtagttagtttacgtttttcgttccgaccccctaacctaaaataaacctaacgttacttagtccgttacggtaacacgagaaaggtaaaacggcggacacgaccctacctaaaccttccgtactacgtttacgtacggttacctccgtaacccgggctaccgttcccggggttaacccaacgttactaccgtaggttcggacgtacggtcgggtacggtacggggtaacctacgtttacctcgttaccctacggaactaccgtagacccgtctaacgcccgtaaggtccggaaggttacaacgggtaagttacgtaccggggtacgtacggttaacttttacgtcgttcgtaggaaacctactaaacgtttagtttaacctttacgttaccgtttccgttaccgttacgggtttccggaaacggggtacgggaaaccgttaaggggttcgaacgttaaacgtaacccggtaaacgtacggtttaccggtaccgccggttaaagtcccgtaacgtacgtttcccggttaactttcgttacccttaaccg

SEQ ID NO: 66367 - DNA, 729 bp, Homo sapiens
  misc_feature: GYAE6OF02F32IE.31.78.H01.1.454.CMB.1.raw
  modified_base (208)..(208): a, c, t, g, unknown or other
  misc_feature (208)..(208): n is a, c, g, or t
tcagcagtagacgtcacgaccggtgctcgatttagtgtgagtagtttgggtttgggggagctacaacaggcaggcaggggcagcaagatggtgttgcagacccgaggtcttcatttctcgtgttgctctggatctctggtcgccgtacggggacagtcgtgatgagcctagtttccagacctcccgtggctgtgtctcgtgggcgagnggccacgatcaacgtgcaacgtccagccagtagttgttttacttcggcccctaacaaagtaacaacttacgttagtacgttcggtaaccaaggcaaggtaaaggtacggacagtccctaactaaacctccgtagtactttacgtcgggtcctttaccggtaccccgggattaccggttacccggggtttaccctaaacggtctttcgagtttcggctacgggtcgggtcgtacgggaccttagttttccaacgttccctacaaccgtgtaccgaggtccgtacgtccgtagcccgtaaggtaccgtaggtaaaggtacgttcgggttacggtaccgtttaagtttacgttaccgttacggttaccgaacgtaccgtaaacttacgtttaacgttaccttttaccgtttaccgttacgttaccggtttccgggaccggtacgggtaaccggtagggtacgagtacgtaacggtaacgtacgtgtacggtctacgactactacgtctacggttctagttaccg

SEQ ID NO: 66368 - DNA, 734 bp, Homo sapiens
  misc_feature: GYAE6OF02HJOS6.31.78.H01.1.454.CMB.1.raw
  modified_base (467)..(467): a, c, t, g, unknown or other
  misc_feature (467)..(467): n is a, c, g, or t
  modified_base (491)..(491): a, c, t, g, unknown or other
  misc_feature (491)..(491): n is a, c, g, or t
tcagcagtagacgtcacgaccggtgctcgatttagtgtgagtagtttgggtttgggggagctacaacaggcaggcaggggcagcgaagatggtgttgcagacccaggtcttcatttctctgttgctctggatctacgtggtgccgtacggggacatcggtgatgacgtcctaggtttccagtacctcccgtggctgtgtctcgtgggcgagagggcccacagtcaactgacaacgtccagccaggtagttgttttacgttccggacccccaactaaataacctaaccttacgttaacgtcgtttacggtaccaggacaaggtaaaggtacggaactacggaccctacctaaacttcctaggtactttacggcgggtccttaccggtaccccgggcgtacggttcccggggttacctaaccgtacttctaggttcggccgacggtcgggtcggtaccgggtaaccgtntttccgtactccgtacaccgtacncacgaccgcgtccgtacgacggtcggacttaagggaacgtgttaggtcgggaccttaagtttccttaggtactccgaagtacctaacgttatttacttacctttcgtttacgtcgttaaccgttcggggtacgggtaaacggtaacggtacggtaaggacgtaacggtaaccgtaaagtacggtcggttacgaccgttacgacccgttaacgcgttaccgttcgtttaccgttaccttacccg

SEQ ID NO: 66369 - DNA, 716 bp, Homo sapiens
  misc_feature: GYAE6OF02F6XDY.31.78.H01.1.454.CMB.1.raw
  modified_base (325)..(325): a, c, t, g, unknown or other
  misc_feature (325)..(325): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagtgttttattcggccccaactaataacaactacttagcttaggtaccagcaagaaagtaggacagcctacctaaactccgtagtaactttaacgngggccttaccgtaacccggggactacgttacccggggttaccctaaccgtattcctagttcggaccgtacggtcgggttcgtacggggtacccgtattttcgaaccttcgttacaacccgataccaacgcgaacgtcctaggccgaagggtcctaggaaagtagtggttacggacgttaagtttaactttaccgtagtacgaacgtaactaaactaacgttttaagtaccttttaccgtttaccgttaacttacccgttttaccggggaccggtaacggggtaacccgtaaaggggttcgggactaacgttaacgtaaaaccggtaacgttacggtacggaccgtttacgacccgttaccaacgttccgttacggtttactaccgttaacc

SEQ ID NO: 66370 - DNA, 737 bp, Homo sapiens
  misc_feature: GYAE6OF02JQ9TX.31.78.H01.1.454.CMB.1.raw
  modified_base (153)..(153): a, c, t, g, unknown or other
  misc_feature (153)..(153): n is a, c, g, or t
  modified_base (577)..(577): a, c, t, g, unknown or other
  misc_feature (577)..(577): n is a, c, g, or t
  modified_base (729)..(729): a, c, t, g, unknown or other
  misc_feature (729)..(729): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacngtcgtgatggacgtcctagttccgagtaccttccgtggtctgtgtctcggtcgggcgacggacgggaccaaccatacaacgtacgacgtaacgtccagaccgtaagtacgtttacgttttacgttccggaccccaacctaaactaaacctaacgttaccgttacgtacggttacgtaaccgaagtacgtaaaggaaacgttacggaacgtaccgtaccctaacccgttaaactccgttacgtactttacggtaccgggttccttaccggtaacccggtctaccggtttacccgggttacctaacggtaactcgtacgtcggacgtacggtcgggtccgtacggtaactcgttctaccgtccgtacgaccttagtccgactcgtacgtctacgcgtaacgtcgtagtactagtggtacgtacgtnttacgtgtacgtacacgtactaaacttcgttaacgttctttacgtcgttaccgttacgggttacgtacggacgtaacgtaaggtacgtacgtacgtaacgaaaccggttagtacggtcgtaccgtgtacctcgtacgtcgttacgttacctnttacccgg

SEQ ID NO: 66371 - DNA, 823 bp, Homo sapiens
  misc_feature: GYAE6OF02JPEXQ.31.78.H01.1.454.CMB.1.raw
  modified_base (157)..(157): a, c, t, g, unknown or other
  misc_feature (157)..(157): n is a, c, g, or t
tcagcagtagacgtcacgaccggtgctcgatttagtgtgagtagtttgggtttggggggagctacaacaggcaggcagggcagcaagatggtgttgcagacccaggtcttcatttctctgttgctctggatctctggtgccgtacgggacatcgtgntgagtccagtttccagtacctccgtagtctgtgtcgtcgtgggcgaggacggtcccacgtatccaacgtgacgaacgtcccgagcccgtaagtggtttacgttttacgtccggaccccctaactaaactaacgtaccgttacttacggtaccttacggtaccaacggtactaaagtaaacggtacggacctacgttaccctaaccgttaaacctcgttaacgtaatttcggaccggtacttaccgggaccggtcctaacggttccccgggttaacctaaaccgtgttactacgttacggaccgtacggtacgggttcgtacgggaaccccttgtttacgaccttcgtacctacccgtagtcgtacgacccgtgtaccgtacgacggtaagtaccgtaaggtaacgttacgtaggtaccgttacgtttaactttacgttaacttcggtactaacggaactaaccgttaagttaccttacggtttaccgtttaccgttaaccggtttaccgtttacggggtaacgggttaaacggtacccgggtaaagggttaccgggaacgttaaccggtaaccgttaaaccggttaacgtttacggtaccgttaccggtacgttaacccggtaccgttacgttacccggtttagttaccgttacccgtttaaccgg

SEQ ID NO: 66372 - DNA, 730 bp, Homo sapiens
  misc_feature: GYAE6OF02I75L4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcggtgatgagcctagtttccagacctccctggctgtgtctcgtgggcgaggacgggccaccatacaactcgacaacgtccagccaagtagttgttttattccggaccccaaccaaataaaccaactacttagtcttacggacctagacaagaaagtaggacacgtccctacctaaacctcctgtactttacgtcgggtccttccgtacccgggcacggttcccgggttacctaaccgtattctagtggacgtaggcggtcgtcgggacctacttctactctcacctactcgagtccacgccgtgccgtaggtctaggaacgtgttacggtcgggtacgttaagttttaacgttacgttcggtaccgaacgtacctaaacgttaactttaacgtttacccttttcgttttaccggttaccgtttaccggtttaccggggaccgggtaacgggtaaaccggttagggtaacgggtaacgtacgttaacccggtaaaaccggttacggttacgggtaccggttaccgtacgtacccgtaacccgtagtttacccgtacggtttaccttctttaaccccgg

SEQ ID NO: 66373 - DNA, 805 bp, Homo sapiens
  misc_feature: GYAE6OF02F6OQR.31.78.H01.1.454.CMB.1.raw
  modified_base (202)..(202): a, c, t, g, unknown or other
  misc_feature (202)..(202): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacgggacattcgtgatcgagcctagtttccagtacctccctggctgtgtctcgtgggngagcggccaccatcaactgaccagtccagaccagtacgttgtttagttccgacccaacaataaccgaacctattactcgttaggtaaccagtacgaagaaaggtacgacgactaccctaccctaaaccgtcctagtacttacgtggtccgttccgtacccggctaccggttccgggttaccctaacggtactctacgtggcgacggtcggtcgtgggaaccttcgttacctaccgtctaccgacctacgtacgtacgactacgtccctggtaccgacgggtaccgtaaggtaggtacgttgggtaccggtacgtttaaagttttaacgttaccgtttaccggtaactacgtaacctaaaccgtttaacttacccgttttaacgtttttccgttttaacccgggtttacccttaacccggggttttacggggaaacccggggttaaaccgggttacccggtaaaggggggttttaacggaacggtttaaacccgtaacggttaaaaaccccggggttaccttacgggtaacccggttcgttaaccggtaacccggttaacccttagttaccccgttggttttacccgttaccccttaacccggg

SEQ ID NO: 66374 - DNA, 926 bp, Homo sapiens
  misc_feature: GYAE6OF02GZKBY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccacatcaactgacaagtccagccagagttgttttattcggccccaactaataacaactactagcttagtaccagacagaaagtagacagccctactaaactcctagtatttacgtgggtccttaccgtaccccgggactacgttcccggggtttaccctaaacccgtattactacgttcggcacggtcgggtcgtacggggtaccgtactttccgacctccgtacctaacctactaccgtaacgctaacggtccctggaccgtaacgggtacccgttaaggaaacggttaacgttcggggttacgggtacccgtttaaagggtttttaaaccgttttaccgttacgggttaaccgaaaccggttaaaacccttaaaacccggtttaaacttttttaaaacccgttttacccggtttttttacccggttttttaacccggtttaaccccgtttttaaacccggggtttttacccgggggttaaacccgggggggtaaacccgggggttaaaacccgggttaaaaccggggggtttaggggtaaacccgtttaaaccggggttttaaaaacccgtaaaaaaccccgggggtttaaccggtttaaccggggggtttaaccggggtaccccgtttaaaccgggtaaacccccgttaaccccgggtttaaacttttaacccccgggtttaccggtttttaacccgttttaaccccgttaacccccgg

SEQ ID NO: 66375 - DNA, 805 bp, Homo sapiens
  misc_feature: GYAE6OF02IIGU6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttctatttctctgttgctctggatctcgtgtcgccgtacgggacattcgtgatgagacctagtttcccagtacctccgtggtctgtgtctcgtggcgagacggccctacatacaactgacaagtccagccaagtagttagttttacgttaccggcccctaaacctaaactaacgtaaacgttacttaacgtacgttacggtaacccaagtacaaacggaaagtaacggacacgtacctaccctaaactccgtattattacgtggtaccttacgtacccgggctaacgttcccgggtaaccctaacgtattactagttcggacgtaggtccggtcgttaggaaacccgttatttacctaccgtacaccgtaacctaacgtacgacgtaccacgtacccgtacgcgtaacggtacctaaggtaaagtgtacgggtacgtacgtttaaggtttaacgtttacgtaccggttaatacggaaacctaaacgtttaactttaaaccgttttaccgttttaccgtttaccgttaaccgtttaccggtttacccggggtaacgggtaaaccggttaaacgggtaacggggttaccgggtaacgtaacgttaaaaccggtaaacggttaacgttaccgggtaacggttcctaaacgggaccctaaccgttacgttacgtttcccgtttaccgttacttaaccccgg

SEQ ID NO: 66376 - DNA, 682 bp, Homo sapiens
  misc_feature: GYAE6OF02HK86J.31.78.H01.1.454.CMB.1.raw
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (413)..(413): a, c, t, g, unknown or other
  misc_feature (413)..(413): n is a, c, g, or t
tcagcagtagacgtcacgaccggtgctcgatttagtgtgagtagtttgggtttgggggagctacaacaggcaggcagggcagcaagatggtgttgcagacccaggtcttcattctctgttgctctggatctctggtgccgtacggggacatcgtgatgagccagtttccagacctcctggctgtgtctcgtgggnaggaggccaccatcaactgcaagtccagcagngttntttatcgcccacaataacaactattagnttacggtacagcaagaaagtaggacagtcccgtactaactcctgactttacgnggtcctactacccgggntacgtcccgggttaccaacggtattcgaagttcggcaaggcggtacgtcgggaacctgtttacgacttcctacctaccacgtanacgtcgaacgcccgttagcccgtaacgggcttacggtaaacggagttcgtaccgggtacgttacgtttaaacgtttcgtacgttccgtaacgtaccaaacgttacgtttaactaccgttttcgttttaccggccttttaacgttcggggtaaaccgggcggtaaacgaccgggttaagggacgtacgtaaccgttaaaccgggctttggggaccgtttcgaccgtaccgttaacacgtttaccctcggtttaccgtactttaaccccgg

SEQ ID NO: 66377 - DNA, 696 bp, Homo sapiens
  misc_feature: GYAE6OF02G0N8Y.31.78.H01.1.454.CMB.1.raw
  modified_base (234)..(234): a, c, t, g, unknown or other
  misc_feature (234)..(234): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcccgtggctgtgtctcgtgggcgaggacggccaccatcaactgacaagtccagccagngttgttttagttcgaccccacaataacaactacttagtcttaggtaccagcaaggaaagtaggacagcctacctaactcctagtattacgnggtccttcgtacccgggntacggtcccgggttacctaacgtattcagttcggactacggtccgggtgtcgggtaccgtagtttccacgttactccaacctactacgacnccgaacgtcctaggacgacgggtcgttaaggaacgtagttcggttaggtacgtttaagtttacgttacgttacggtaccaacggtacctaaacttatttaacttacctttccgttttaccgttaccgttaccggtttaccgggtacggggtaacggtaccgtaagggtacgtaaggttacgtaaccggaaacggttaaccgttgggtaccggtaccttaccggacctacccgtattcccgtttagttacccttacttacccg

SEQ ID NO: 66378 - DNA, 751 bp, Homo sapiens
  misc_feature: GYAE6OF02H5ZGM.31.78.H01.1.454.CMB.1.raw
  modified_base (157)..(157): a, c, t, g, unknown or other
  misc_feature (157)..(157): n is a, c, g, or t
tcagcagtagacgtcacgaccggtgctcgatttagtgtgagtagtttgggtttgggggagctacaacaggcaggcaggggcagcaagatggtgttgcggacccaggtcttcatttctctgttgctctggatctctggtgccgtacggggacagtcgngatgagcctagtttccagacctccctggctgtgtctcgtgggcgaggacgggccaccatcaactgacacgtccacgaccagtagttgttttattccggccctaactaactaacaactacttagtccgttaggtaccagacaagaaggtagacacgaccctactaaacctctagtacgtttacgcggttaccttccgacccgggtactacgggttccccggggttaccttaaccgggtacttcgaacgttcggacgtacgggtcgggttcgtacgggaacccgtttatttaccgaaccttccgttaaccaccgtactccgtaagcctaacggtcctaggtaccgtaacggtaccgtaggtaaacggtacgttcgggtacgttaccgtttaaggttttaactcggttagttcgaacgaacctaaacgttatttaactttaccgtttaccgtttccgtacgttacgggttaccgggagggtaacccgggtaacgtaaacgggtcgttaactaacgttaccgtaaaacgtcgggttaccgtcggtaacgtcaccgtaacttcggttaccttacggtttactccgttaaccttccccgg

SEQ ID NO: 66379 - DNA, 621 bp, Homo sapiens
  misc_feature: GYAE6OF02IM21W.31.78.H01.1.454.CMB.1.raw
  modified_base (487)..(487): a, c, t, g, unknown or other
  misc_feature (487)..(487): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagagttgtttattcggcccccaacaataacaactacttagacttggtaaccagacaagaaacggtagacagaccctacctaaactcctgtaatttaccgtgggccttcgtaccccgggctacgttcccggggttaccctaacgtattcagttcggacgtacggtcgggtctagggacccgtatttcacttctccacatcgacgcacgcctgcgacgcgtagaaagtgtggtgacttagtttacttacgtcgtacgaanacgtaactaatttacttaccgtttctttacgtacttacggttcggtacgggacggtaaccgtaagggtcggaacgtactaccgaaacgtacgttggtcggacgtgtaccacgtcttacgtctaccgttataccg

SEQ ID NO: 66380 - DNA, 846 bp, Homo sapiens
  misc_feature: GYAE6OF02JYKPH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctgtggtcgccgtacggggacagtcgtgatgcgcctagtttaccagcctcctggctgtgtctcgtgggacgaggcggccaccatcaactgactaacgccacgaccaagaggttgtttttaacgttcggaccccaacctaaataaccaacttaccttaggctttacggaccaaggcaaaggtaagtaggacgacacccttacctaaactcctagtaattttacgtcgggacctttccgaacccgggtctacggtttaccccggggttcctaaaacccggtcttttaacgacgtttacggccgaacgggtccggggttacggtaaacggggggtaccccgtttactttctaaccgggtctttaaccctaccctaaggtcgaccgttacccaaggggttcccctaaagggaccccgtttgggaccgggtttaaacgtacggtttacggttacggggttacggtttaaccgtttaaggttttaaccttaaccgtacgttaacgtaacgtaaccctttaaacttttaactttacgggtttttaccctttacggtttacccggttacggttacccggttacggggaaccgggttacggtaaaccgggtaaggtaacggttaactaacggttaaccgaaaccggtttagggttcggtaccggttaccctaagttacctaaccggttatttacccggttaacgtttaccgtccctttaaccgg

SEQ ID NO: 66381 - DNA, 816 bp, Homo sapiens
  misc_feature: GYAE6OF02HEJNW.31.78.H01.1.454.CMB.1.raw
  modified_base (207)..(207): a, c, t, g, unknown or other
  misc_feature (207)..(207): n is a, c, g, or t
  modified_base (709)..(709): a, c, t, g, unknown or other
  misc_feature (709)..(709): n is a, c, g, or t
tcagcagtagacgtcacgaccggtgctcgatttagtgtgagtagtttgggtttgggggagctaacaacaggcaggcagggcagcaagatgtgttgcagacccaggtcttcatttctctgttgctctgatcttctggtgacccgtacgggacaagttcggtgatagacgccgtagtttccacggacctccgtcggtctgtgtcgtcgngggcgaaggacggcctaaccgattaccaacgtcgactaaacgttccgacgaccgtaggtacggtttagtttttacgttccggacccccaaactaaactaaacgtaacctttaacgttagtcgtacggttaccagacgaaagtaaacggtacgactaccgtccttaacccgtaaactccgttatacgttttacgttacggtccgttcccgtaccggggcctaaccggttcccggggtttaaccctaaccgtacgtttactacgggttcggccgttaacgggccgggttacggttaccggggtaaacccggttaccttttacgaacccttacctaccgaacccgttacttaccgacgtacccgcgttaccgtcggacgtacggtacgtaacgtaggtacgttggtacgttaccgttaagtttacttaccggttagttaccaacggtctaaacttagtttaacgtttccgtttacgttacccttaccggttacgttacccggggnggtaaccggtaacggtacgggtaagacgttaacgtaacgtaaacggtaacgttcgggtaacgtcgaccgtaccgtacgtaccgtaccgttaccgttctaccgttccc

SEQ ID NO: 66382 - DNA, 615 bp, Homo sapiens
  misc_feature: GYAE6OF02I1UE7.31.78.H01.1.454.CMB.1.raw
  modified_base (377)..(377): a, c, t, g, unknown or other
  misc_feature (377)..(377): n is a, c, g, or t
  modified_base (477)..(477): a, c, t, g, unknown or other
  misc_feature (477)..(477): n is a, c, g, or t
  modified_base (495)..(495): a, c, t, g, unknown or other
  misc_feature (495)..(495): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgaggacgggccaccatacaactgacaacgtccagccaagtagttgtttttacttcggccccaaccaaactaacaaacctacttagcttaggtaccagcaagaaagtaggacacgcctacctaaacctcctgtactttacgtgggtcttccgtaccgggctacgtccggggttacctaaccgnttacgagttcggcgtacggcgggtcgtcggggaccgttacgtttacactctccacctactcgacgcacgtcctcgccgaggcgtagaagatgggtacgtnttagtttattagtctacncgactaactattactactttctttcgtacttacggttcgacgggtacgtacggaaggtaggtagacgtaccgaaacgtcgtaggtgtacgtcgactcgtacttcgttacgtccttctacc

SEQ ID NO: 66383 - DNA, 944 bp, Homo sapiens
  misc_feature: GYAE6OF02HI1QR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgttacggggacatcgtgatggacgcctagtttccagacctcccgtgggtcctggtcgtacttcgtgggacgtaggacgggtacccaaccgtataccaaacgttcggactaaacgtcccgaggacccgtaaggttacgtttggttttttaaccgttccggacccccctaaaacgtaaattaaacccgtaaccgtttaacgtttacggccgttttacgggaaaccagaaccgtaaaggtaaacggttacggacctacgtaccccgttaaccttaaaccttccgttaggtaaccttttccggtacgggtacctttaccccggtaacccggcgttaaccggttccccggggtttaacctaaaccgtgtttaccaggtttccggaccgtacgggttccgggtaccgtacggggtaaccttacgtttacgtacccgttacctcccgtaaaccgtcgtaccgtaagggtccctaaccgggtccgtacgtaccggaccggttacgtaacggtaacgtacggttacgggttaccggttaacgtttaacggttttaacggtttacccgtacgttaaccgtacgttaaacccgtaaacgttttacgtttaacccgtttaccgtttttacccggttttaccggtttaccgttaaccgggtttccggggtaaccggtaaacgggttaacccgtaaggggttaccgtacgttaaccgtaaccggttaaaccggtggttaccggttaccggtaccgttaccggtaaccgttaacgttcccgtttacggtttaccgttacctttacgttacccccgg

SEQ ID NO: 66384 - DNA, 885 bp, Homo sapiens
  misc_feature: GYAE6OF02IHG99.31.78.H01.1.454.CMB.1.raw
  modified_base (139)..(139): a, c, t, g, unknown or other
  misc_feature (139)..(139): n is a, c, g, or t
  modified_base (504)..(504): a, c, t, g, unknown or other
  misc_feature (504)..(504): n is a, c, g, or t
tcagcagtagacgtcacgaccggtgctcgatttagtgtgagtagtttgggttgggggagctacaacaggcaggcaggggcagcaagatggtgttgcacgaccaggtcttcatttctctgttgctctggatctctggtcnccgtacggggacagtcgtagatgagcctagtttacccacgtacccgtcccgtggtaccttgtcgtccttcggtacggggaccggaagggaccgggtaccccaaccgtaacgttacctaaaccgtcgacctaaaaccggtccaaccggtaccggtaaggttaagttttacggttttttaaccgttccgggaacccccccctaaacgttaaaactaaacccgtaaacctttaacggtttaacggtccgttttacggaacccgtagaaccgtaaaggtaaaacggtacggaccaccgtaaccccttacccgtaaaaccttccgtaacggttaacttcggtcggtacccttacccgggtaaccccgggngttaaccccgggttacccggggttaccctaaccgttacttccgtaggttcggacctacggggtccgggttacgtaccggggttaaccttaccgtttacgacccgtttactacccacccgtagtacctacggtacgtaccgtacgtacggacgtacggcgtaggtaacgtgtacggtacgtcgttaagtttacgtactacgtacacgtactaaccttaacttaccgttacttttaccgtttaccgttacgttaccggttaccgggtaacgggtacggtaacggtaacgggtacggtaacggtacttaaccggaaacgttaaccggtcgtaaccgggtcgtacggtaccaccgttacgtacctcggttaccttcccttaaccg

SEQ ID NO: 66385 - DNA, 665 bp, Homo sapiens
  misc_feature: GYAE6OF02JKUGX.31.78.H01.1.454.CMB.1.raw
  modified_base (247)..(247): a, c, t, g, unknown or other
  misc_feature (247)..(247): n is a, c, g, or t
  modified_base (363)..(363): a, c, t, g, unknown or other
  misc_feature (363)..(363): n is a, c, g, or t
  modified_base (479)..(479): a, c, t, g, unknown or other
  misc_feature (479)..(479): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggacctggtcgtctacgtcgggcgaggagggcccaccgtatacgaactcgcaacgtccagccagngttacgttttattccggaccctaccaataaccactacttagccgtcgtaccagacagaaagtaggacagtccctacctaaactcctagtactttacgtgggtaccttccgaccggntacggttccgggtacctaacgtactctagtcggcgacggtcggtcgtcggaaccgtcttctactacctccactacgtactacggctacggtcctacgtacgacggtctaagtacgngttcggcggtacgttaggtttatacgttacgtagacgtactaagtattaccgttactttacgttaccgttagttacccggttcggtaaccgggaggtaaaccgtggtaacggtacgagttaacccgaacgggttactggtaacgaccgtacggacctacggtactctacggttcctacgttacccg

SEQ ID NO: 66386 - DNA, 812 bp, Homo sapiens
  misc_feature: GYAE6OF02IEFFS.31.78.H01.1.454.CMB.1.raw
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
tcagcagtagacgtcacgaccggtgctcgatttagtgtgagtagtttgggttgggggagctacaacaggcaggcaggggcagcaagatggtgttagcagacccaggtcttcatttctctgttgctctggatctntggtnccgtacgggacagtcgtagatgagcctagtttaccagacctccgtggcgtgtgtcgtcgtcgggacgaggacgggcccaccgatacaactcgaccaacgtccacgaccgtagtagtttacgttttacgttaccggacccccctaaaactaaacttaaacctaaaacctttacgttaacgtcgttttaccgggtaaccaagtaaccgaaagtaaaacggttagggaactaccggaccttaccccttaaaaccgttaccgttacgttaacgttttaccggtccgggttaccttaccgggtaccccgggtcgtaaccggttccccgggggtttaaccctaacccgggttaacttaccttacggttaggcctacggggtacgggtccgtacggggtaacccgttcttcctaccgtcctaaccacctactacgacgtacgaccgtacctcgccgtaacggacgttaaggagtacgtacggtgtacgttaagttttacgtaccgtgtaccctagtaccaaacgtttcgttaactttaccgttctttaccggtaacgtttaccggttaccggggaacggtaccgggtaacggtaagtcgggtaacgtaacgtaacgtaaaccggtacgttacggtcggactaccggacctacgttacctagttccttacgttccctaccg

SEQ ID NO: 66387 - DNA, 678 bp, Homo sapiens
  misc_feature: GYAE6OF02JJOFI.31.78.H01.1.454.CMB.1.raw
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacggccaccatcaactgcaacgtccagccagtagttgttttagttcggcccctaacaaataacaacttacttagcttggtaccagacagaaagtaggacagcctactaaactcctagtactttacgtgggtccttcgtacccgggntacgttccggggttacctaacgtacttcattcggcaggtcgggttcgtacgggtaacctagttttccacgttccgtaccaaccctacgtccgaagccaacggccctacggacgacgggtcttaggaaagtacgtcggtacggtattaacggttttacgttacctacgtacctaacgtacctaaacttagtttaactttaaccgtttccgttttacgaccgttaccggtttccgggaacgggtaacggtaaccgtagggttacgagtactaccggaaacgtacgtaggtcgacttacgacctacgtaccgttcgtacgtttccgtacttaccg

SEQ ID NO: 66388 - DNA, 788 bp, Homo sapiens
  misc_feature: GYAE6OF02F33DS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcccgtacggggacatcggtgatgacgcctagtttcccagtacctccctggctgtgtctcgtgggcgagacgggccaccatacaactgacaacgtccagccagtagttgttttattccggccccaacaataactaactactagcttggaccagactaagaaagtagacacgtcctacctaaactcctagtattcgtcggtccttaccgacccggctacggttcccggggttaccctaacgtcttactacgttcggaccgtagggtccgggttacgtaccggggtacccttagttttcccgaaccttccgtaccaaaccctagttaccgaacgtccggaaccgtccgtccggaacgtacgggtactaagggtaaacgtacgtgggtaccggttaacgtttaaacggttttacgttacgttacgttaccgaaccggttaaactaaaccgtttaagttttaacctttacccgtttttaccgtttaccgttacccggtttaaccggttttacccggggaacggggtaaaccggttaaccggtaaggggttacgggtaccgtaaacgtaaccgttaaaaccggtacgttacgggtacggttcccgtaacgggtccctaacgttaacttcccggttatttcccgttacttccccgg

SEQ ID NO: 66389 - DNA, 815 bp, Homo sapiens
  misc_feature: GYAE6OF02FVHN0.31.78.H01.1.454.CMB.1.raw
  modified_base (250)..(250): a, c, t, g, unknown or other
  misc_feature (250)..(250): n is a, c, g, or t
  modified_base (295)..(295): a, c, t, g, unknown or other
  misc_feature (295)..(295): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtagatgagccgtagtttccagtacctccgtcggcgttgtgtctcgtgggcgaggacgggaccacatacactgacaagtccagccagtagttntttacgttccgccccaacaactaacaactagtacgcttgtaaccngacgaagtaaaggtaacgacgacgtaccgtacctaactccgtagttaacgttaccgtcggtctttaccggtaccgtacgtacggtttcccgggttacccttaaacggacttacgtacggtacggtcacggggttacggttccggttacggtaccgttacgtttaccgaccttaaccgtactaccgtactcgtaaccgacgtaccgacgtacgtaccgtaggtaccgtaaacggaagttaacggttcgggtaacgggtactttaacgtttaacgtttacggttacgttaaccgttaaacggtaacctttaaacctttaaacgttttaacctttaaccgttttttaccgtttacggtttaaccgttttacccgggttacggggtaaaccggggtaaacggttaaacggtacgggtaaccggtacgtaaaaccggtaccgtaaaccggttacgggtacggtacggtacggtaacccgtacgaccccggttaacttccgtttacgttaccttaccgttaccccg

SEQ ID NO: 66390 - DNA, 720 bp, Homo sapiens
  misc_feature: GYAE6OF02F1NM1.31.78.H01.1.454.CMB.1.raw
  modified_base (616)..(616): a, c, t, g, unknown or other
  misc_feature (616)..(616): n is a, c, g, or t
  modified_base (678)..(678): a, c, t, g, unknown or other
  misc_feature (678)..(678): n is a, c, g, or t
  modified_base (716)..(716): a, c, t, g, unknown or other
  misc_feature (716)..(716): n is a, c, g, or t
tcagcagtagacgtcacgaccggtgctcgatttagtgtgagtagtttgggtttgggggagctacaacaggcaggcaggggcagcaagagtggtgttgcagacccaggtcttcatttctctgttgctcgtcggagtctctggtgcctacggggactagtcggtgagtgtacgcctagtttccagacctcccgtggcttcgtgtcctcgtggacgagacggccacactcaacgtgaccaagtcctagacctaggtagttcgttttaacttccgggaaccccaacgtaacgttaaaccaacttacgtagtaccgttaacggtaaccgacgtacgaacggtaaaagttcggaactaacggtaccctaaccggtaaaaccttccgttacgtaaccgttttaaccgcgggtacctttaccgtaacccggggtactaccgtttacccggggttaacctacccgtatacgttcgtacggtaccgacgggtcggtccgttacggggaccttaggtttccacgttaccacctaaccgtagtccgaacgtccgtacggtcctacgtcggaacggtctaaggaaccgtagttaccgaggttaccgttagttaactaggtcgaccgtancgttaactagttacctacgtttacctcgttacgtaccgtgggtacgaacgtacgagtcgagntacgaacgattggacgtcagccgactctacgtgttacntccg

SEQ ID NO: 66391 - DNA, 717 bp, Homo sapiens
  misc_feature: GYAE6OF02FOJ63.31.78.H01.1.454.CMB.1.raw
  modified_base (226)..(226): a, c, t, g, unknown or other
  misc_feature (226)..(226): n is a, c, g, or t
  modified_base (476)..(476): a, c, t, g, unknown or other
  misc_feature (476)..(476): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcggtgatgacgccctacgttttccagtacctccccgtggtctgtgtctcgtgggcgagacgggccaccatcacngctaagtccacgacctagtagttcgttttagttccggaccccaacctaaactaaacctaaactaacgttagcgttaggtaccagtacaagtaaacggtaggacagtccctacctaaactccgtagtacttacgtaggtccttcgtacccgggctacggttcccgggttacctaaccggtacttctagttcggcgaggtcgggtacgtcgggtacccgtagtttcacttcctaccaacctctacgacgtcncgtactcgcctacgggtacgtagaagtaggttggtaagggtacttaacggttttaaactttaccgttacgtacgtaacggtacctaacgttaatttaccgttaacttttcgtttaccgttcccttaacggtttaccgggacgggtacggtaaacggtagggtaggtacgaacgtacgtaaacggtattcggtacggtacgtacggtacctaccgtacgtcgttacgttacctacgttaccg

SEQ ID NO: 66392 - DNA, 875 bp, Homo sapiens
  misc_feature: GYAE6OF02HRS87.31.78.H01.1.454.CMB.1.raw
  modified_base (151)..(151): a, c, t, g, unknown or other
  misc_feature (151)..(151): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggganatcgtgatgacgctacgtttccacgtacctccctggtctgtcgtctcgtgggacgacggacgggacccacctactacgtaactggcgtaaacgtccgacgaccgtagtaagtttcgtttttacgtttaccggacccctaaccgtaaataaaccaacttacgttacgtacttacgggtaaccagacgaacgtaaaggtacggaacaccgtaccctaccttaaaccgtctacgttaacgttaccggtcggtcctttaccggtaacccggtaccgtacgggttaacccccggggttttaaccctaaaccggttacgttaccttaacggttacgggtaccgtaaccgggtccggggggtttaaccgtccggggggttaaacccgtttaaccggttttaccctaaccggttccctttaacccgaaaccccttacgttaccgaaccggtaccgtaacggtcccgttacggaccggttaggtacccgtaaggttaagtacgggttacggtacgttaccttaagtttaccgttacgtacgtaccgaacgtacctaacgttaactttaccgtttaacgtttcctttccgttaccgttcgggttacccgggtaccgggtaacgggaaaccgttagggtacggtacggtaacctaaacggtaaccggtacgttacggttacggacctaccgaaccgttacgtacgtttaccgttaggttacccttacgttacccg

SEQ ID NO: 66393 - DNA, 869 bp, Homo sapiens
  misc_feature: GYAE6OF02G93OP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagtttccagacctccctggcctgtgtctcgtgggcgaggacggccaccataccaactggaccaacgtccacgacccgaaggtacgtttgttttacttccggacccccaacgtaaactaaaccgtaacttaacgttacgtccgtttacggtaaccaagtacaaggaaaggtacggaccacgtacccttacctaaaccgtcctacggttaactttaccggtggtacctttaccggtaccccgggtacgtaccggttacccggggttaccctaacccgtatttaccgacgtttacgggcgtaacggggtccgggttaccgttacggggaaacccgtacgttttacgaaccttccgtaacgtaaccctaatacgtaacgacccggtaatccccgtaggtaccgacggggtacctaaaggtaaccggtggtacgggtacggtacctttaagttttaacgtttacggttaccgaacgttaacgacccttaaacgttaaccgttttaacgttaacccttttaccggttttacccgttaaccgtttcccgggtttaccggggtaacggggtaaaccggttaaccgggtaaacggggttacgggaaacgttaaccggtaaaccgtaaacgggttaaccgttagggtaccggttaccggtacgtacccggaccttaacccgtagttttacccttaccggttacccttacccgg

SEQ ID NO: 66394 - DNA, 796 bp, Homo sapiens
  misc_feature: GYAE6OF02I7RNB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagagggccacatcaactgacaagtccagtccagtagttagttttagttaccggacccccaacctaaataaacctaaccttaaccttagtaccgtttacggtacccaagacctaaaggtaaaacggtaacggacaacggtcccttaaccttaaacttcccgtagtacgttttacggtcggtaccttaccggtacccgggtacgtacgttccccggggtttacctaaccgtacgttactacggttacggcgtacgggtcgggtaccgttacggggaacccgttcgttttaccgaccttccgttaccacccgtataccgtaacgaccgtacgtccctaggaccgaacggtaccgtagggtaaacgtaacgtggttacggtaacgtttaagtttaaccgttacgtacgtaccgacgtaacctaaacgttaactttaacgtttaccctttacgttttaccgttaccgttaccgggtttaccgggtacgggtaaaccgggtaacgtaacgggttacggtaagtaaccgtaacgaaaccgttaacgtacggtacggtacgaccgtaacgtaccgtacgttacgtcgttaccttacgttaacccg

SEQ ID NO: 66395 - DNA, 741 bp, Homo sapiens
  misc_feature: GYAE6OF02HR3Y1.31.78.H01.1.454.CMB.1.raw
  modified_base (327)..(327): a, c, t, g, unknown or other
  misc_feature (327)..(327): n is a, c, g, or t
  modified_base (422)..(422): a, c, t, g, unknown or other
  misc_feature (422)..(422): n is a, c, g, or t
  modified_base (703)..(703): a, c, t, g, unknown or other
  misc_feature (703)..(703): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcggtgactgagcctagtttccagacctcccgtggctgtgtctcggtgggcgaggacggcccaccatacaactgacaacgtccacgcagtagtttagttttacgtccggaccccctaacaaacttaactaaccttacttagcttacggtaaccagacaaggaaacggtacgaacncgtaccctaacctaacgttccttagtacgtttaaccgtgggtcccttacccggtacccgggtctaccgggttccccgggtttaccgaaaccgttnttccgtaagttcgggcagggtccgggtcgtcggggtaaccttcgtttccgaccttcgtacccacctacgtcgacgacctacgtccgttacgaccgtacggacgttaaggtaacgttagtccgggttaggtacctttaaagggttttctttaccgtagttacacgtactaaacgttacttttacttaccgttttacgtttcgtacctttaccgggtcgggtacgggtacggtaaccgtagggttacggacttaacgaaccggaaagtccggttacggtgtcnccggacttacgtccgttcttacggttccttacgtcccg

SEQ ID NO: 66396 - DNA, 943 bp, Homo sapiens
  misc_feature: GYAE6OF02F89SN.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtgccgtacggggacagtcgtgatcgacgcctacgtttccagtacctccctggctggtcgtcgtcgtgggacgaggacggaccaacctcgtacctaacgttcggaccgtaacgtcccaacggacctaaggtacgttttagttttacgttccggtaaccccctaaccgtaaacttaaaccgaaacgttaaccgttacggtccgttttacggaacccgtacggtacgtaaacggtaaaaggtacgggaacctaacggtacccctaaaccgttaaaccctcgttaacgtacgttttaccggacgggtacctttacccggtacccggggactaccgggttacccggggtttaccctaacggtacgtttcgtaagttcggtaccgaacgggtccgggtaccggtaacgggtacccgttaacgttttccaaaccgttccgttaacccgaacctacgtaccgtacggaccgtaccgtaccgtcggtacgtaaccgggtacttaagggaaactttcggtacggtaccgggttaactttacggtttaaacgtttccggtaaccgttaactacccggttaaacgttaaaccttttaacggttttaacccgttttacccttttaccggttttaaccgggttacccggtttaccgggtttaacccgggggtaaaccgggtaacccgggttaaacggtaacggggttacgtaacctaaccggtaaaccggtaaaaccccggttgttacgggtacggtaacccgttacggttacccggtaacttaccgtttccgttaacggtttacccttacgttaccccgg

SEQ ID NO: 66397 - DNA, 763 bp, Homo sapiens
  misc_feature: GYAE6OF02HYQ8X.31.78.H01.1.454.CMB.1.raw
  modified_base (131)..(131): a, c, t, g, unknown or other
  misc_feature (131)..(131): n is a, c, g, or t
  modified_base (462)..(462): a, c, t, g, unknown or other
  misc_feature (462)..(462): n is a, c, g, or t
tcagcagtagacgtcacgaccggtgctcgatttagtgtgagtagtttgggtttgggggagctacaacaggcaggcaggggcagcaagatggtgttgcagacccaggtcttcatttcgtcttgttcgcttcncggtactctcgtggtcgtcccgtacggggacacgtcgtgtatggacgtacctacgtttccaagtccttcccgtggcttcggttcgtccgtcgtcgggacggacggacggcccgtaacctataccgaaacgttggaacctaacgtaccgacgtaccgaggttaagtttcgtttttacggttaccgacccaactaaactaaccaaccgttacgttaacgccgttagtaccagtactaaggaagtacgacacgtaccctaactaaccgtctaagtacgttcgcgtctaccgtaccgctacggttcccggtactaaccgtctacgtgtacggcgnggtacggtcgtacggacgttactttcacccttcgtaccaaccgtcttacaaccgtcgttaacggtaccctggtacggaacggtacgtaaacgggttaactcgggttacggtaccgggttagttaacgttttcggttaaccgtcgtacggttaactaccgtaacttagtttaacctttaccgttttccgtacctaccgttacgttccggacgggtacggtaaacggtgtacggtacgtactaacggaaacgtccggtagtccgcgtaactccgtaagccgttctacgttcccttagtacccg

SEQ ID NO: 66398 - DNA, 785 bp, Homo sapiens
  misc_feature: GYAE6OF02IXS7H.31.78.H01.1.454.CMB.1.raw
  modified_base (158)..(158): a, c, t, g, unknown or other
  misc_feature (158)..(158): n is a, c, g, or t
  modified_base (421)..(421): a, c, t, g, unknown or other
  misc_feature (421)..(421): n is a, c, g, or t
  modified_base (449)..(449): a, c, t, g, unknown or other
  misc_feature (449)..(449): n is a, c, g, or t
  modified_base (521)..(521): a, c, t, g, unknown or other
  misc_feature (521)..(521): n is a, c, g, or t
  modified_base (720)..(720): a, c, t, g, unknown or other
  misc_feature (720)..(720): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgacctacggggacatcggtnagtgacgcctagttttccacgtacctcccgtggcttggtcgttcttcggtgggtaccgaggtaaccgggccctaacctacgttaccctaaacgtgacgtaaaccgttcccaacggtacccgtaaggttagttttaacgttttttacgtttcccgggaacccccaccgtaaaactaaacctaaacttaccgttaacgtcttacgggtaccaagacgtaagaaaacggtaggacacgtacctttaaccctaaacttccgtagttntttaccggtgtccttaccggacccggtntaccgttccgggttaccctaaacgtctttacgagttcgaccgtagggtccggttacgtacggtaacccgttntttaccgaccttaccgtacctacaacgtaccagtccgtaccgaccttcggaactaccggtagtacgtaacgtgttacggtcgtacgtttatttaacgttcgttacgtaccgtaacgtactaaacgttaatttaccgttacgtttaccgtttacgtcctttaacgggttccggtaggttaaccggacgtaacggggttanacgtaacgttaacgtaacgtaacgtcggtagtacgtcgactacgtcgttatttctcgttcctacg

SEQ ID NO: 66399 - DNA, 775 bp, Homo sapiens
  misc_feature: GYAE6OF02HMJK7.31.78.H01.1.454.CMB.1.raw
  modified_base (131)..(131): a, c, t, g, unknown or other
  misc_feature (131)..(131): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatntcgtggtgccgtacggggacatgtgatcgaggactacgttccagtaccgtccgtgccgtggtcgtcttcggcggacggagacgggccacctagtacaacgtgacaacggtccagtccgagttaggttgttttacctcggacccctaacaacgtaacctaacttacgtagtccgttacggtaccgaagtcgaaagtaaacgtacgaccacggcccttaacgtaactcctagtactttacgcggttcctaaccgggtccccgtacgtaggttacccccgggttaaccttaaccgtaacgttccgaacgtttcgggaccgtacggtaaccggggttgtaccggggtttaaccttaccggtactttacccggttaccaaccgttacccggtaaacttcgaacgggcccgtacggacccgttccggaacgtacgggtaccgtaaggttaaccggtagtccggttaacggttacgttagtttacgttactacgttcgacgtactaacttacttacttactttccgttaccgtccgtttaccggtaccgtcgggaccggtaaacggacggtagagtaaccgacgtaaacgtaacggttcggtaacggtccgtagtacgtacccagttccgttaacgttcgtacttaccccg

SEQ ID NO: 66400 - DNA, 787 bp, Homo sapiens
  misc_feature: GYAE6OF02H0OIK.31.78.H01.1.454.CMB.1.raw
  modified_base (479)..(479): a, c, t, g, unknown or other
  misc_feature (479)..(479): n is a, c, g, or t
tcagcagtagacgtcacgaccggtgctcgatttagtgtgagtagttgggttgggggagctacaacaggcaggcaggggcagcaagatggtgtgcacgacccaggtcttcatttctctgtgctctggatctcgtggtcgaccgtacggggacagtcgtgatgacgtccgtagtttccacgtacctcccgtgggtctcgtcgtctcggtgggacgaggacggtccacactcaacgtgacaacggtcacgaccaggtatttgttttaccgtacggaccccctaactaaacgtaaccgtaacttcgtaacggttcgttaccggtaccaacggtaacgtaaggaacggtacgtaacctcggtacccttacctaaactccgtacgtacttacggtcggtacttccggaccggtataccggttccgggttaccaaccgttatccgtagttcggaccgtcggtcggtcgtacgggaccttgttaccncctctacacgtcacgtagaccgcgtaccgtcgaccgtacggacgtacggtaagtgtacgggttacgacgttaagtttaccgtacggttactaccgttaagtacctaacgttacgtttaaccttaccggtttacgttaccgttacgttaccggttaccgggtaaccgggtaacgtaaccggtaaggttaccgggtacctaacggttaaaccccggaatttacccggtacggggtaccgggtaccccgtaaggttaccccgtacgttaaccggttacgttaccgttttacccggtaacctttcccccggg

SEQ ID NO: 66401 - DNA, 745 bp, Homo sapiens
  misc_feature: GYAE6OF02FND4T.31.78.H01.1.454.CMB.1.raw
  modified_base (230)..(230): a, c, t, g, unknown or other
  misc_feature (230)..(230): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttaccagtacctcccgtggcttggtcgtctcgtgggcgaggacgggccacactacaacgtnacgacgtccagaccagtagtttacgtttttacgtcggaccccaactaaactaacaacttacgttagtcttcgaaccgagacgaaagaaacggtaacggacacgtacccttacctaaacgttcctcgttaatttaccgtacggtaccttccggtacccgggtctacggtttcccggggttaccctaaaccggttactttacgtacgttacggactacggggtccgggttaccgttaggggaaccctttagttttaccacgttccctactaaccgtactaccgtacgccgtacgtcgtcgacgacggtcgtagaacgtgtacggtacgtacgttaacgtttagtacgtacggttacgagtacccgtaattaacgttactttaacctttcgttttaccgttccttacggttacgggtaccggtacgggtaaccgtaggggtaacgtagttacgaacggtaaacgtacgttaggtcgtacctacggtcctacctagttcgttacgttctacttaccccg

SEQ ID NO: 66402 - DNA, 806 bp, Homo sapiens
  misc_feature: GYAE6OF02JW4WB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgtatggacgcctagttccgacgtacctcccgtggcgttgttcgtctacggtcggacgaggacgggccaactactacgaacgtgacctacgtaccacgtccgtaaggtacgtttacgtttttaccgttaccggacccccgtaaaccgtaaacttaaaccgtaaccttaccgttacggttaccgttacggtaacccgacggaccgtaaacggtaaaggtaccggaccctaaccgtacccgttaacccttaaacctccttacggtaacgttttacgggtaccggtacctttacccgggttaacccggaccggtaccggttaaccccggggtttaaccctaacgttacgttaaccgtagttccgggtacgtaacgggtaccggggtcgttacggggtaccttaacgttttcccaccgttctaccgaaccgtacttaccgaacgtctaccgtacgtcgacgtacgtacgtacgtacggtacgttaggtcgtaagtaccgtttattaccgtcacgtactaactacgttacttctaccgtttcgtacccgttgtccggttacgggtcgggtaaacgcggtagtaccgagtacgtaaccgtacggtctacggtgtacgtactaccgtacctacggtcttacgttaccgtacttcccg

SEQ ID NO: 66403 - DNA, 692 bp, Homo sapiens
  misc_feature: GYAE6OF02HS6F9.31.78.H01.1.454.CMB.1.raw
  modified_base (504)..(504): a, c, t, g, unknown or other
  misc_feature (504)..(504): n is a, c, g, or t
  modified_base (572)..(572): a, c, t, g, unknown or other
  misc_feature (572)..(572): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgacgcctagtttccagtacctcctggctgtgtctacgtgggcgaggacgggccaaccataccaacgtcgacaacggtccacgccaagtagtttgttttacgttcggacccccaactaaataacctaacttacttagtccgttaggtaaccccaggacctaaaggaaaaggttcggaacctaccgtacccttaacccttaaaacttccgtagttaacgtttacggtcggtaccttacccggaccggggtctaaccgggtttccccggggttaacctaacccgtattaccgtagttcggccgtagggtccggtcgtgggtacctacgtttaccactcctacaaccgtntacgacgtcacgtccgtagaccgtagccgtagaaacgtgtacggtcggtactttaagtttactacgtntaccgacgtactaaactagttaccttacgtttcgttctactacggtttcggacggtagtaaccgtaggtgataacgtacgaacgtcgtggcgtcaggtcaccgtactcgtctctactacc

SEQ ID NO: 66404 - DNA, 805 bp, Homo sapiens
  misc_feature: GYAE6OF02HOOKJ.31.78.H01.1.454.CMB.1.raw
  modified_base (230)..(230): a, c, t, g, unknown or other
  misc_feature (230)..(230): n is a, c, g, or t
  modified_base (325)..(325): a, c, t, g, unknown or other
  misc_feature (325)..(325): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcccgtacggggacatcgtgatgagccagttccagacctcctggctgtgtctcgtgggcaggagggccaccatcaactgcaagtccagcagntgtttattgccccacaataacaactacttagcttggtacagtcaagaaagtggacagcctactaaactctgtattacgtggcttccgacccgggnaacgttcccggggttacctaaccgtattaccagtttcggcctaagggtccgggttacctcgggggaaacccttagttttaccaaccgttcctaccgaaccctaacttccgaaagtacccgaacgtcccgttacggacgtaacgggccgttaaaggaaacggtacgttacggtacgggtacgtttaacggttttaaacgtttaccgttagttaacccgtaaacggtaaccctaaaaccgttaaacgttttaaccttaacccgtttttaccgttttacccgtacgtttaaccgtttttacccgggaccgggggtaaacgggaaaccccgttaaaggggtccgggtaaacggtaacgtttaaacccggtaaaaaccggtaacccgtttagggtaaccggggttaaccttaacgggtaaccccgttaaccgaaacccggtttttacccgtaacccgggttttcctttaaccccgtttaaccccg

SEQ ID NO: 66405 - DNA, 862 bp, Homo sapiens
  misc_feature: GYAE6OF02JMXNS.31.78.H01.1.454.CMB.1.raw
  modified_base (133)..(133): a, c, t, g, unknown or other
  misc_feature (133)..(133): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggattcnctggtgcctacgggacatcgtgatgagcctagttccagacctcctggctgtcgtctcgtgggcgaggacgggacccaccgattccaactgacaacgtaccgagccaaggtacgttggtttttacttccggtacccccaaccgtaaataaacctaacttaaccgtttaagtccgtttacggttaacccgtacggaccgtaagaaaaggttacggacacgttacccgtccttaaacctccgtacgtatttacggacggtcttaccgtacccgggtacctacggttcccgggtttacctaaccggttacgttacacgtttacgggctaaccggtcgggtccgtaggggtacccgttagttttccaaccttcgtaccctacctaagtccgacgtaccgtacggtccgtcggtacgtacggacccgttagggtaaagttacgtacggttacggtaccgtttaaggtttaccgtttaaccgaccgttaaggtaacccgtaaccgtaaacctttaggttttaacctttacccgtttttaacccgttttcgggttaaacccgtttcccggggtttttaacgggggacccgggttaaaccggggtaaaccggttaaggggttaaccggacgtttaaaccgtaccggttaaaccgggaaccggtttaacgggtccggtaaccgtttacggacccgtacgtttaaccggttccggtcggttaccttaaccggtttacccc

SEQ ID NO: 66406 - DNA, 721 bp, Homo sapiens
  misc_feature: GYAE6OF02FXTG0.31.78.H01.1.454.CMB.1.raw
  modified_base (664)..(665): a, c, t, g, unknown or other
  misc_feature (664)..(665): n is a, c, g, or t
  modified_base (667)..(667): a, c, t, g, unknown or other
  misc_feature (667)..(667): n is a, c, g, or t
  modified_base (670)..(675): a, c, t, g, unknown or other
  misc_feature (670)..(675): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (688)..(688): a, c, t, g, unknown or other
  misc_feature (688)..(688): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (695)..(695): a, c, t, g, unknown or other
  misc_feature (695)..(695): n is a, c, g, or t
  modified_base (699)..(701): a, c, t, g, unknown or other
  misc_feature (699)..(701): n is a, c, g, or t
  modified_base (703)..(703): a, c, t, g, unknown or other
  misc_feature (703)..(703): n is a, c, g, or t
  modified_base (705)..(706): a, c, t, g, unknown or other
  misc_feature (705)..(706): n is a, c, g, or t
  modified_base (708)..(710): a, c, t, g, unknown or other
  misc_feature (708)..(710): n is a, c, g, or t
  modified_base (713)..(716): a, c, t, g, unknown or other
  misc_feature (713)..(716): n is a, c, g, or t
  modified_base (719)..(719): a, c, t, g, unknown or other
  misc_feature (719)..(719): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccgtggcttgtgtctcgtgggcgaggacgggccacatacaacgtgacaacgtccagaccagtagttgtttttaattccggaccccaacaaactaaactaactaacttagtccgttaggtaaccagaccaaggtaaaagtacggacacgacctaccctaaactcctagtactttacgtggtccttaccgacccgggctacggttcccggggttacctaacccggtacttacgtacgttcggtacgtacggggtcgggttaccgtacgggggtacccgttaacgttttaccgtaaccctttacccgttacccctaaacccggttaaccgtttaacccgaacgggttaccccgtaaacccggggttttaccccccgtttacggggggtaacccccgggtttaaaaacccggggggggtttacccccggtttttaaacccggggggttaaaaaaaaaacggggggttttttaaaaacccggggggtttttgnntnttnnnnnnantntntntnctntgngngngagnnnananngnnnacnnnntcntc

SEQ ID NO: 66407 - DNA, 764 bp, Homo sapiens
  misc_feature: GYAE6OF02HF6E3.31.78.H01.1.454.CMB.1.raw
  modified_base (123)..(123): a, c, t, g, unknown or other
  misc_feature (123)..(123): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttnctctggatctctggtgcctacgggacatcggtgatgagccagtttccagacctccctggctgtgtctctgggcgagaggccaccatccaactgactaaggtccagcccagtagttgttttaattcggcccaacgtaataactaacgtacttacgcttaggtaccagccagaaacgtagacacgtcctaccgtaaactcccgtatacgttttacgtgggtccttaccgtaccccgggactaccgttaccgggggttaccctaaaccggtacttacgtacgtttacggacgtaacgtccgggttaccgttacggggacccggtacgtttccgaacccgtttacgtaccctaacccgtactccgtaacggtacccgaaacggtccccgttagggaccggtaaccgggaccgttaaggaaaggtaccgtagggtacgggtacttaaagttttacgtaaccgttacggttaccgaacggtaactaaaccgttaagtttaaacgttacctttacgtttaccgttcttaaacggtttccgggttacggaacgggtaccgtaagggtttacggagtacgtaccggtaaacggtaacgtggtaccggtactacgtaccggtacctacgttccgtacgtccttacgtaccg

SEQ ID NO: 66408 - DNA, 651 bp, Homo sapiens
  misc_feature: GYAE6OF02FNBXM.31.78.H01.1.454.CMB.1.raw
  modified_base (199)..(199): a, c, t, g, unknown or other
  misc_feature (199)..(199): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagnggccacatcaactgcaagtccagccagagttgttttattcggccccacaataaccaactacttagtcttggtaccagcaagtaaacgtagacacgcctacctaaactcctgtattacgtcggtcttccgtacccggacacggttccggggttacctaaccgtattactagttggtcacggtcgggtcgtacgggaccgtacttacacctctaccactactacgacgactacgctagcgagcgtagaacgtagtcgtaggtacgttagtttactacgttacgtcaagtacctaacgtaatttaacgttactttacccgtttcgtacgttaccggtttcgggaacggtaacgggtaacgtaagggttcggaacgtacgtaaccgtaaacgtacggtaggtaccggtacttacgacccgtaaccgttagtaccgttacgttaccttacgtacccg

SEQ ID NO: 66409 - DNA, 783 bp, Homo sapiens
  misc_feature: GYAE6OF02FTY7F.31.78.H01.1.454.CMB.1.raw
  modified_base (333)..(333): a, c, t, g, unknown or other
  misc_feature (333)..(333): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtcgtctcgtgggacgaggacggccaccgatcaactgcaagtccagccagacgttgttttattcggaccccctaacaataacaacttacttagtccttaggaaccaggacaagaaagtacggacagcctacctaaactccgatacttacngggtcttcgacccggntacgttcccgggttaccaaaccggtnttaccgagttcggctaaggtccgggtactcgggacccttatttccgactccgttaccaacccgtatcccgaagccgtacgtcccgtcggaccgtacggtcgtaacggtaaacgtacggttacgggttacggtaccgtttaaggtttttaaaccgttaccgttacgttaccgtaaacggtacctaaaaccttaacgtttaaccgttaaccgttttacccggtttttaacccgtaaccgtttaaccgggttttacccggggaaccgggttaaaccggggtaacccgtaaagggggttaccggaaggtaccgttaaaccggtaaaaccggtacgttacgggttaccggtaccggtaacgtaacccgttaaccgttacgtttaccgtcggtttacccgttacggttaacccc

SEQ ID NO: 66410 - DNA, 797 bp, Homo sapiens
  misc_feature: GYAE6OF02GJCGQ.31.78.H01.1.454.CMB.1.raw
  modified_base (205)..(205): a, c, t, g, unknown or other
  misc_feature (205)..(205): n is a, c, g, or t
  modified_base (441)..(441): a, c, t, g, unknown or other
  misc_feature (441)..(441): n is a, c, g, or t
tcagcagtagacgtcacgaccggtgctcgatttagtgtgagtagtttgggtttgggggagctacaacaggcaggcaggggcagcaaagatggtgttgcagacccaggtcttcatttctctgttgctctgtatctcgtggtgaccgtagggacagtcgtgatgacgcctattccgagtcctccgtggctgtcgttcttacgcgggngtaggaccggaccaactacgtaccaacgtcgaccgtaaccgtaccgacgccgtaagttacgtttacggtttttacgtccgacccccaaagtaacttaaaccctacttaacgttcgtcggtacggtactagaccgaagtaacgacgctacgccccttaacacgttctagttaccttaccggtgtccttaccggtccggtacgttaccggtccccggtttaaccgtaacgttcttacnggttcgaccggtcggtacggttccggaggttaacccgttacttagttcccctcgttaaccgaacttcggtaaccgtccgaccggtacttaccggtcgtacggtcggtacgtaacgggtagacgttcgggttacggaccgtttaagttacgttactcgttaccgaaccgtacgtaactttacgttcttaaccgtttccgtttaacgtcgtttaacccggtggggtaccggtaaaccgggtaaccgtaaggtaccggtaacgttaaccgtaacggttaaaaccgttcggtcgggtaaccgttaccggacgttaccgtaaccgttccgttcgtaaccggtttccgttcctttaaccccg

SEQ ID NO: 66411 - DNA, 754 bp, Homo sapiens
  misc_feature: GYAE6OF02JSX7R.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgcctctggatctcgtggtcgccgtacggggactacgtcgtgtagtgacgcctacgtttccgacgtacctcccgtggtcgtgttgtcgtcgtgggcgacggacggccacactccaatgacgtaacgtccacgccagttagtttacgttttacgtccgtaccccaactaaactaacctaacttacttacgtactttacggaaccagtacgtaaacggaaggtaacggaccgtaccgtaccctaccgtaacctcccgtattacgttacgtccgggtcctttacccggacccggtcgttaaccggttaccccggggttaccctaaacgttaccgttcgttacgtggtaccgtacgggtccgggtaggttaccggaccgtttactttaccgaccttctaacccgtcgtaccgtcgaccggttaccgtccgtacctcggtaccgtaggtaccggtagtaacgcgttggtactacgttagttacgttcgtacgactactacctaagttactttaccttccgtttaacttccgtaccgttcggacgggtcgaaacggttgacgttacggactaacgtaacgaacgttaacgtggtaccgtacgtacgaccgtactaacgtcttacgttccttagtcccg

SEQ ID NO: 66412 - DNA, 819 bp, Homo sapiens
  misc_feature: GYAE6OF02F3YEM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgtttgctctggatctcgtggtcgccgtacggggactagtcgtagatgacgtccgtagtttaccacgtaccttcccgtggtcctgttcgttccgtacgtcgggacgaggacgggcccaaccgtcgtaccaacgtacgtacgtaacgtcccagtaccgaggttagtttacgtttttacgttaccggaccccgtaacaaacgttaaccaactttaccgttaggtaccgttacggtaacctacggaccgtaaaggtaaacggttacggacctacggtaaccccgttaacctaaccgttaccgtagttaaccgtttaccggtacggttacccgtttacccggtaccccgggtagtacccgggtttccccgggttaaccttaaccggtcttaccgtacggttcggacggtcggtccgggttaccgtacgggtaaccgtttacgtccttacccggacttaacccacctacgtaccgaccggtacgtaccgtcgtcgacgtaacggtcgtagtaacgtagttcggtacgttacgtttagtttacgttcgttacgtacgtacgtactaacgttactttacgttacttttaccgttacgttccgttacgttaccgggtaacggtaccggtacgtacgtaggtacgttacgtacggtaacgtacggtcggtaccgcgtacgactccgtcgttacgtcgtactccgttaccc

SEQ ID NO: 66413 - DNA, 721 bp, Homo sapiens
  misc_feature: GYAE6OF02J1YFJ.31.78.H01.1.454.CMB.1.raw
  modified_base (366)..(366): a, c, t, g, unknown or other
  misc_feature (366)..(366): n is a, c, g, or t
  modified_base (439)..(439): a, c, t, g, unknown or other
  misc_feature (439)..(439): n is a, c, g, or t
  modified_base (532)..(532): a, c, t, g, unknown or other
  misc_feature (532)..(532): n is a, c, g, or t
  modified_base (639)..(639): a, c, t, g, unknown or other
  misc_feature (639)..(639): n is a, c, g, or t
  modified_base (696)..(696): a, c, t, g, unknown or other
  misc_feature (696)..(696): n is a, c, g, or t
  modified_base (713)..(713): a, c, t, g, unknown or other
  misc_feature (713)..(713): n is a, c, g, or t
tcagcagtagacgtcacgaccggtgctcgatttagtgtgagtagtttgggtttgggggagctacaacaggcaggcagggcagcaagatggtgttgcacgacccaggtcttactatttctctgttcgctctggactctcgtggtcgtaccggtacgggacagtcgtgatcgccgtacttgttaccagtcctccggtgcctggtcgtccgtaggcgggtgacggaccgggaccctacacgtcaacgttcgactaaccgtcacgtaccgtaggttagttttcgttttaccgtccggaccccctaaacgtaacttaaccgtacttaggtccttaccggttgtacccagtaccgtaaggtaacgcggtacnccgtacctaactacgtccgtagttacgtcgtcggtactcccggacggtctacgttacccgggttcctaacgtntacgtgtacggcctaggggttccgtgggtaccgtcttacgtttcgaccgttaccctagctacggctaaccgtcacgtcgtacagtacgtacgntacggtctagtctacgttaactcgtagcctaaggtctaaacgttctttaccgtttacgtccgttacgttaccgtccgggttaccgggtacgtaacggtaccgggtancccggtaatacgttaaaccggtcgttacgcggttacacgttccgacggttaacccgngttacgtcgtacccttnttaccccg

SEQ ID NO: 66414 - DNA, 730 bp, Homo sapiens
  misc_feature: GYAE6OF02IA7ZJ.31.78.H01.1.454.CMB.1.raw
  modified_base (151)..(151): a, c, t, g, unknown or other
  misc_feature (151)..(151): n is a, c, g, or t
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
  modified_base (466)..(466): a, c, t, g, unknown or other
  misc_feature (466)..(466): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacntcgtgatgagcctagtttccagtacctcctggctgtgtcctgtggcgagacgggccaccataccaacgtgtacaacggtccacgaccgagtagttagtttttacttcggacccccaactaaataacaccttaagttacgactttagggtaacncgacgtaaagaaacgtggaacncgccctaccgtaactccgtagtactacgtcggtcttaccgaccggctaggttcccggttaccaacctgtcactggacacggtcgggtcncgggtactnttccgtcctagtaccacgtanccgtacgccgacgtccggtanccggtagccgtagtaagtacgtggtaccggatttaaacggttttattacccgtgtaacccgtagaaccggtaactttaacggttaactttaccgttttacgttacccgtttaagttaccggtttacgggtacggggtaaacggttaaccgtaaccggggttagacgttaagggacccgttaaaaccggttacgttcgggttaaccgggtcgtacgtacccggtacgtttaaccggtctttacggtttaccgttcccgttaaccc

SEQ ID NO: 66415 - DNA, 825 bp, Homo sapiens
  misc_feature: GYAE6OF02JGLOS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacagtcgtgatgagccagtttccagactccctggctgtgtctcgtgggcgagagggccaccatcaactgcaagtccagccagagttgttttattcggacccacaataacaactacttagcttacggtaaccagacgaaggaaagtacggacacgtccctacgtaaacctcctcgtaacgtttaccgtcgggtaccttccgttaacccggggctaccggttccccggggttaaccttaaccccgtagtttaccgtacgtttcggacctacgggtaccgggtccgttacgggggtaaccccggttattttacccgaaccgtttcccgtacccgtaaacctacgttccgaacgcccgtaacggtcccgttaggacccggtaacggggtccgtaaggtaaacggtacgttacgggttacggttaccttaaagggttttttacttaacgtttccggttaaccgaacgtaacccgtaaactttaacgtttaaccgtttaccgtttttacccgtttttacgttaacccgtttaccgggtttaacccggggtaaccggggtaaaccggggttaacccggtaaagggtttcgggaacgttaacgtaaccgtaaaaccggttacgttacggtacgggccttaggacccgttaactaccgtttacgttacgttacccttacgttacccg

SEQ ID NO: 66416 - DNA, 896 bp, Homo sapiens
  misc_feature: GYAE6OF02FHKTM.31.78.H01.1.454.CMB.1.raw
  modified_base (122)..(122): a, c, t, g, unknown or other
  misc_feature (122)..(122): n is a, c, g, or t
  modified_base (860)..(860): a, c, t, g, unknown or other
  misc_feature (860)..(860): n is a, c, g, or t
tcagcagtagacgtcacgaccggtgctcgatttagtgtgagtagtttgggtttgggggagctacaacaggcaggcaggggcagcaagatggtgttgcagacccaggtctcatttctctgttnctctggatctctggtgccgtacgggacagtcgtgatgacgtccgtacgtttccgagcctcccgtaggtcgtgtcgtcttacgcgggacgaggacggcccaacctagtcgaacctgacctaagtcccgagaccaggtacgtttcgttttagttcccggaccccctaacgtaaactaaccgtaaaccttacgtttagtcccgtttaagggtaacccgtaacgtacggtaaaacgtaaacggttaaaccgggtaccggtaacgtaacccccgtttaaccccggtttaaaaccctccccgttaaggttaaccgtttttaaccggaccggggtttacccctttaacccggggttaaccccccgggtaagtacccggggttttaccccccggggtttaacccctttaaaaccggtaacgttttaccttacgggttaccgggtaccggtaaccggggttcccggggtttaccgtaccgggggtaaaccccgttaggtttaccccctaaacgttcccgtttacccgaaacctaccgtaccggtaacggtcccgaaacgttcccgtaccggtacggtaacccggtacgttaaggaaaccggtcgtacggtagggtacttacgtttataccggtctacgagtaccaagttaccttacttacttccgttacgtacgttaccggttaccgagggtaccggtaacgtaggttacggataccgtaacgtaaacgcggtaccgtgtaccgacnccggtaccttagttccggtccgttactcggttaacc

SEQ ID NO: 66417 - DNA, 884 bp, Homo sapiens
  misc_feature: GYAE6OF02GRI7H.31.78.H01.1.454.CMB.1.raw
  modified_base (528)..(528): a, c, t, g, unknown or other
  misc_feature (528)..(528): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgccgtacggggacagtcgtgagtgacgcctagtttccagtacctcccgtaggctagtgtcgttcgtgggcgaggacggtccaccagtccaactgacgaacgtccgacgacgagtacgttcgtttttacgtccggaccccaacgtaactaactaacgttaccttaggtccgttacggtaacccaggaccaaggtaaaggttcggacctaacggcccttaacctaaaccgtccgttagttaaccgtttaccggtacgggtaccctttacccggtacccggggtacttaccgggttaccccggggtttaccctaaccgttagttaccgtaggtttacgggaccgtaacggggtccggggttacgtacggggtaacccttagtttaacccncgttacccaccttaaccgacgtacgtaccgactaccggttccgacggtaccgtacggtcgttaacgggtacgtaggttacggtcgggtaacgttttagttttacgttacgtacggttaaccgacggttaacttaaacggttacttttaaacgttttcccggttttactttacccgggttaccggttttaaccggggtttacccgggggaaccgggttaaaccgggtaaccgggttaacggttaacggggtacccttaaagggtaacccgtaaaacgggtaccggtttacgggaacgttaccgtaccgttaccgaaggtttcccgtacgttttacgtttccgtaccctttaacccgg

SEQ ID NO: 66418 - DNA, 942 bp, Homo sapiens
  misc_feature: GYAE6OF02F06HT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcggtgatgacgtccgtagtttccagacctcccgtggctgtgtctgtgggcgaggacgggccacatacaactgacaacgtccacgccaggtagtttagttttacgttccggacccccaacctaaactaaacctaacttacgttacggtacctttcggtaacccagaccgaaaggtaaaacgtaacgggtaaccaacggtaccccttaacccgtaaaaccttaccgtaacggttaaccggtttttaaccggtccggggttaccctttaccccggtaacccccgggggtaccgttaacccggggtttaccccggggttttaacccctaaacccggttaacgttttacccgaacggttttaccgggaacgtaccggggttccccggggttaccggttaccgggggttaaccccgttacttttaacccgcccgtttaaccgtaccctaaccgttacgttaaccgacgtacccgtaacggtaccctacgggccgtaagggtccgtaacggtaaagtcgttacgggtcggtaaccgtttaaggttttacgtaccgttacggtaaccgttaccgtaacgttaacctttaacttttaaccgtttaaccgtttcctttttaccggggtaaccctttacggggttttcccggggaaaccggttaaacgggttaaccgggtaacgggttaggttacccaaacgggttaaaccgtaaaccgggttaacgttacgggtaccgtcggttaacctacgttaacccgaagtttcccggtttcgtaaacccgtttccgttccccgg

SEQ ID NO: 66419 - DNA, 696 bp, Homo sapiens
  misc_feature: GYAE6OF02IYFHL.31.78.H01.1.454.CMB.1.raw
  modified_base (375)..(375): a, c, t, g, unknown or other
  misc_feature (375)..(375): n is a, c, g, or t
  modified_base (456)..(456): a, c, t, g, unknown or other
  misc_feature (456)..(456): n is a, c, g, or t
  modified_base (664)..(664): a, c, t, g, unknown or other
  misc_feature (664)..(664): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcctacggggacatcgtgatgacgctagtttccagacctcccgtggtctgtgtctcgtgggcgaggacggccacatacaactgacaacgtccacgccgtagtagttgttttagttccggaccccaactaaataactaacttattacgtcgttacgtaaccagacgtaagaaggtagaacacgtcctaactaactctgtacttacggtgtctccgacgctacgtccggtacaacgtntacagttcgacgacggcggtcgcggtacctatttaccactaccgtccgaacctacgtacgacgtcgaccgtccgtcgacgnggtacctaaggaactaggtcgtaggtacgtttaagtttacgttacgtcgtaaccgtcgtaacgtaaaccttatttaacctttaccgttttctttaccgttacgttacggtttaccgggaacgggtaccggtaagtagggtaaccgtattaaccggtaaacgttaaaccgtagttacggtaccgttacggtaccgttacaacccggttnttacgggttacctttacccgtagtttaccccg

SEQ ID NO: 66420 - DNA, 849 bp, Homo sapiens
  misc_feature: GYAE6OF02GI7PY.31.78.H01.1.454.CMB.1.raw
  modified_base (123)..(123): a, c, t, g, unknown or other
  misc_feature (123)..(123): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttnctctggatctctggtgcctacggggacacttcgtgatgagcctagtttccagacctcccgtggctgtgtctcgtgggacgaggaacgggcccaaccgattaccgaaaacttcggacaaaggttccccaaggaccgaagtacgttagttttttacttacgggacccccaacctaaataaacctaaccttaccttaagtccgtttacggtaacctacgacgtaagaaaaggtaacggacacgtaccctacgtaaacctcctagtaattacgtcggtaccgttaccgtaacccgggtacctacggttacccgggggtttaacctaccgtaattaccgtacgttacggttaccgaacggtcggggttccgttaccggggtaaccgttaacgttttacctaacggtttaccaccgtaacccgtaagtaccgtaacggtccgtaacgacccgtacgaccggtacggtaacggttgaaaccgttagtacgttacggcgttaagtttaaccttacgttacgtactaacgaacttaacttaacgtttaacgttaaccttttaccggtttacgttaacccgttccggtttacgggttaaccggaaacggggtaaaccggttaagggtacgggtaacgtaacgtttaacccggaaaacggttaacgggtttaactaccggggtactaaccggtacggtaacctaacgttccgttacgttacccgttacggttaaccc

SEQ ID NO: 66421 - DNA, 624 bp, Homo sapiens
  misc_feature: GYAE6OF02GESUB.31.78.H01.1.454.CMB.1.raw
tcagcagtagacgtacacgaccggtgctcgatttagtgtgagtagtttgggtttgggggagctacaacgaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgttttattcggccccacaataacaactactagcttggtaccagcaagaaagtaggacacgcctactaaactcctagtactttacgtgggtcttccgtacccgggctaacgttcccggggttaccctaaacccggtattcgaagtttcggctaggccggggttctacgggggacctattttcgaacttcctcaacctatcagcacgcctgcgaaggcctagaagtactggtcgcgttagtttactacgttcgtacacgactaactattactactttctttacgtctacgtttcgggaccggtacggtaccgtaagggtggagtacgtaaccgtaaacggtaacgtggtacggacttcgacgtaccctaagttcgtacgttaccgtctaaccg

SEQ ID NO: 66422 - DNA, 639 bp, Homo sapiens
  misc_feature: GYAE6OF02GWUEC.31.78.H01.1.454.CMB.1.raw
  modified_base (233)..(233): a, c, t, g, unknown or other
  misc_feature (233)..(233): n is a, c, g, or t
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
  modified_base (535)..(535): a, c, t, g, unknown or other
  misc_feature (535)..(535): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacggccacgatcaactgacaagtccagccanagttattttacgttcggaccccaactaaactaacctaactacttagaccttagggtaaccagacaaaggtaaacggtaggaccacgtacctaccctaaaacgtcctagtactttaggcggtcttccgaccggntacgtccgggttacctaacgtacttcagttcggacncggtcggtctagggactacgttcacgttcctacaccgtatccgagacacgcctagcgacggcgtaagaagtagttgggacgtacgttaagtttacttacgttagacctaagactaactatttacgtacctttnttcgtactacgtttacggaacggtacggagtaacggtagacgtaatacgtaaaccggtagtacgtcgagtacggactaccgtatacgtacgttcgtacctaccg

SEQ ID NO: 66423 - DNA, 795 bp, Homo sapiens
  misc_feature: GYAE6OF02GIN0W.31.78.H01.1.454.CMB.1.raw
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
tcagcagtagacgtcacgaccggtgctcgatttagtgtgagtagtttgggtttggggagctacaacaggcaggcagggcagcaagatggtgttgcagacccaggtcttcatttctctgttgctctggatctctggtgcctacggggacatcgtgatgacgcctagtttccagacctccctggctgtgtctcgtggcgagacggccacgatccaacgtgacctaagtcccagacccgtaggtaagtttggtttttaacgttcggaccccctaaaccaaagttaaacccaaactttaccgtttaggtaccgtttacgggtaaccccaaggaccgaaaaggtaaaaacggttacggaaccgtaccgtccccttaaaccccgtaaaaccttccgttaagttactttttaccggtacgggtaccctttacccggtaaacccggggtcctaaacggtttccccgggggtttaaccccttaacccggtaatttccggtaacgtttccggcgttacggggtcccgggttacgtaccggggtacctacgttttcaacgttctaccgacctancgtaancgtacgccgtgccacggtactacggtaagtacgtggtacgtacgttagttttacctacgttcgtacacgtataaccttattaacgttctttcgtttactacgttacggtttacgggacggaacggtaaccgtaggtacggtacaacgtaaccggaaacgttaaccgttgggtacgaccgtttacgaccctacgtaacgttccgttacgttaccgtacgtttacccg

SEQ ID NO: 66424 - DNA, 738 bp, Homo sapiens
  misc_feature: GYAE6OF02IRMSR.31.78.H01.1.454.CMB.1.raw
  modified_base (267)..(267): a, c, t, g, unknown or other
  misc_feature (267)..(267): n is a, c, g, or t
tcagcagtagacgtcacgaccggtgctcgatttagtgtgagtagtttgggtttgggggagctacaacaggcaggcaggggcagcaagatggtgtggcagaccaggtcttcatttctctgttgctctggattctcgtggtgaccgtacggggacagttcgtgatggacgtccgtacgtttccgacgtaccttcccgtggcttggtcgtcctggtacgggcgaggacggccaccagtaccaacgtcgataacggccaacggccaaggtntttaggttttacgtccggaccccctaaataacgtaacctaacttacgttaacggcgttacggaccagtaccgaaggtaaaggtacggaccacgtaaccctcttaaaccggtctaagttacgtttacggtcggtccttaccggtaccggtactaacggtttcccggggttaacctaaacgttcgttactaacggtgtaccggagggttccgggtacgtacggggtacgttacttccggtactccgttaacgcctaagtcgaacgtctaacgtccgtaagcggacgtcgtacgaagtcgtaggtcgtacgttagtttaagttcctagtcaacgtaacaacgtttattaacgttacgtttacgtcgtaccttaccggttagggaccgtacgggagtaagggttgacggttactaaccggaaagtcgtatccggtacttacgctaacgtgttaacgtccgttctaaccgttcccg

SEQ ID NO: 66425 - DNA, 868 bp, Homo sapiens
  misc_feature: GYAE6OF02ID74G.31.78.H01.1.454.CMB.1.raw
  modified_base (541)..(541): a, c, t, g, unknown or other
  misc_feature (541)..(541): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgcctagtttccagtcctcccgtggtctgtgtctcgtgggcgaggcgggccaccgatacgaactcgaccaaacgtccacggccaaggtagtttacgtttttacgttccggaccccccaaactaaactaaacctaaaccgttacttacgtacctttacggtacccagtaccgaaaggtaaaacgtacggaccaccggtaccccttaaccgtaaaaccgttccgtagttaacgttaaccggtcgggtacccttaccgtacccccggggtatacccgggttcccggggttaccctaaaccggtcttttaccgagtttaccggcgtaacgggtccgggttacgtacgggtaaaccttctttaccggaccttaccacctaaacctntaaccggacgtacccaaggcccttacggccggtaacggtcctaaagggtaacgacggttgacggtaaccgtttagtttaaacgtttcctagttaaccgacgtaaccgtaaacttacggtttaaactttacccttttccgtttaacgtaacccgtttaaccgggttttcggggaacccggggttaaacggtaacccggttaaacgggggttaccgtaaacggttaacccggttaaacccgtaaaaccggtaaacgttcggggtaaccgtaaccgtttaccggaaccctagtacccggtttactttccggttaacctctttacccccgg

SEQ ID NO: 66426 - DNA, 821 bp, Homo sapiens
  misc_feature: GYAE6OF02H69I1.31.78.H01.1.454.CMB.1.raw
  modified_base (750)..(750): a, c, t, g, unknown or other
  misc_feature (750)..(750): n is a, c, g, or t
tcagcagtagacgtcacgaccggtgctcgatttagtgtgagtagtttgggttgggggagctacaacaggcaggcaggggcagcaagatggtgttgcagaccaggtcttcatttctctgtgctctgatctcgtggtcgccgtacggggtacacgtcggtagtagtacggtacgtccgttaacggttttccgaaacggtaacccttcccgtcgggtccgttggttccgttccggtacggtcggggacggaacgggaccgggtaacccaaccgtataaccgtaacgtacggacctaacggtaccgacgtaccgtaggttaagtttcgttttacgttcccggacccctaaactaaactaaccgtaaacttacgttacggtacgttacccggtaacgacggtaacgtaaacggtaaaagtacggtaacctaaccgttaaccccgttaaccctaaacgttcccgttaattaacggttaccggtccggttaccttaacccggtacccggtacgttaaccggttaccgggtacctaacgtacgtcgtaaggtcgtaccgcggacggttcggacggttaccgttcaccgttcctaccgtacctaactcgtacgccgacgtactccgtaggaaccggtcgtacgtaacgtaggtacggtacgtagttaccgttaggtttaactcggtacgtacgtaacgtactaccgttattaccgtttacgttcgttacgtcgttacggttcggaacggtcgtaaacgnggtactaggaactacgtaacgtacgttgacgtacgtccgtaactcgttactacgttcgttaacgtctaccg

SEQ ID NO: 66427 - DNA, 677 bp, Homo sapiens
  misc_feature: GYAE6OF02FQM3X.31.78.H01.1.454.CMB.1.raw
  modified_base (524)..(524): a, c, t, g, unknown or other
  misc_feature (524)..(524): n is a, c, g, or t
  modified_base (555)..(555): a, c, t, g, unknown or other
  misc_feature (555)..(555): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtacctcccgtggctgtcgtctcgtgggcgaggacggccaccatacaacgtgacaacgtccacgcagtagtttagttttacgtccggaccccaactaactaaacctaacttacttacgtccgttacggtaaccacggacgaaaggtaaacggtacggaccacgtccctaaccgttaacctccgttagtacctttacggtcggtacctttccgaccggtctaccggttcccggttacctaacgtcttcgtagtcgcgacgggtcggtacgtcggtactcttcactcgtacacgtactcgacgcgtacgcgtgacgagcgtagagtatcggtgtacttagttcacgtcgacnggtactaacttactttacttacgtttccgtnttaccgttccgggttccgggaaggtaccgtaacggtacgggacggtacgtacgtaaaccgtaaggtccgttcggggtacacgtacgaccgttccttaggtcctttcgtaccttacttccccg

SEQ ID NO: 66428 - DNA, 776 bp, Homo sapiens
  misc_feature: GYAE6OF02G3K85.31.78.H01.1.454.CMB.1.raw
  modified_base (747)..(747): a, c, t, g, unknown or other
  misc_feature (747)..(747): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggactctctggtcgcctacgggacatcgtgatgacgcctagtttccagacctccctggctgtgtctcgtggcgagcggccaaccgagtaccaactcgacgtaaccgtccgacgaccgaaggttaggtttcgtttttaacgttccggaccccctaaactaactaaaccgtaacttacttacgtacgttacgtaccagacaagtaaacgtacggacaccgtaccctacctaaaccgtccgtacgttaacttaccggtcggtacccgtttccggtaccccgggtacttaccggggttaccccgggtttaacccaaccgttaacgttcgtacgttacggcgtaccgggtcgggtacgtacggggtacctacgttccgacttcctaccactactcgacgaccgacgtcctggccgagtaccgtaggacgtactgggttacgtagtttactttacgtttactacggtaccaagtaaccaatttacgttaacctttacgtttacccgtttacgtacccgtttaccggttacgggtacgggaaacccggtttaaggaaggttaccggtagtaaccgttaaccggaaacggttacgtacgttcggaaaccgttcgacccgtaaccgttnttaccggtacctttccgttacttaccccg

SEQ ID NO: 66429 - DNA, 673 bp, Homo sapiens
  misc_feature: GYAE6OF02HB1N9.31.78.H01.1.454.CMB.1.raw
  modified_base (180)..(180): a, c, t, g, unknown or other
  misc_feature (180)..(180): n is a, c, g, or t
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
  modified_base (451)..(451): a, c, t, g, unknown or other
  misc_feature (451)..(451): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggagctacaacaggcaggcaggggcagcaagatcggtgttgcagacccaggtcttcatttctctgttgctctggatctctggtgccgtacgggacactcgtgatgagccagtttcagacctccnggctgtgtctcgtcgggcaggacggtccacgactacgaacgtcgacgaacgtccagccgaagtcgtttgttttacgttccggacccctaacctaataaacctaccttagttagtcgtttacgaccagaccaagaaagtacganacgtcctaactaactcctntacttacncggtctcgaccgntcgtccgggttcctaacgtnttctagttcggcacggtcggtacgtcgggtaacctacttcgtactcgtaacccacgacgtctacgacncggtccgtgcgacgtactacgaacttaggtcgtggtactttagtttatacggttcganaacgaccttgttactttacgtttacttacccgtttcgttagttccgtttaggaccggaccggttaacgtagggtacccgtagaaccttacgaaacggttaaccgtgtttaccggatccggtaaccacggttacttcccgtttacgtttccttacccgttaaccg

SEQ ID NO: 66430 - DNA, 876 bp, Homo sapiens
  misc_feature: GYAE6OF02F3WHP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagccagtttccagtactcccgtggtctgtgtctcgtaggggcctagacgggcccaaccagtaccaactgacctaagtccagcccgagtagttgtttttaacgttcggaccccctaacgaaactaaccaaacttacttaggtcctttaggtacccaagtaccgaaaggtaaaacggtacggaaccgacgacccttacccgtaaaaccttcccgtagttaactttaccggtggggtaccttttaccggaccccgggtactaacggttccccgggggtttaacctaaacccggtagtttacctaggttacggaccgtagggtaccgggttcgtacggggtaaccctattttacccgaaccgttcctaccgacccgtaaacttccgacggtacctaccggtacccgtggtacccggtaacggtacctaagggtaaacgtcggttacgggtacggtaccgttaaggtttttaaccgtacgttaacggttaccgaaacggtacctaaacggttaacttacggttttaaccctttacccgttttaccggttaccgttaaccgggttttaccgggaacccgggtaagggttaaccccgggttaagggttacgggtacgttaacgtaaccggtaaaaccggtacggttacggtaccgggtacgttaaccggacccgtaaccggttacgtttacccggtccggtttacgtttaccggttaacccg

SEQ ID NO: 66431 - DNA, 837 bp, Homo sapiens
  misc_feature: GYAE6OF02I69ZA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgtgcctacgggcatcgtgatgagtcagttccagactcctggctgtgtctcgtggcgagcggccacatcaatcgctaacgtccagaccagtagttcgttttacgttcggccccctaaactaaacttaaaccgtaacttaaccttaggcttaacgggtaacccaagaccaaaggaaaaggttacggacaacggtaccctaacctaaaacgtcccttaggaaccttttacggcggtaccttaccggtaacccgggctaacggttccccgggttaactaaaccccgtattaccgtaattcggactaacgggtccggggtactacggggtaaccttaacttttccgaaactttccgtaacctaacccgtacgtacaacggaccgtaacgacccgttacggaccgtaaccggtacctaaaggaacggttaacgttacgggttacgggtaacctttaaggttttaacctttaccgttaggtttaccaaaggtaccctaaaacgttaactttaacggtttaacctttccgttttaccgtacgttaaccggttttaccgggaacggggttaaaccgggaaccgttaacggggttacgggaacgtaacgttaaaccgtaaaccggaaaccgtttggggtaaccgttcccggttaaccgacctttaaacccggactttccgtttaaccgtttaccggttacctttaaacccgg

SEQ ID NO: 66432 - DNA, 684 bp, Homo sapiens
  misc_feature: GYAE6OF02JTRKG.31.78.H01.1.454.CMB.1.raw
  modified_base (184)..(184): a, c, t, g, unknown or other
  misc_feature (184)..(184): n is a, c, g, or t
  modified_base (286)..(286): a, c, t, g, unknown or other
  misc_feature (286)..(286): n is a, c, g, or t
  modified_base (421)..(421): a, c, t, g, unknown or other
  misc_feature (421)..(421): n is a, c, g, or t
tcagcagtagacgtcacgaccggtgctcgatttagtgtgagtagtttgggtttgggggagctacaacaggcaggcaggggcagcaagatggtgtgcagacccaggtcttcattctctgttgctcgtggatctcgtggtcgccgtacggggacagtccgtgatggagcctagttccagcctcccnggtctgtgtctcgtgggccaggacggccaccgatcgaactgacaacgtccagccaggtacgttgttttacttacggccccaacaataacctaactacgtcgngttcgtaaccagacgaagtaaggtacgacacgtccctaactactctagtacttacgtgctaccggtacgctaccggttcgggtccctaacgtgttacacggttagcgtacgggtcggtccggtacggtaaccgtntttacctacgtccgttacaccctagtcaacgccacgtaccgtcgacgtcgggacttaaggacgtagttccggtagtaccgtttagtttactaccgtacggttcaaacgtaacgtaacttaagttccttaccgttttaccgtcgttcgtttaaccggtacgggtccgggtaaacggaaccgttaggacggactaaccgggtcaaacgggttcgcggttacctacgtacggtacaaccttggttacctacgtttccgacgttccc

SEQ ID NO: 66433 - DNA, 792 bp, Homo sapiens
  misc_feature: GYAE6OF02IKJ0O.31.78.H01.1.454.CMB.1.raw
  modified_base (191)..(191): a, c, t, g, unknown or other
  misc_feature (191)..(191): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (411)..(411): a, c, t, g, unknown or other
  misc_feature (411)..(411): n is a, c, g, or t
  modified_base (520)..(520): a, c, t, g, unknown or other
  misc_feature (520)..(520): n is a, c, g, or t
  modified_base (526)..(526): a, c, t, g, unknown or other
  misc_feature (526)..(526): n is a, c, g, or t
tcagcagtagacgtcacgaccggtgctcgatttagtgtgagtagtttgggtttggggggagctacaacagggcaggcaggggcagcaagatggtgttgcagacccaggtcttcatttctctgttgctctggatctctggtgccgtagggacatcgtgatgagcctagttcagactcctggctgtgtctcgnggacgaggacggccaccntacaancgacaacgtcaagaccagtagttagttttacgtccggacccctaacgaaaataaccgtaacgttaacgttaacgccgtttacggtaacccataaccgtaaaggtaaaaggtaccggaacgtaactaaccccgtaacccttaaaaccgttcccgtagtaacctttacggtacgggtcctttaccggtaacccgggtntaaccggtttccgggggttaaccctaaacgtacgttactacggttgacggacgggttacgggtccggtccggtaacccgttattaccgtaccgtacttaacgacctacncgtacnccgtacgtccgtgacgacgtacggtagtaagaaccggttggtacggttacgtttaagtttaaacgtttacgacggtacgtaacgtaaccgttaacttaacgttaactttaccgttttccgttttaccggttacgttaccgggttccggttaaccgggtaacggaaacccggttagggttagtaaccggtaactaaaccggtaaacggtaacgtcggttaggaaccgtcgtaaaccgtcctaacggtttcgtactttcacttacccg

SEQ ID NO: 66434 - DNA, 927 bp, Homo sapiens
  misc_feature: GYAE6OF02FJCVL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcgatttctctgttgctctggatctctggtgccgtacgggactatcgtgatgacgcctagtttccagacctccctggctgtcgtctcgtgggcgaggacggccaccgatacaacgtgactaacgtccagccaggtacgttgtttttacgttaccggccccaacgtaaactaacctaactacttacgtcttacggtaccgagacctaaggtaaacgtacggaccacgacccttaaccgtaaccttcctacgttatttaccggtcggtccttaccggtacccgggactacggttacccggggttacctaaccggtattccgtacgttcggacgtacgggtccggtacggtcgggaccgttacgtttcaccttacgtaccacgtacgtaccgacgtaccgtaacgtccgtacgtccgaacggttccgtaaggtaaccggtcggttacggtaccggtaacgttttaaccgggttttacgttaacccggtttcgtaacccgttaaccggtaaaccttaaaaccggtttaaccgtttttaaaccttttaacccgttttttacccggtttaaacccgttttaccgttttaacccgggttttttaacccgggggaacgggtttaaacccggggaaaccccgggttaaagggggttaaccgggttaaccgtaaaacggtaacccgggttaaaaaacccggttacggtttaacccgggggtaccgtttaaccccggttaccggtaaccccgtttaacccggggtttaaacctttttacccccgggtaccggttttttaaccccgttaaccgggttttaaaccccccgg

SEQ ID NO: 66435 - DNA, 746 bp, Homo sapiens
  misc_feature: GYAE6OF02JST8G.31.78.H01.1.454.CMB.1.raw
  modified_base (117)..(117): a, c, t, g, unknown or other
  misc_feature (117)..(117): n is a, c, g, or t
  modified_base (216)..(216): a, c, t, g, unknown or other
  misc_feature (216)..(216): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
tcagcagtagacgtcacgaccggtgctcgatttagtgtgagtagtttgggtttggggagctacaacaggcaggcaggggcagcaagatggtgttgcagacccgaggtcttcatttcnctgttgctcgtggatctctaggtgccgtacgggacatcgtgatgagcctagttccagtactccctggctggtcgtctcgtggacgagacgggccaccgntacgaacgtgactaacgtccagtccaaggttacgttgttttaccgttcggaccccaacgtaaagtaacctaacttacgttagtccgttacggtacccagtaccgtaaggtaacgtcggaacctcgtaccctaaccgttaactccgtaagtacctttaacgtcgggttacctaccggtacccgggtacttacggtacccgggttacctaaccggtatttccggtagtacggtccgaggttaccgggtcgtacgggtactntttaccgnttaccgactactggtccctagaccgtgaccgtcgacgcgtacgtcgtaacgcgttagaccggttacttacggtttacttacgcgtaaccgtacgtaacctaacggttcttaccgttactttcccggtacggttaccgttacggtttaccgggacggtaaccggttacgacgggttaaccgacgggtttaatacccggaaaggtcccgttaaggtccgtacgttcgaccctacgttaccgttcgtaccgtttccaagttcccgg

SEQ ID NO: 66436 - DNA, 683 bp, Homo sapiens
  misc_feature: GYAE6OF02GFWTA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggggacatcgtgatgagcctagtttccagacctccctggctgtgtctcgtgggcgaggacgggcccaccatcaactgacaacgtccagccagtagttgtttttacgttcggaccccaacaaataaacctaacttacttagccttaggtaccagacaagaaaggtacggacacgtaccctaccttaaaccgtcctagtactttacggtcgggtacttccgacccggctacggttccgggttacctaacgtactcagttggcgtacggtcgggtcgtacgggacctattcgactctacactagtcagcacgcctcgcacggctagagtagtggtacgtgttaacgtttacttacgtcgtacaacgtactaacttatttacttaccgtttctttacggtacctttacggtttccgggacggtaacgggtaaccggtagggtacggtacgtaacgttaaccgtaaacgggtacgttcggtaacggttaccgacgtaacccgtaacgttaacgttccgtttacgttacctttacgttacccg

SEQ ID NO: 66437 - DNA, 984 bp, Homo sapiens
  misc_feature: GYAE6OF02GYF28.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcccgtacggggacagtcgtgatgagcctagtttccagacctccgtggctgtgtctcgtgggacgaggacggccacacgtacactgacaacgtccgacgccagtagttagttttacgtccgaccccaacgtaaactaacctaacttaacgttacgtccgtttacggtaaccaagacaaacggtaaaacggtaccggtaacaccggtaccctaacccgttaaacctccgttagttaacctttacggtacggtccgtttacccggtacccgggtactaccgggtttaccccgggttttaaccctaaaccggtacgtttacgtaccggtttcggaacccggtacggggtaccgggtttaccgggtaaccggggtttaacccgtttacgttttacccgtaaccgtttacccgttaccctaaacccggtacgttaacccggtaccctacggtaaccgtacccgtttcgggaacccggttagggtaacccgttagggtaaaacgtttccgggttaacggggtttaacccggtttaacggtttaaacggtttttaaccgttaaccgttccgggtttaacccgtaaacggttaccctaaaaccgttttactttttaaacccggttttacctttttaaccgggtttttccgttaacccgtttaaccgggtttaccccggggtaaacggggtaacccggttaaaaccgggttaacggggtaccggtaaagttccccggttaaaacggttaaaacccggtaaccgggtttacgggaccggttaacccgttaacggaacccctttacgttaacccgtttaaccgtttaccggttaccctttaccgtttaaaccccgg

SEQ ID NO: 66438 - DNA, 592 bp, Homo sapiens
  misc_feature: GYAE6OF02FHHEI.31.78.H01.1.454.CMB.1.raw
  modified_base (464)..(464): a, c, t, g, unknown or other
  misc_feature (464)..(464): n is a, c, g, or t
  modified_base (489)..(489): a, c, t, g, unknown or other
  misc_feature (489)..(489): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccacactcaactgcaagtccagccaagagttagttttagtttcggacccccaacaattaacaactacttagacttggaccagcagaaagtagacagcctactaaactcctagatttacgtggtccttcgtacccgggctacggttccggggttacctaaccgtattccagtttggcgtacggtcgggtcgttacggggaccgtatttacactctaccactatcgaacgctagcctgcgaggcgtagaagtagtgtaggnttagtttaactgtgtcagacaactnttaactctttcttacgttctacgtttcggacggacgggtacgaagtggtacgatacgtaaacagtgtacggtactgaccacgtatcgtacgttcctacttccg

SEQ ID NO: 66439 - DNA, 713 bp, Homo sapiens
  misc_feature: GYAE6OF02I43SB.31.78.H01.1.454.CMB.1.raw
  modified_base (349)..(349): a, c, t, g, unknown or other
  misc_feature (349)..(349): n is a, c, g, or t
  modified_base (463)..(463): a, c, t, g, unknown or other
  misc_feature (463)..(463): n is a, c, g, or t
  modified_base (509)..(509): a, c, t, g, unknown or other
  misc_feature (509)..(509): n is a, c, g, or t
  modified_base (638)..(638): a, c, t, g, unknown or other
  misc_feature (638)..(638): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggactctctggtcgcctacggggacatcgtgatgagcctagtttccagactccctaggctgtcgtctcgtggacgagacggccacgatacaactgacaacgtccagacctaagtagttcgttttactaccgaccccaactaaactaactaactacttagtcgttacgtaaccagacgaagaaagtagacgactaccctacctaactcgtagtaacttacggnggtactccggtacccggagtaccgtccgggttacctaacgtattacgtagtcggcgacgtcggttacgtacgggtacgttacttaccgacgtctacctaaccgactaccgaacnccggaacgttccgacgtacggtaaccggcgtaaaggtaaccgttanaggggtaccttagttaaccgggtttaattaccgtacgtaacggtataaccctaagtttaactttaacgttccgtttacgttaccgtttacgtacggttacgggacgaaccgggtaattagggacggtanaacgttaaccaaacgggtacttcgggtaagtacccgttacgaccttactacggttcttcgggttactacctacgg

SEQ ID NO: 66440 - DNA, 804 bp, Homo sapiens
  misc_feature: GYAE6OF02IXQW7.31.78.H01.1.454.CMB.1.raw
  modified_base (121)..(121): a, c, t, g, unknown or other
  misc_feature (121)..(121): n is a, c, g, or t
  modified_base (545)..(545): a, c, t, g, unknown or other
  misc_feature (545)..(545): n is a, c, g, or t
  modified_base (769)..(769): a, c, t, g, unknown or other
  misc_feature (769)..(769): n is a, c, g, or t
tcagcagtagacgtcacgaccggtgctcgatttagtgtgagtagtttgggtttgggggagctacaacaggcaggcaggggcagcaaggatggtgttgcagacccaggttcttcatttcctntgttgctctggattctcgtggtcgccgtagggcagtcgtgatgacgcctagtttccaacgtccgtccctggtcctggtcgttaccgtgtcgggacgaggacggccaacctatccaactcgacacgtccacgacgtagttagtttcgtttacgtccggaacccctactaagtaaaccctaacgttaccttacggtaccgttcggtaaacccgtagtacgaaacggtaaacgttacgggaacctaccggtacccttaaacccgtaaaccgttccgttagttaaccgtttacggtccggggtacctttaccgggacccggtactaccgggttcccgggttacttaaccggtagttcgtacgtcggtagcggtttcgggcgttacgggactttacgtccgtacgttcccaaccacgtagtccgaacgngtaccgtccggtagtccgaacggtcgtacgaaagggtcgtaggtacccgtagtttaacgtttacgacgtcgttaacacgtacgaactttcttaggttacccttttaccgtgtacccttacggtaccgggtaggtacggttaaaccggtaggtacgggtactacgttaaaacccggacggttaacttacggggtcttaccggtaccctaaccgtaaccgggtttntaccgttacccggtttaccgttccttaaccccggg

SEQ ID NO: 66441 - DNA, 781 bp, Homo sapiens
  misc_feature: GYAE6OF02HLYIP.31.78.H01.1.454.CMB.1.raw
  modified_base (138)..(138): a, c, t, g, unknown or other
  misc_feature (138)..(138): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtnccgtacggggacatcgtgatgagcctagttcagacctcctggctgtgtctcgtggacgaggaggccaccatccaaatcggcaacgtccagacctaagtagtttgtttttacttcggaccccctaaacaactaaaactaacttacttaacgtccgtttacggtaacctaggacctaaaggtaaaaggttaacgacgtaaccgtacccgttaacccttaaaaccgttaccttaacggtaacgttttttaccgacggggttaccctttacccgttaaccccggggtccgtaaccggtttaccccggggtttaacccttaaaccggttacgtttacgtaacgtttcgggaccgtaacggggtcgggtttacggtacccgggggtaacgtttccggttttaccgtacctaccgtaccacctacgtaccgtaccggtacaaccggtcccgtacggaccgaacggtttcgaaacggtaaagtcgtacgggttagtccgttaagtttaccgttagtctacaacgctaattacttatttacttacttcgtactaccgtttacgcggaaccggtacgagggtacggacgtaacgtaaccgtaaggtacgttgtacggaccgtagacccgtgttaccttgtcttcttctaaccg

SEQ ID NO: 66442 - DNA, 688 bp, Homo sapiens
  misc_feature: GYAE6OF02HICT8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaggggacatcgtgatgagccagtttccagactccctggctgtgtctactgggcagacgggccaccatcaactcaagtcccagccagagttgttttattggcccccacaagtaacaacttacttagctttaggtaccagctagaaagtaggacacggcctacctaaaccttcctagtattttaccgtgggtcctttaccgtaccccgggctaacgttcccgggggtttaccctaaccggtatttccgtagtttcggctacggtcggggttctcgggggaaccctatttccgactcgtcaccatccagccagtaccctgcgacgtcgtacggaacgtagtcgttggacgttacgttttaacgttacttggtacctaggacctaagtatttacctacgttttccttacgttcgtaacgtttccgggacggttaacgggtaccgtaaaggtcggtaacgtacgttaaccgaaccggttaacgtacggttgggtacccttacggaccctttacccgaatttccgtactttaccgtttaccacgtttccccg

SEQ ID NO: 66443 - DNA, 769 bp, Homo sapiens
  misc_feature: GYAE6OF02JJ3XK.31.78.H01.1.454.CMB.1.raw
  modified_base (186)..(186): a, c, t, g, unknown or other
  misc_feature (186)..(186): n is a, c, g, or t
tcagcagtagacgtcacgaccggtgctcgatttagtgtgagtagtttgggtttgggggagtcgtacaacaggcaggcaggggcagcaagatggtgtgcagacccaggtctcatttctctgttcgctctcggatcctctgtgccgtacgggactatcgtgactggacgcctagtttcagacctccgnggctgtgtctcgtagggcgagagggcccaccagtaccgtaactggactaacggtccaacgtccgaagtagtttgttttacgttaccggaccccctaacaaagtaaccgtaaccgttacttacgaccgtttacggtaaccgacggtacctaagggaaacggttaacggacctaccggaccccttaaaccgttaaacccgttccctgggtaactttaaccggtcgggtaccttaccggtacccggacgtacggtttaccccgggttacctaaccggtattaccgaggttcgacgcggtaccgggttcgtacgggtacctgtttcacgtccgttccactacgtccgtagactccgtcctacggacgacggtacgtacgtagtacgtacggtcggtacttaacgttacgttacttacggacgtacgtactaacgttcttacgtaccttacgttacgtaccgttacgttcggtaacggtacggtaacgtaagggtccgtaagtaccggtacgaaacggtcgttacggtacgtaccgttaaccgccgtaacgtacgttacggtttaccggtagtttacccgttacccgg

SEQ ID NO: 66444 - DNA, 793 bp, Homo sapiens
  misc_feature: GYAE6OF02HJHHR.31.78.H01.1.454.CMB.1.raw
  modified_base (154)..(154): a, c, t, g, unknown or other
  misc_feature (154)..(154): n is a, c, g, or t
  modified_base (492)..(492): a, c, t, g, unknown or other
  misc_feature (492)..(492): n is a, c, g, or t
  modified_base (724)..(724): a, c, t, g, unknown or other
  misc_feature (724)..(724): n is a, c, g, or t
tcagcagtagacgtcacgaccggtgctcgatttagtgtgagtagtttgggtttgggggagctacaacaggcaggcaggggcagcaagatggtgttgacagacccaggtctcatttctctgttgctcgtgatctcgtggtcgaccgtacgggacngtcgtgatgacgctacgttcacgtacctccgtggcttgtcgtctaggtcgggagacgggaaccggcccaacgtactacgaaacgtcggacctaacgtcgaacgccgtagtaggtttagttttctaccggacccaactaaataacctaaacttacgttagtacttaccgggtaacaacgtacgtaagaaaacggtgtaccgaacgtaccctaacccgttaacgtcgtacttaacggttcgtaacgtccgttaccggacccgtacgtcggttacccgggttaacctacggttactcggtacgtggaacctcgggttacggtacggtacgggtaaccgttnttacggacctacgtcttaaccgacacggtactccgacgtccgtacggtaccgtaagaccgtagtacggttagtacggttacgtacgttaacgttttacgtcttacgtaccgaaggttacctaattaacttaccgtttaccgtttaacgttccgttccggttaaaccgggttcgtaaccgggtaacgggttaacggtacgggttacgaacggttaacgtaacggttaaaccgngggttagttaaccgtccggtaaccggtcctaacggttcgtaccgtttacgttaaccctcggtttacccg

SEQ ID NO: 66445 - DNA, 753 bp, Homo sapiens
  misc_feature: GYAE6OF02F0GU3.31.78.H01.1.454.CMB.1.raw
  modified_base (538)..(538): a, c, t, g, unknown or other
  misc_feature (538)..(538): n is a, c, g, or t
  modified_base (584)..(584): a, c, t, g, unknown or other
  misc_feature (584)..(584): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctcgtggtgcctacgggacattcgtgatgactcctagtttccgagtacctcccgtggctgtgtctcgtgggacgacgcggcccacatacactgacacgtccgacgtaccagtaggttcttttacgttccggaccccaaccaacttaacctaacttaacttacgcgttacggtaccaacgcgtaacggtaaaagtaccggtacgaaccggacccttaaccctaaacctccgtaggtaacttttccgtacgggtacctttaccgggtaccccggtagtacccgggtttaccccggggttacccgtaaacccggttagttccctagttagggcctaccggggtcggttccggtacggggtaccgtaagtttccctagtacctccgaacctagtccgactcgacgctacggnacgtctaggacgtagtcggtgtacgttagtttaacgagtttcgacncgtacctagttactttaacgttacctttcgttttacgtaccgttaccgttacggggtaacggtaacggttacggtacggtaaccgggtactaaggtaaccgttaaaacggcggttacggaccgggttcacggtacctacgttacgtcgtttacttccgtagtttacccg

SEQ ID NO: 66446 - DNA, 679 bp, Homo sapiens
  misc_feature: GYAE6OF02HNZ08.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtggcgagacggccaccatcaactgacaagtccagccagagttgttttattcggccccaacaataacactactagcttggtaccagcaagaaagtaggacagcctacctaactcctgtaactttacgtcggtacttccgaccgggtctaacggttcccggggtttacctaaaccgtattctaagtttcggctaggtccgggtcgtacggggtaaccgtacgttttccaaccttcctaccaaccctatacgacgtaccgaacgtcccctggacgtaacgggtctaacggtaaatacggttaggtggtaccgttaagttttacttaacgttcgttacgacgtaactaaccgtaagtttacttaccgtttacgtttcgttaccttaccggtttaccgggacgggtacggaacgtaagggtggaacgtagtaaccgaaagtaccgtaggtccgtacgcgtaccaacctagttcctacgttccttatacccgg

SEQ ID NO: 66447 - DNA, 711 bp, Homo sapiens
  misc_feature: GYAE6OF02GPZCE.31.78.H01.1.454.CMB.1.raw
  modified_base (444)..(444): a, c, t, g, unknown or other
  misc_feature (444)..(444): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
  modified_base (701)..(701): a, c, t, g, unknown or other
  misc_feature (701)..(701): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctcgtgggtcgccgttacggggacagtcggtgaagtgaacgcctaggttttccaggaccttccgtaggcttgttcgtctacgtgggcgaggacgggcccaacacgtacaacgtgaccaacggtccacgtaccaagtagtttcgtttttacgttaccggcccctaaacaagtaaacctactacttagtacttcggtaacacgtacgaagaaacggtacggactaccggtacctaaccttaaaccgtctacgtactttacggacggtccttaccggtaccggctacggttcccgggttacctaagtacttaccngttcgacgtgtccgggttcacgggtaccttagtccaattccgacaccngtaacncgacacgacgcgacgcgacgtaagacgtgtagtcggtactttaagttattacgtactacgacactatactttacgtactttacctttcgtactttaccggttacgggtaaccggacggtaacggtagggacggttacgaacgttaaccggaaggtaacgttggtacggtacgttaccgacgtaactcttaagccgttttaccncgttaacccg

SEQ ID NO: 66448 - DNA, 953 bp, Homo sapiens
  misc_feature: GYAE6OF02IRNT9.31.78.H01.1.454.CMB.1.raw
  modified_base (203)..(203): a, c, t, g, unknown or other
  misc_feature (203)..(203): n is a, c, g, or t
tcagcagtagacgtcacgaccggtgctcgatttagtgtgagtagtttgggtttgggggagctacaacaggcaggcaggggcagcaagatggtgttgcagaccctaggtcttcatttctctgttgctctggatctcgtggtagccgtacggggactagtcgtgatgacgcctagtttccgagtacctccgtgtctgtcgtctgnggacgagacggccacactacacgtcgacacgtaccgacgaccgtagtagtttacgttttacgtacccggacccctaaccgtaaactaaaccgtaaaccgtttaaccgtttacggttaccgtttaaccggtaaccccgtaacggtaacggtaaaacggtaaaacgggttaccgggaaaccttaaccccggttaaccccgtttaaacccttaaaaccccgtttcccgttaaggtttaaccgtttttaaccgggtaccgggtttaccccgtttacccgggtaacccgggtaccgttaccggggtttacccccgggttttaacccgtaaccggtttacgtttacgttacggtttcgggtaccgttaacgggggttcgggtttaccggtaaccggggttaaccctttaacggttttacccacccgttttaccgtaaacccgttaacctacggtacggaaacccgtcgtaacgtccgtacggaccggtacgtaaccgttaggaaactgggttacggttgtaccggtttaaactttcggtaattacggtaacgacgttaacctaaactttttagttaccgttttaaccgttttccgtacgtttaccgtaacgggttacgggtaacgggttaaacgaaccggtttaggggaaaccttacgaaacgttacccgggtaaaacggtttccgtacgggtttccaaccgttacggaccctttaacggtacgtttcccggttagtttccccttaagtacccccg

SEQ ID NO: 66449 - DNA, 817 bp, Homo sapiens
  misc_feature: GYAE6OF02IPDEA.31.78.H01.1.454.CMB.1.raw
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgccgtacggggacagttcgtgatgacgcctacgtttccagtacctcccgtggcttgtcgtcgtcgtgggcgaggacggccacactcaactgactacgtccagaccgagtacgtttgtttttacgttcggacccccctaacgaaaacttaaccgtaaacttacgtttacgtaccgtttacggtaaccctaacggacgtaaaggtaaaaggttacggaaccgaaccggtaccccttaacccgttaaaaaccttcccgttaaggtaacgttttaaccggtcgggtaccgtttacccggtaaccccggggtccttaacgggtttccccggggtttaaccctaaaccggttacgttacgtacggttggaccgtacgggtccggtcggtacggtaccgtactttacgacttccgtacctacgtactactacgtccacgtccgtcggacgtacggtctaacggaagtacgtacggttcggtacgtttaagtttacgttacgtacttaccgaagttaccaaagtttactttaaccgttcttttaccgtttgttaccgtaacggtttccgggagggtaaaccggtccggtaaggttaggtacgaaccgttaaccggaaacggttacgttcgggttaacgccgttaccgtccgtaaacgttccgtcttaccgttcgttaccttaccccgg

SEQ ID NO: 66450 - DNA, 668 bp, Homo sapiens
  misc_feature: GYAE6OF02GEILK.31.78.H01.1.454.CMB.1.raw
  modified_base (220)..(220): a, c, t, g, unknown or other
  misc_feature (220)..(220): n is a, c, g, or t
  modified_base (314)..(314): a, c, t, g, unknown or other
  misc_feature (314)..(314): n is a, c, g, or t
  modified_base (602)..(602): a, c, t, g, unknown or other
  misc_feature (602)..(602): n is a, c, g, or t
tcagcagtagacgtcacgaccggtgctcgatttagtgtgagtagtttgggtttgggggagctacaacaggcaggcaggggcagcaaggatggtgttgcagacccaggtcttcatttctctgttgctctggatctctggtgcctacggggacatcgtgatgagccagtttccagactccctggctgtgtctcgtgggcgagacgggccaccatccaacgtnacaacgtccagccagtgttgttttattcggaccccacaataacaactacttagtcttgtaccagcaagaagtagacacgcctacctaactcctntactttacgtggtccttccgtacccgggactacggttcccgggttacctaaccgtacttctagttcggcgaggtcgggttcgtcgggtacccgttacttttccgtaccttccgtccaaccctactaccgacgtccacgtccctggaccctagggaccttaggaaacggtacgtgggttcggacgtttaaggtttttacgtaccgttaggtaccaacgtacctaacgttatttacgttacctttcgtttcgtaccttacgttcgggacggtacggtaaccgtaagggtntacgtacacgtaaacggtagttcggtcgtacagtccctacgtacgttcctcgtttactacctaccg

SEQ ID NO: 66451 - DNA, 792 bp, Homo sapiens
  misc_feature: GYAE6OF02HEG5Y.31.78.H01.1.454.CMB.1.raw
  modified_base (126)..(126): a, c, t, g, unknown or other
  misc_feature (126)..(126): n is a, c, g, or t
  modified_base (136)..(136): a, c, t, g, unknown or other
  misc_feature (136)..(136): n is a, c, g, or t
  modified_base (518)..(518): a, c, t, g, unknown or other
  misc_feature (518)..(518): n is a, c, g, or t
  modified_base (767)..(767): a, c, t, g, unknown or other
  misc_feature (767)..(767): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctntggatctcgnggtgccgtacgggacagtcggtgatgagcctagtttccgaagactcccgtggcttgtcgtctcgtggggcgtaggcggccaactaagtcaaacgtgaccgtaaacgtccagccgaagtacggtttgtttttacgtccggacccctaacaaacgttaaacaaccttacttacggcgtttacggtaccaaggtctaaaggaaaacggttaggaactacggtcccttaactaaaaccgtccgttagttaactttacggtcggtccgtttaccgacccgggtactacggggttcccgggttaacctacgacgttcagttcggacgtacgggtcggtcgtacgggtaccgtaatttccgaacgtttcacccgtaacgtactaccggngttaccgaccgtcgttacgacgtacggtcgtaacggtaacgtacggttacggtacggttacgttaaagttttaccgttacgtacgtacgaacgttacaaacggttacttaacgttacctttcggttaccgttaccggttcggtacggttaccgggaaacggttaacccgttaggtaaccgggtacttaacggaaccgtaacggtacttaacgggacgttacgtaccggtaaccgtacgttaccggtttnttaccgttcgttacccgttaacccg

SEQ ID NO: 66452 - DNA, 864 bp, Homo sapiens
  misc_feature: GYAE6OF02GZA0H.31.78.H01.1.454.CMB.1.raw
  modified_base (152)..(152): a, c, t, g, unknown or other
  misc_feature (152)..(152): n is a, c, g, or t
  modified_base (449)..(449): a, c, t, g, unknown or other
  misc_feature (449)..(449): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacgggganatcgtagatgagcctagttccagactcccgtgctgtgtctcgtggcgagacggccacatacactcgactaagccacgccaaggttacgtttacgtttttagttccggaacccccctaaccgaaataaaccgtaaaccttacgttacgtccgttacggtaaccagtaacgaaaggaaaggtaacggaccaacgtccccttaacccgtaaaccttcccttagtaaccgttttcgtacgggttacctttccccggtacccgggtacgtacccggtttacccgggttacccgtaaaccgtnttaccggtacgttcggacgtacgggtacgggtccgtacggggtaccgttcttaccgtactcctacgaccctcgtaccgaactccgtccggtacccgtcggacgtacgggacgttacgtaaaggtagttacggggtaacccggttacgtttttaacgggtttatttaaacccggttcggttaccgtaaaccgttaacctaaaccttttaacgttaaccgtttttaccccgtttacgttttcccgtttaaacccgtttcgggttttaccggggaaaccgggttacgggtaaacccgttaagggggtttaagaaccgttaccggtaaaacgttaaccgggtaaccggtttacggccgggttacctacggtaacccttcggttaaaccgttccggttacgtttactaccggttaacccc

SEQ ID NO: 66453 - DNA, 680 bp, Homo sapiens
  misc_feature: GYAE6OF02GHR9N.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatccaacgtcgacaacgtccaaggccaggtagttgtttttacttcggaccccctaacaaataacaacttacttagcttaggtacctagacaaggaaagtacggacaacgccctaccgtaaacctcctagtactttacgtgggtccttaccgtacccgggctacggttccccggggttacctaaccggtattaccgtattcggacgaggtcggggttccgtcggggaacccttattttccgaacttccgtaccaacccgtataccacggaccacgtcctcggcgtacggtactaggaaagtacgtggtacgggacttaggtttaactacgttcgtaccacgacctaacttacttaacgttctttactttacgtccttcgtttcgggacggtacggtaacgtagggtcggagtaacacgtaaacggtacgtaggtgtccgtagtccgactacgtcgttctacctcgtaccc

SEQ ID NO: 66454 - DNA, 707 bp, Homo sapiens
  misc_feature: GYAE6OF02FSXEI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggctgtgtctcgtgggcgagacgggcccacactacaaccgtgaccaacgtccaacgccaggtagttcgtttttactttccgggaccccctaaccaaataacaaccttacttagtcttaggtaaccagacaagaaagtaggacacgccctacctaaacctcctagtattacgcggtcttccgaccggctacggttcccgggttacctaaccgtattacagttcgacgacggtcgggtcgtacgggtacctacgttccacctctacccactactcacgctactccgtgcgtacggctagaacgtgtcggtacggtacgtttaacggtttacttacgttcgtacggtactaaccgtaacttaacgttttaaccttaccgtttccgtttaccgttaccgttacggtttccgggaacgggtaccgggtaacgtacgggtagtacgtaacgtaccggtaaaaccggtacgttacgggtcggtaccgtacgaacctaccgttagtacccgttacgttccgttacctacccgg

SEQ ID NO: 66455 - DNA, 631 bp, Homo sapiens
  misc_feature: GYAE6OF02JNUH6.31.78.H01.1.454.CMB.1.raw
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
  modified_base (536)..(536): a, c, t, g, unknown or other
  misc_feature (536)..(536): n is a, c, g, or t
  modified_base (552)..(552): a, c, t, g, unknown or other
  misc_feature (552)..(552): n is a, c, g, or t
  modified_base (579)..(579): a, c, t, g, unknown or other
  misc_feature (579)..(579): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagccagtttccagctcctggctgtgtcncgtgggcgagnggccacatcgaactgacacgtaccagccagtagttagttttagttccggacccctaacaactaaaccactacgttagtcgtacggtaccagtacaaacggaaaggtacgacacgtacctacctaaccgtccttagtaccgtttacgtcgggtccttaccgacccgggtcctacggttcccgggttacctaccgtactacgtagttcggtacgacgggtccgggttacgtcggggtaaccttcgttctaccgtctacgacctactacgtaacgctaccggactcgccgagtacgagtaacgtcgtaggtcgtattacgtttaacgngtacntaatattntacttacttcgttacncgttaacgtcgtagacgtacagggtanagtacaacggaactgagtcgtacgtacgtacactacgtctgtttccattccg

SEQ ID NO: 66456 - DNA, 1003 bp, Homo sapiens
  misc_feature: GYAE6OF02I93XS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgacgccagtttccagtacctcccgtggctgtcgtctcgtcgggacgaggacgggcccacataccaacgtgacaacgtccaacgccgaggtagtttagttttacttcccgggaccccctaacctaaactaacctaaaccttaccgtttacggtaccgtttaacggtaaccgacgacgtaaacgggtaaacggttaacgggacctaaccgtaccccttaacccttaaaacccgtccctttaacggtaaccttttaccgggtccggggttaccttaccccgggttaacccccgggggtaccttaaccgggtttcccccgggggtttaaacccttaacccgggttaaccttaccgtaacggtttcgggaaccgtacgggggtaccggggttaccggtaccggggtaaccgtttaccttttaccaccccgtttacccgtaccctaaccccggtacgtccgttaacggaccccgttaacccgggacccggaccggtaccggaacccggggttaaccgttaaacggggtaacgggttaaccgggtttacgggtttaccgggtttaaacccgtttaacggtttttacctttaaccgggtttaccggtaaaccgggttaactaaacccgttaaaacttttaaaccgttttacccttttaacccgtttttaccgtttaccgtttacccggtttccggggtttacccgggggttaacgggtaaaccgggttaacgggaaccgggttaacgggtaacggtaacctaaaccgggtaaacgtaccggttaccgggtaccggtaccggtactaccgtaccttagtttaccggttaccgtttaccttaccggttacccc

SEQ ID NO: 66457 - DNA, 925 bp, Homo sapiens
  misc_feature: GYAE6OF02JYN1U.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacagtcgtgatgagcctagtttccagacctcctggctgtgtctcgtgggactaggacgggtacccaaccattacccaaacgttcgactaaacgttcccgaaggtacccgtaaggtaggttttacggtttttaactttccgggacccccctaaactaaaacgtaacctaaaccttaaccttaacgtccgtttacggtaaccccaagtaccgaaaggtaaaacgttacggacctacgtaccctaccctaaacgtcgttacggtaactttaccgacggtctttacccggtacccgggactaccggtttccccggggttaaccctaaccggttacttaccgtaaccggtttaggcccggtaaaccgggtttcggggtaccgttaacgggggtaaccccgttaagttttacccacgtttccctaacggacctaacgccgaagtaccgacggtcctggtaccgtacggaccttagggaaaacgtcggttggttaccggtaaacggtttactttaaacgtttcctacgggttaaaccggttacctaaaaccgtacttttaaaacgtttccgttttaacgtttacccgttttacgtttaaacccggttccggttttaaccggggtaacgggttaaaccgggtaacccggtttaaacggggtaacggttaacgtaaacggttaaaccggaaaacccgttttacggacgggttaaccgttacccgtaccggttaacccttaaccggaaggttttcccctttggttaccccttaacggtttaaccccgg

SEQ ID NO: 66458 - DNA, 497 bp, Homo sapiens
  misc_feature: GYAE6OF01A4S39.51.59.F04.1.454.CMB.1.raw
tcagcgatcgtatacacgaccggtgctcgatttagtacacacacttagggattggggctggggagcctagctgtgctgtgggtccaggagacagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccgaggcagaggacgaggctgactattagttgtcaatcaacagacaccattggtacttatgtcttcggactgcgacaggtacaccgtcctgggtaccg

SEQ ID NO: 66459 - DNA, 639 bp, Homo sapiens
  misc_feature: GYAE6OF01B8IVT.51.59.F04.1.454.CMB.1.raw
  modified_base (205)..(205): a, c, t, g, unknown or other
  misc_feature (205)..(205): n is a, c, g, or t
tcagcgatcgtatacacgaccggtgctcgatttagtacacacacttagggagttggggctggggagcctagctgtggctgtgggtccaggaggcagaactctgggtgtctcacctatggcctggatccctctacttctcccctcctcactctctgctacacggctctgacggcctcctatgagctgacgacagccaccctcggtntcagtcgtccccaggacagacggccaggtatcacctgactctaggagtatgctattcgaccaaaacgaatagtagcttattcggtaccagcagaacgccggcctacggccctgtgttcggagactggtataaaggactactggaagacggcctacggagggactcccgtaggacgtacgtacttcctacgtcggtctccgaggtccgaacgggacaacggtcacgtagttcggacctatcgaggtagagttccaggtcaaggacggaacgaaggtctagtaacgttcttaagttcgtacttaaacgtccgaaacgtacgtaactaacgtagtttacgggtaaccttaagttacggttaccgtttccgggtaaacttcggacccgtaaacccgtaagggttaccctaacccggtttccgggtcggggttaacccc

SEQ ID NO: 66460 - DNA, 802 bp, Homo sapiens
  misc_feature: GYAE6OF01D3718.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctcccctcctcactctctgcacaggctctgaggcctcctatgggacgtctacgaaccaacgaccgaccccctacccggttcgggttcgtacgtacggttccccgtacccggaacggaacgaacgggaccggaccggaaggtactaccctaccgtcgtccttcggtagggaagtagtcgacttacgttaccgaaacccgaaaaccgtattacgtcgttactttaggttaccgaaccgagacgaacggaccgggcccggacgacccggtccgttggttggttggtagtagttaagtaaagtaacgaactacgtaggacggacccgtccgtagggacggtacctccgaggacgtacttactttccgtcggtcgtcctacggtacggtacgggaacggtaaccgtacggactagttaggttcccgactagtacgagggtacgtacgtacgacggacgaagggacggacggacgtcgtaacgttaactttaagtttacgttaccgaaacttaacgtaaccgaaacgtaccgtaaaccgtaccgtttaaggtttaaccggtttaaccttttaggttaccgtttacccggtaaaacggtacgttaccgggaaaccccgttaaacgggtaacccggttacccgttaaccccgggtttcggggttccggaaaccccgg

SEQ ID NO: 66461 - DNA, 536 bp, Homo sapiens
  misc_feature: GYAE6OF01CPT78.51.59.F04.1.454.CMB.1.raw
  modified_base (318)..(318): a, c, t, g, unknown or other
  misc_feature (318)..(318): n is a, c, g, or t
  modified_base (421)..(421): a, c, t, g, unknown or other
  misc_feature (421)..(421): n is a, c, g, or t
  modified_base (526)..(526): a, c, t, g, unknown or other
  misc_feature (526)..(526): n is a, c, g, or t
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccacggcccctgtgttggtgatgtaataaagacactgagaggccctnagggatccctgagcgattctcgtgctcaggtcagggacaacggtcacagttggccatcgagtcggagtccgaggcaggaggacgaggcgtgactattatgtanaatcaacagacacctattggtacttatcgttcttacggtaactcgacgtaaccgaaggtccgtaccgtccgtacgggtcacggtaccccaacggacccaaccccncgtcgtaccc

SEQ ID NO: 66462 - DNA, 661 bp, Homo sapiens
  misc_feature: GYAE6OF01D2ZJR.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcattcgaccaaaccgatatgcttatggtaccagcaagaacgccggccgacggcccctggtgttggtgatagtaataaagacacgtaggagacggccctagagggactcccgtgacgcgtattctcgtcggcctccgaggtcgagggacctaacggtcacgtagttcggacctacgtcgaggtcggacgtcccgaaggtccgaagggacggacggacggtcgtacggtaactttaagtttaacgttcggtaacctaaagttaccaaacgtaacgaaccctaaccgtaagttttacggttaacctttagttacggttaccgtttaccgggtaaccttcgggaccgtaaaccccggtaaaccggttcccgtaaccccggtttaccgtaccggggttccgaaccgggtaaaccccccgg

SEQ ID NO: 66463 - DNA, 575 bp, Homo sapiens
  misc_feature: GYAE6OF01AY5F5.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgaccaggatcacctgctctggagatgcattgaccaaaccgatatgcttattggtaccagcagaacgccgggccacggcccctgtgttggtgatgtaataaagacacgtgagacggccctcgagggactcccgtgacgcgtattctcgtggctccgaggtcgagggacgaacggtcacgtagttcggccatcgagtggacgtccgaggcgaggacggacggaggctgacttatttcgtgtactaattcttacacgtactagtcgtagttcggtaactttagttcggttacgttacgggaacgttacgggaacctaacgggtcctacccggttccgtaacggtccgacggtaaccccg

SEQ ID NO: 66464 - DNA, 492 bp, Homo sapiens
  misc_feature: GYAE6OF01A2X4N.51.59.F04.1.454.CMB.1.raw
  modified_base (459)..(459): a, c, t, g, unknown or other
  misc_feature (459)..(459): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccgaggtcagggacaacggtcacattggccatcaggtggagtccgaggcgagaggacgaggctgactattattgtcaatcaacagacacattggtacttntgtcttcgactgcgacagtcaccgtcgtggtac

SEQ ID NO: 66465 - DNA, 528 bp, Homo sapiens
  misc_feature: GYAE6OF01A2YM9.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtgtccccaggaccagacggccaggatcacctgctctggagatgcattgccaaaaccgatatgcttatggtaccagcagaagccgggccaggcccctgtgttggtgatgtataaagacactgagaggcctcagggactccctgagcgattctctggctccgaggtcagggacaacggtcactagtcggccatcagtggagtccgaggcaggaggacgaggctgactattagttgtcaattcaacagacaccattaggtacttagtagttcgttcgggaactggtaccgacccgaacggttccgacccggttccgtcgggtacccg

SEQ ID NO: 66466 - DNA, 515 bp, Homo sapiens
  misc_feature: GYAE6OF01AYABH.51.59.F04.1.454.CMB.1.raw
  modified_base (344)..(344): a, c, t, g, unknown or other
  misc_feature (344)..(344): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgtggtgatgtataaagacactgagacggccctcgagggatcccngagcgattctctggctcaggtcgagggacaacggtcacattcggccatcgagtggacgtccaggcagaggacgaggctgactattagttagtcaatcaacagaccactagttcggtaactttgtagtcttacggaacttcgacgaccaggtccaccgtccgtgggtacccg

SEQ ID NO: 66467 - DNA, 548 bp, Homo sapiens
  misc_feature: GYAE6OF01AKLEY.51.59.F04.1.454.CMB.1.raw
  modified_base (327)..(327): a, c, t, g, unknown or other
  misc_feature (327)..(327): n is a, c, g, or t
  modified_base (537)..(537): a, c, t, g, unknown or other
  misc_feature (537)..(537): n is a, c, g, or t
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagaggccctcgagggatcccgngagcgattctctggctccgaggtcagggacaacggtcacattcggccagtcagtggacgtccaggcagaggacgaggctgaactattatgtacaatcaacagacacctagttagtacttagtgtacgttacggactggaccgtaacgtaacggttccacccggtccgtacggggttaccacggaccccgtaacggacccctaacccccgngttcgtacccg

SEQ ID NO: 66468 - DNA, 522 bp, Homo sapiens
  misc_feature: GYAE6OF01BI3ZS.51.59.F04.1.454.CMB.1.raw
  modified_base (242)..(242): a, c, t, g, unknown or other
  misc_feature (242)..(242): n is a, c, g, or t
  modified_base (513)..(513): a, c, t, g, unknown or other
  misc_feature (513)..(513): n is a, c, g, or t
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcgagggactcccgtgacgcgattctcgtcggctccgaggtcagggacaacggtcacattggccatcaggtgagtccaggcaggaggacgaggctgactattattgtacaatcaacagacactattggtacttatgtcttcggaactgaccgacgaaggtccaccggtcctgggtccacgacccaacggacccaacccngtcgtaccc

SEQ ID NO: 66469 - DNA, 496 bp, Homo sapiens
  misc_feature: GYAE6OF01BSSWW.51.59.F04.1.454.CMB.1.raw
  modified_base (353)..(353): a, c, t, g, unknown or other
  misc_feature (353)..(353): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtcgttggtgatgtataaagacactgagaggccctcagggatccctgagcgattcnctggctccaggtcagggacaacggtcacattggccatcagtggagtccaggcagaggacgaggctgactattattgtcaatcaacagacaccattggtacttatgtcttcggaacttgcgaccaaggtcaccgtcctgggtac

SEQ ID NO: 66470 - DNA, 609 bp, Homo sapiens
  misc_feature: GYAE6OF01EXK2D.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctggagatgcattgaccaaaccgatatgcttatggtaccagcagaacgccgggccacggcccctgtcgttggtgatgtaataaagacactgagacggccctcgagggactcccgtgacgcgtacttctcgtcggctccgaggtcaggggaccaacgggtcaacgtgttcggacccatccgaggtggacgtccgaggcaagaagcgaggtctggacttactttctagtactaaacgttcttacaagtacattaccgtaggttacggttaacctttagtcggtttaccgttacggggtaaaccgtcgggggtaaaccctaaacgggttccctaaccccggttaccgtaacgggttcccgaaccggtaaccccccgg

SEQ ID NO: 66471 - DNA, 708 bp, Homo sapiens
  misc_feature: GYAE6OF01DJVJM.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctcgtggagatgcattcgaccaaaccgatatgtacttattggtaccagcaaggaacggcccgggaccgacggccccgtggttcggttgggtagagttacgtaaagtaaagactacgtagacggaacggccctacgaacgggtactccccgtaggacgtcggtacttccgttcgtacggtccctacggaacgggttaccgaacggggaacctaaaccgggtcctaacgtagttcgggaccctaagttccgaggttacgggacggttacccgagggtaccgaagggaacgggtaaccgacgggtacctacgggtaactttaagtttacttcggttaactaaacgtaccgaaacgacgtacccaacgttaacgttaggttaacctttagtcggttaccgtttacggaacgttcggaaccgtacccgtaaacggttccctaacccggttccggtacggtaccgtaccggaaaccccgg

SEQ ID NO: 66472 - DNA, 551 bp, Homo sapiens
  misc_feature: GYAE6OF01CJMAY.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaaccgatatgcttattggtactagcagaacgccggccaggcccctgtgttggtgatgtataagacactgagacgccctcgagggactcccgtgacgcgtattctcgtggctcgagggtcgaagggacaacggtcactagttcggccagtaccaggtggacgtccgaggcgagaggacgaggctagacttagttattgtacaatcaacagaacacctagtttggtaacttacgttgttacgttcggtaaactggaccgtaaccgaacggttacccgacccgttccgtcgggtaacccg

SEQ ID NO: 66473 - DNA, 644 bp, Homo sapiens
  misc_feature: GYAE6OF01CJPAI.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttctcccctcctcactctctgcacaggctctgaggcctctatgagctgacacagccaccctcggtgtcagtcgtccccaggacagacggccaggatcacctgctcgtggagatgcattcgaccaaaccgatatgtcttattggtaccagcaggaacgccgggccacggccctgtcgttggtgatgtaataaacgacacgtaggagacggccctacgacgggtactccccgtggacgcgtacttcgtcgtcggtcctccgaggtcgaacgggacctaacgggtacacgtagttcggaccctagtcgaggtcgggagtacccgagggaccagggacggaacggaggcctaggaactttaagtttattgtaactaataccaaactacgacctaaccgtagtttacggtactttaaggtcgtttccgttaaccgggtaaccttacggaacccgtaacccgtaacgggttaccccgtaacccgggttcccgttacggggtccctaacccgggaacccccg

SEQ ID NO: 66474 - DNA, 880 bp, Homo sapiens
  misc_feature: GYAE6OF01BP8YK.51.59.F04.1.454.CMB.1.raw
tcagcgatcgtatacacgaccggtgctcgatttagtacacacactttaggggtagttggggggggagcctaagctgtgctggtgggtccaggaggcagaactctgggtgtctcaccatggcctggatccctctacttctcccctcctcactctctgcacaggctctgaggcctcctatgagctgacacacgccacccgtcggtgtcacggtcgtccccaggacagacggccaggactcacctgcttcgtggagactgacattcgaccaaaccgatatgacttattggtaaccagcaagaacgccggaccacggtcccctggttcggtttggtcgtagttacggtaataaaacggacctaacgtggaacggtacggccccgttaggacggggtacttccccggtggacgtcggtaactttctcgtcggcctaccgaggttcgaacggggaacctaaccgggtccaacgtacggtttcggaccctaagttaccgtaaggggttcgggtaaccggttacccgtaaggggttaccgtaaggggtaaccggggtaacccgggaaggggttacccgttaaggttaacccgttttaaagtttttaacggttttttaccggttaaccgttaaaaccggtttaaccccgtaaaaaccgggttaaaccgggtaaaaccccgtttaaacgggttttaaccggggttttaaacccggtttttaaagtttaacccggggttttaacccggtttaaacccggggttaaaccggtttacgggtacccccggttaaaaccccgggtaacggtttaacccccgtaaccccggtttacccgggttacccgggggtttaccctaaccccggggtacccccggttaaaaaccccccgggg

SEQ ID NO: 66475 - DNA, 588 bp, Homo sapiens
  misc_feature: GYAE6OF01C0RD1.51.59.F04.1.454.CMB.1.raw
  modified_base (448)..(448): a, c, t, g, unknown or other
  misc_feature (448)..(448): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggatcacctgctctggagatgcattgaccaaaaccgatatgcttattggtaccagcagacgccggccaggcccctgtgttcggtagatgtaataaagacactaggagacggccctgaagggactcccgtgacgcgtattctcgtggcctccgtagggtacacgggacaacggtcactagttcggccatcgagtgcgtcgagcaagagacgaggctagtacttntttcgtagtactaattcttacagtacacgttctaaggttcgttaactttagtggtttcccgttacgggtaaccggtacggggtaaacctaacgggttacccgaaccggttacccgttacgggacccgacgaaacccccgg

SEQ ID NO: 66476 - DNA, 532 bp, Homo sapiens
  misc_feature: GYAE6OF01B04LI.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgccaaaaccgatatgcttattggtaccagcagaagccgggccaggcccctgtgttggtgattgtataaagacactgagaggcccctcgacgggatccctggacgcgtattctcgtggcctccgaggtcagggacaacgggtcactattcggcatcaggtggagtccgagcagaggacgaggctgactagttattgtacaatcaacagacacctattaggtacttagtgttcttacggaacgtgaccgtaaccgaacggttccaacccgttccgtggggtacccg

SEQ ID NO: 66477 - DNA, 636 bp, Homo sapiens
  misc_feature: GYAE6OF01CFZMU.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgccaaaaccgatatgcttattggtaccagcagagccggacacggccctgtgttggtgatgtataaagacacgtgagacggccctcgagggactcccgtagacgcgtatttctcgtggctccgaggtcgaacgggacaacgggtcaacgtagttcggaccagtaccgaggttcgggaagttcccgaagggccaagggaacgggaacggagggtaccgtggtaaccttagtttaagtttcgtaacctaattacccgaaactaacgaacctaaccgtaacgtttacggttaactttaagttccggtttacgtttaccgggtaaaccttcggaacccggtaaccctaaacgggttaccctaaccccggttccggtaccggggttaaccccg

SEQ ID NO: 66478 - DNA, 711 bp, Homo sapiens
  misc_feature: GYAE6OF01BXBL6.51.59.F04.1.454.CMB.1.raw
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgacattcgaccaaaaccgatatgtactttatggtaccagcagacgccggcacggcccctgtgttggngatgtaanaaagcactgagacgccngaggactcccgtagagcgtacttcgtcgtacggcctacgacggtacgaacgggtaaccgaaccggttacgaaccgttacgttcggaccctagtaccgtaggttacgggaccgtacgacgggagacgggaaggacggaacggtccgttagaaccgtttagtttacgtttacggtaacctaaagttcccaaacgaacgtaacccgtaaccttaaggtttacgtttaacctttagttacggtttaccgttaaccgggaacttcgggtaaaccccgtaaccgtaaacggggttccccgtaaccgggttcccggtacggggttacccaaccggtacccccggaaaacgggtacccccctaaaccccgaccgttccgtaacccgttacccgtttccccg

SEQ ID NO: 66479 - DNA, 555 bp, Homo sapiens
  misc_feature: GYAE6OF01AH21C.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtcccccaggacaggacggccaggatcacctgctctggagatgcattgcccaaaaccgatatgcttattggtaccagcagagccggccaggcccctgtgttggtgatgtaataaagacacgtgagacggccctcgagggactcccgtagacgcgtattctcgtggcctccgaggtccgagggacaacggtcacgattggcctagtcaggtggacgtccgaggcaggacggacgaggcgtagacttagttagttgtacaactacaacacgacactagttcggtactttagtgttacgttcggtaaccgtgaccgtaccgtaacggtaccacccggttccgtgggtacccg

SEQ ID NO: 66480 - DNA, 599 bp, Homo sapiens
  misc_feature: GYAE6OF01AFZFZ.51.59.F04.1.454.CMB.1.raw
  modified_base (268)..(268): a, c, t, g, unknown or other
  misc_feature (268)..(268): n is a, c, g, or t
tcagcgatcgtatacacgaccggtgctcgatttagtacacacacttagggagttgggggggagcctagctgtgctgtgggtccaggaggcagaactctgggtgtctcaccatggcctggatccctctacttcctcccctctcactctctgcacaggctctgacggcctcctatgagctgaccacacgcccaccctcggtgtcagtcgtccccaggacaggaccggccaggatccacctgctcgtggagatgctattcgaccaaaccgntatgtcttattcggtacagcagaacgccgggccaggccctgtgttggtagatagtaataaacgacacgtaggacgacggtccctacgacgggactcccgtaggacgtcgtacttcgtcgtggtacctccggaggtacgacgggaactaacggtcacgtagttcggcctagtcgaggtcggacgtccgaggacgaggtacggacgtaggctacgtacttattaacgtcgtaactaactacaacacgtaccaccgttagttacggtacttagtcgttcgtacggactcggaccgtaacgtacgtccgtaccgtccgacggtccacgaaccccg

SEQ ID NO: 66481 - DNA, 569 bp, Homo sapiens
  misc_feature: GYAE6OF01A6YZJ.51.59.F04.1.454.CMB.1.raw
  modified_base (240)..(240): a, c, t, g, unknown or other
  misc_feature (240)..(240): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgcattgaccaaaccgatatgcttattggtaccagcagaacgccggccacggcccctgtgttggtgatgtataaagactactgagacggccctacgagggactcccgtgacgcgtattctcgtcggcctccgaggtcagggacaacggtcactagttcggacctatacgagttggacgtccgaggacgagacggacgaggctagacttagttattgtacctaactacgaactacgacctaacgtattacggtactttagtcgttactacggtaactcgaccgtaacgaacgttccgaaccgttaccgtcgggtccaccggtaaccccg

SEQ ID NO: 66482 - DNA, 657 bp, Homo sapiens
  misc_feature: GYAE6OF01B0F8Q.51.59.F04.1.454.CMB.1.raw
  modified_base (180)..(180): a, c, t, g, unknown or other
  misc_feature (180)..(180): n is a, c, g, or t
  modified_base (307)..(307): a, c, t, g, unknown or other
  misc_feature (307)..(307): n is a, c, g, or t
  modified_base (359)..(359): a, c, t, g, unknown or other
  misc_feature (359)..(359): n is a, c, g, or t
  modified_base (646)..(646): a, c, t, g, unknown or other
  misc_feature (646)..(646): n is a, c, g, or t
tcagcgatcgtatacacgaccggtgctcgatttagtacacacacttagggattgggggctgtgggtccaggaggcagaactctgggtgtctcaccatggcctggatccctctacttctcccctcctcactctctgcacaggctctgaggcctctatgagctgacacagccaccctcggtntcagtcgtccccaggacagacgccaggatcacctgctctggagtatcgctattacgaccaaaacgatatgtctttagtcggtaccagccgaagaacggccggaccacggcccctggtgttacggtanagttacgtaataaaggcaacgtcgaagacggtccctgaacgggacttcccgngaacgtcgtacgttcttcgtcggactcccgaggttcgacgggaacacggtcactagttcggactagtacgaggttcggacgtcgaggacgaacggaagggtacggaacggcgtaagtaacgtttaatttacgtttcgtaacaaacgtttacaaacctaacggtaacctaacgtacgtttaacggttactttaagtcggttaacgtttacggaacctacgacgtaaccgaggttacccgtccggtacccgtacggtcccaacgtacccgaaccggacctaacccccgnttccgtacccg

SEQ ID NO: 66483 - DNA, 861 bp, Homo sapiens
  misc_feature: GYAE6OF01AKVLO.51.59.F04.1.454.CMB.1.raw
  modified_base (239)..(239): a, c, t, g, unknown or other
  misc_feature (239)..(239): n is a, c, g, or t
tcagcgatcgtatacacgaccggtgctcgatttagtacacacactttagggtagttggggcgtggggagcctacgctgtgctggtggggtccaggtacggctaggaactctgggtgtctcaccatggcctggatccctctacttcgtccccttccgtcactctctggtccacaggctcttgaggtcctcctatgacgctgacacagccgaccgtcggtgtcgagtcgtccccgaggacncgacggccaggactcacctgcctcgtggacgatcggccagttcggacccaaaacccgtataattcgctttaagttcgggtaacccagccgaaggaaacggcccggggtacccaacgggtcccccgttggttcggtttaggggtacgtaaggttagttaaagtaaaaacggccgtaacgtaggaacggttaacggtacccccgttacggaacggggtaccttaccccgtagggaacggtacgtaactttcccgtacgttcggtcccttacccggaagggttccgaacggggtaacccgtaacggggtcctaaccgttagttacccgggacctaacgtacgtaacgggtacggaaccggttaccgaacgggaaccgtaacgggtaacgggtaaccgggtaacgggtaccttaacgggtaaccctttaaagtttaacgtttaccggttaaccgtaaacgttaacccgaaacggtaacggtaacccctaaccggttaagttttacccggggttaacttttaaccgtttagggtttacccgtttaaaccgggtaaccgtttcgggaacccggtaaaccggtaacgggttacccgaaccccggttccgggttccggggttaaaccccg

SEQ ID NO: 66484 - DNA, 643 bp, Homo sapiens
  misc_feature: GYAE6OF01CMCL8.51.59.F04.1.454.CMB.1.raw
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgtcttattggtaccagcagaagccgggccacggcccctgtgttggtgatgtaataaagacacgtgagacggccctgacgggtactcccgtgacgcgtacttctcgtcggtcctccgaggtcgaacggggacgtaaccggtcactagttcggaccagtcaggtggacgtaccgaggcgaggaggacggaggtctaggtacttaatttagttcgtacaatacgaacacgaacccaaccgttagtttacggttaacttagttacgttaccgttaccggtaacttcggacccgtaacccgtaacgggttcccgtaacccgggttacccggttcgggtaacccgtaccggtaccccccgaaacgggtacccccaaaccccccgtacgttccggtaacccc

SEQ ID NO: 66485 - DNA, 591 bp, Homo sapiens
  misc_feature: GYAE6OF01B1Y33.51.59.F04.1.454.CMB.1.raw
tcagcgatcgtatacacgaccggtgctcgatttagtacacacacttagggattgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggcccctgtgttggtgatgtaataagacactgagaggccctgagggactccctgacgcgtattctctggtcctccgaggtcgaagggacaacggtcactagttcggaccatcgaggtggacgtccgaggcaaggaggacgaggctgacttattattgactaatcaacagaacctacctagttacggttacttagtcgttacgttacggaactcggaccgtaaccgtaacgggtccaacccggttccgtacggggttcccaaccggtacccccgaaacgggtcccccaaacccccgtactttcggtaccctaccgttacccg

SEQ ID NO: 66486 - DNA, 672 bp, Homo sapiens
  misc_feature: GYAE6OF01AF7E4.51.59.F04.1.454.CMB.1.raw
  modified_base (268)..(268): a, c, t, g, unknown or other
  misc_feature (268)..(268): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttcctcccctcctcactctctgcacaggctctgacggcctcctatgagctgacacacgcccacccgtcggtgtcagtcgtccccaggacaggaccggccaggactcacctgctcgtggagatgcattcgaccaaaccgnttatgtacttagttcggtaccagcgaagaacggccgggccacggtccctggtggttggtagtatagtaagtaaacgactacgtaggaggaccggtcccgtacggagggtacctcccgtagacgcgtacgttcctcgtcggcctaccggaggtcgagggacctaacggtcacgtagtcgccagtcgaggtggacgtccgaggacgaggacggacggtagctagtacttagttacgttacgtactaaagtaccaacgacgtaacctacgtttacgttaaggttacctttaacgttcggtttacccgttaagggaaccgttccggaaacccggttaacccgtaaccgggttacccccgtacccgggttacccgttacccggggtaccgaccccgggtaaacccccgg

SEQ ID NO: 66487 - DNA, 603 bp, Homo sapiens
  misc_feature: GYAE6OF01BETA0.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaccgatatgcttattggtaccagcagaagccgggccacggcccctgtgttggtgatgtaataaagacacgtgagacggccctacgagggactcccgtgagcgtattcgtcgtggcctccgagggtcgagggacaacgggtcaactacgttcggacctagtcgtaaggtggacgtaccgaggcaggaggacgaggctggacttagttagttagtactaattacaaacgaacgtaaacctagttacggttaactttagtcgtttaccgttacggaacttcggtacccgaaccgtaacggttcccgtaacccggttcccggtagggtacctaccgggaccccgtaaacccggg

SEQ ID NO: 66488 - DNA, 613 bp, Homo sapiens
  misc_feature: GYAE6OF01DE9CI.51.59.F04.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (329)..(329): a, c, t, g, unknown or other
  misc_feature (329)..(329): n is a, c, g, or t
tcagcgatcgtatacacgaccggtgctcgatttagtacacacacttagggattggggctgggggagcctagctgtgctgtgggtccaggaggcagaactctgggtgtctcaccatggcctggatccctctacttcctccccctcctcactctctgcacaggctctgaggccctcctatgagctgacacacgcccaccctcggtgtcagtcgtccccaggacagacgcaggatcactgctcgnggagntgcattcgaccaaaaccgatatgtcttagttcggtaccagcaaggaacgccgggccacggcccctggtgttggtgatgtaanaaagacactggaacgaggtcccctacgaagggtactcccgtggaagcgtacttcgtctggcctccgaggtcgaacgggaccaacgggtacacgtagttcggaccaagtcgaggtgggacgtccgaggcaggaggacgagggtctaggtacttagtttacttagtacaaagtccaaacacgaccctaactagtttacggttacttaagtcggtttaccttacgggaacttccggaacggtacccgtaaacgggttcccaacccgggtccgttacggggtaacccg

SEQ ID NO: 66489 - DNA, 632 bp, Homo sapiens
  misc_feature: GYAE6OF01DIAUS.51.59.F04.1.454.CMB.1.raw
  modified_base (294)..(294): a, c, t, g, unknown or other
  misc_feature (294)..(294): n is a, c, g, or t
  modified_base (622)..(622): a, c, t, g, unknown or other
  misc_feature (622)..(622): n is a, c, g, or t
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaacgatatgtcttattcggtaccagcagacgccggccacggccctgtgttggtnagtgtaataaagacacgtgagacggtccctacgaggactcccgtagacgcgtacttctcgtcggcctccgaggtcgaacggggactaacgggtctacgtagttcggacctagtcgaggtacgggacgtccgaggaccgtaaggaacgggacggtacggtcgtacgtaacttagtttagtttacggtactaaacgtacaaacgacgtaacctaccgttaagtttacggttaactttagttcgttacgttaccggtaactcggaccgaaccgtaacggtccctaccggttccgtacgggtaccaccgtacccgaacggacccctaacccngtcgtacccg

SEQ ID NO: 66490 - DNA, 593 bp, Homo sapiens
  misc_feature: GYAE6OF01AWU6O.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaacgccggccacggcccctgtgttggtgatgtataaagacactagagacgcctcgaggactcccgtgacgcgacttctcgtcggcctccgtaggtcgacgggaacgaacgggtcactagttcggaccaatcgaggtcggacgtccgaggtcgaggacgggacgtagggctagaacgttatttagttagtactaactacaaacgaacgactaccgtaagtttcggtactttagtcgttccgttacggaaccgttggacccgtaaccgtaacgggttacccacccggttaccgttcggggtcccaacggtaacccccgg

SEQ ID NO: 66491 - DNA, 797 bp, Homo sapiens
  misc_feature: GYAE6OF01BEEB3.51.59.F04.1.454.CMB.1.raw
tcagcgatcgtatacacgaccggtgctcgatttagtacacacacttagggattggggggggaaccgtagctgtgctgtgggtccaggaggcagaactctgggtgtctcaccatggcctggatccctctacttcctcccctctccactctctgcacgaggctctgacggcctcctatgagctagaccacacgcccacccgtcggtctcgaggtccgtaccccgaggaccaggaccggccaggactccaccgtgcctcgtggagatgctatcgaccaaccgtatactgtactttagttcggtaccagacgacggacggcccgggaccgaccgggtccccgttggttcgttgggtatagttagtaataaagactacgtagaacggaccggtacccgtacggaacggtccttacccgaggacgtcgtacgtttcgtacgtcggtcctaccggaggttaccggacgggaaccgtaacgggtacctaacgtacggttaccggaccttacggtacccgtagggtacgggtaaccgttacccggaagggtaccgaagggaacggggaccggtacgggcccgttaggtaacctttaacgtttacgttaggtaacctaaacgtaccgaaaaccgtacggaacctaacccgttaagttttaccgggtaaccttttacggttaccgtttacccggttaacgggtaccgttaaccgggtacccgtaacccggtaaccgggttacccggtaccccggtttaccgggtaacccgggttacccgaaccccgggtaccccggtaaacccccggg

SEQ ID NO: 66492 - DNA, 519 bp, Homo sapiens
  misc_feature: GYAE6OF01B1O8E.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccggccaggcccctgtgttggtgtatgtataaagacactgagaggccctcgagggatccctgagcgtattctctggctccgaggtcagggacaacggtcacattggccatcagtgagtcaggcagaggacgaggctgactatattgacaattacaacagaactacattaggtacttagttcgtactttcggaaacttggaccgtaccgaacggttccacccgttcgtggtacccg

SEQ ID NO: 66493 - DNA, 788 bp, Homo sapiens
  misc_feature: GYAE6OF01ETBU9.51.59.F04.1.454.CMB.1.raw
tcagcgatcgtatacacgaccggtgctcgatttagtacacacacttagggattgggggggggagcctagctgtgctgtgggtccaggaggcagaactctgggtgtctcaccatggcctggatcccctctacttcctccccctctcactctctgcacaggctcgtgacggccctctatgagctgaccacacgcccacccgttcggtctacgacgttcgtcccccaggaccacggaccggccaaggactcccaccgttgccttcggtaggagtatcggactacttacgaaccctaaacgtattacgttcgttactttaacggttacggtaaccgacggacgaaacggggtaaccggcccccggggaccgacccgggtccccgttagggttgggtttagggtagtaagtttaacgtaaacgtaaacgtaaccgtacgttacggaacgggtaccccggtcccgtacggaccgggtaccttacccggtaggtaccgtaccgttacgtttccgtcggtaccgtccgtacggtacggtcggacgggtaccaacggtcacgtgttccgactacgtagtaggacggtaccgtacggacggacggaacgggacggacggtacgtacgttagtaactttatttaacgttacgaacctaaacgacctaaacgaactacccgttaacgttacgtttacggttaactttagtccggtttaccggttaaccggatcccggtaaacgtaaccccgttagggttaccccaccggttacggtcgggtaaccacccgggtaaccccg

SEQ ID NO: 66494 - DNA, 869 bp, Homo sapiens
  misc_feature: GYAE6OF01ELBGM.51.59.F04.1.454.CMB.1.raw
  modified_base (234)..(234): a, c, t, g, unknown or other
  misc_feature (234)..(234): n is a, c, g, or t
  modified_base (370)..(370): a, c, t, g, unknown or other
  misc_feature (370)..(370): n is a, c, g, or t
tcagcgatcgtatacacgaccggtgctcgatttagtacacacacttagggattgggggggggagcctagctgtgctgtgggtccaggaggcagaactctggggtgtctcaccatggcctggatccctctacttctccccctcctcactctctgcacaggctctgaggcctcctatgagctgacacagccaccctcggtgtcagtcgtccccaggacagacggccaggatcaccntcgcgtgtgagatagtcactacgaccaacgtatactgtcgttactaggtaccaggacgtaacgggacgcccggggaccctacggtcccgtttaggttggtacggttaggtaattaaacggtaactaaacgtacggntaacggtaagggacccttaacggaccggtactacccgggtatcccgtacggtacgtccgttacgttcgtcctacgggtcctaccgggacgggacctaacggggtaccaaccggttacgtaccggacgttacgggtacctacggtacgggtaacggttccgggaacggtaccaagggggaccccggtaaggggaacggggtaacgttaaacggggtaacgtttaaacggttaaaccgtttagtttaaaccgttaacggttaaacccctaaaaaccggttaacccggtaaaaccgtaacccgttaaaccgtttaacccgggttaaacctttttaaacgggggttaaccctttttcgttaaacccggggttaaaccccgtttaccgggggttaaccccgtaaaccccgggttaacccggtaaaccccccggggtttaaaacccggtaccccgggttaacccccggggtttaaaccggtccccgggggtaaaaacccccccgg

SEQ ID NO: 66495 - DNA, 716 bp, Homo sapiens
  misc_feature: GYAE6OF01D8O7R.51.59.F04.1.454.CMB.1.raw
tcagcgatcgtatacacgaccggtgctcgatttagtacacacacttagggattgggggctgtgggtccaggaggcagaactctgggtgtctcaccatggcctggatccctctacttcctccccctcctcactctctgcacaggctctgaggcctcctatgagctgacacacgcccacccgtcggtgtcagtcgtccccaggacagacggccaggactccacctgctcgtggagatgctattcgaccaaacgatatgtcttagttcggtaccagcaaggaacgccggccacggcccctggttcgtggtgtatgtaataagacagtgagacggcctcgaggtactcccgtgacgcgtacttctacgtcgtcctcggtacggtacgaacgggtaaccgaacggtacctacgtagttccgactacgtacggtaggtacggtacgtaccggaggtacgaagggtacgggaacggcggtacgtacggtaacctttatttagttcgtaactaacgtaacaaacgtaactaaccgaaccgttaggtttaacggtttaactttacgttacggttaccgttaaccgggtaaccgttacgacccgggtaaaccgttaaccgggttaccccggttaacccgggttcccggttacggggttaaccccaacccgggtaccccggaaaccccggtaaccccctaaccccgttacgtcccggttaacccccg

SEQ ID NO: 66496 - DNA, 559 bp, Homo sapiens
  misc_feature: GYAE6OF01A0IU0.51.59.F04.1.454.CMB.1.raw
  modified_base (342)..(342): a, c, t, g, unknown or other
  misc_feature (342)..(342): n is a, c, g, or t
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaaccgatatgcttattggtaccagcagaagccgggccaggcccctgtgttggtgatgtataaagacactgagaggccctagagggatccctgagcgattctcnggctccgaggtcagggacaacggtcacagttcggccagtcaggtcggacgtccgaggcgaggaaggacgaggctagactattattgtacatacaacagacacctattcggtacttagtcgttcgttacggtactcggccgaaccgtaacggtaccctacccggttccgtacgggtccacggacccctaacggacccctaacccctccgtcgtacccg

SEQ ID NO: 66497 - DNA, 758 bp, Homo sapiens
  misc_feature: GYAE6OF01BF9WZ.51.59.F04.1.454.CMB.1.raw
  modified_base (203)..(203): a, c, t, g, unknown or other
  misc_feature (203)..(203): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttcctccccctcctcactctctgcacaggctctgaggcctcctatgagctgacacacgccctaccgtcggtntcacgtcgtaccccgaaggacaacggaccggaccaagggtactccgaccgtgtccgttcgtagggaacgagttcgactaacgttcgaacccaaaaccgtaagttaacgttacgttacgtttaacgttacggtacccgaggtaccgaacggaaccgggccccgggaccgaccgggtcccgttggttacggttggtagtacgtagtaaacgtaacgtaacgtacgtacggaacggaccggtccctacggacggtacgtacccgtaggaccgtacgttacgttccgtacggttcggtacccgttaccggtacggtaccggaacgggtacccgttaacggtacctaacgttacggttcgaccgttaacgtacgaacggttacgggtaccgtacggaggacgtaacgggacggtacggacgtacgtagtactttagttagtacgtactactaacgaacgtaccgaacgtaccgttagttacgttacgttcgtacgtttacgtacgtaacgtcggtaaccgaaccgttacgggtacctccgggttaccgtcggtaacccgg

SEQ ID NO: 66498 - DNA, 714 bp, Homo sapiens
  misc_feature: GYAE6OF01DB2V3.51.59.F04.1.454.CMB.1.raw
  modified_base (243)..(243): a, c, t, g, unknown or other
  misc_feature (243)..(243): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttctccccctcctcactctctgcacaggctctgaggcctctatgagctgacacagcccaccctcggtgtcagtcgtccccaggacagaccggccaggatccacctgctctgganatgcattcgaccaaaccgatatgtcttattacggtaccagcaggaacgccgggaccacggccctgtgtggtgtatgtaataagacacgtgagcggaccctgacgggtacctcccgtgacggtacgtacttccgtacgtcgggtcctaccggtaaggtaccggaacggggtaaccgtaaccgggtaccaaccgtaacgtttccgggaaccctaagtacgtaacgggttacgggaccgttacccggaagggacccgtaaagggaaccgggaaccggtagggtacccgttaggttaaccttaagttttaacgtacggttaactaaaccgtaccaaaccgtaacgtaacctaaccgttaacgtttacggttactttagtccgtttaacgttaccgggtaactccggaaccgtaaacccgaacgggttaccctaacccggttacccggttacgggtccgtaaccggtaacccccgg

SEQ ID NO: 66499 - DNA, 760 bp, Homo sapiens
  misc_feature: GYAE6OF01CTDKG.51.59.F04.1.454.CMB.1.raw
  modified_base (128)..(128): a, c, t, g, unknown or other
  misc_feature (128)..(128): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctntacttctcccccctcctcacctctctcgcacgaggtccttcgtaggacggtcccttacctagtggagtcctagaaccacgacgcccctacccgtggtcgtacgagttcccgtaccccgaaggacacgggaccggccgaggtactccacgtgtctcggtggaagtatcggactaagttccgaaacccgaaaaccgtattaactcgttactttaagttacggtaaccgagacgaaggaaccggcccgggtaccgaccggtccccgtggtttggttggtagtagtaagttaaagtaaacgaacacgtacggacggtaccggtacccctagggacgggtaccctcccgtaggacgtacgtactttcgtcgtcggtaccttacggacggtacgggaacggtaacgtaccggtaacaacgttcggttacggacctacgtacgtaggttacggacgtaccggaggacggaacggacggggaacgacgggtacgtacgttaacgtttaagtttagttacgtaactaataacccgaacgacgtaaacccacttaagttccgttaacgtttagtcgtttacgttacggaaccgtggtaaccgtaacccgaaaggttcccgtacccggtggttaccggacccg

SEQ ID NO: 66500 - DNA, 789 bp, Homo sapiens
  misc_feature: GYAE6OF01DB4T5.51.59.F04.1.454.CMB.1.raw
  modified_base (107)..(107): a, c, t, g, unknown or other
  misc_feature (107)..(107): n is a, c, g, or t
  modified_base (195)..(195): a, c, t, g, unknown or other
  misc_feature (195)..(195): n is a, c, g, or t
  modified_base (262)..(262): a, c, t, g, unknown or other
  misc_feature (262)..(262): n is a, c, g, or t
  modified_base (409)..(409): a, c, t, g, unknown or other
  misc_feature (409)..(409): n is a, c, g, or t
  modified_base (453)..(453): a, c, t, g, unknown or other
  misc_feature (453)..(453): n is a, c, g, or t
tcagcgatcgtatacacgaccggtgctcgatttagtacacacacttagggagttggggggggagcctagctgtgctgtgggtccaggaggcagaactctgggtgtcncaccatggcctggactccctctacttcctcccctcctcactctctgcacaggctctggacgcctcctatgacgcagacacacgacccncccgtcggtgtcagtccgtaccccgaaggacacggacggccaggtactccaccgtcgcttcgagganagtcgacgtagttaccgaacccgaaaccgtattaacgtcgtacgtttacgtttacgggtaaccacgacgaaccgggaaccgggcccgggaccgtacccggtacccgttggttcgggttaggtgtaagttaagtaaactaaccggtanaccggtagacggaccgccgtacggacgtaccgtcgagtaacggngttacctcgtcgtcgtccctacggtacggtaacggtaacgggtaacgtaacccggtctaacggttacgtacggtactaaggtacggacgggttacggaccgtaaccggaagggacgaacggacgggtaaccggtacggtacgtaaccgttacggtttactttaacggtcgtaaacgtaaccgtaaacctaacgaacccgttaaacgaccgtttaattacgggttttaaacgttaaacgttcgggtttacccggttaaggaccctagggaaccccgttacggtaaacccgttcggtaaccccgttaccggggttaccgtacggaccccgaaccccgg

SEQ ID NO: 66501 - DNA, 641 bp, Homo sapiens
  misc_feature: GYAE6OF01A3N90.51.59.F04.1.454.CMB.1.raw
  modified_base (200)..(200): a, c, t, g, unknown or other
  misc_feature (200)..(200): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacacgccaccctcggtntcagtcgtccccaggacaggacggccaggtactcacctgctcgtggaagatgcattcgacccaaaccgataatgcttatggtaccagcaagaacgccgggccacggtcccctggttacggttgggtagtagtagtaagtaaaagacacgtagaacggaacggtccccgtacggaacgggtacctcccgtaggacgtacgtcttccgtacgtcggcctacgacggttacgaaggaccgaacggtcaacgtacgtcggacctactcgaggtggacgtccgaggcgtaaggaggacggagtcgtaagtacgttagttaagtacgtactaacttaccgaacgtacaaccgtacctagttacgttaaaccgttgttacggttacgttaccgtacgtacggacccgtaacggtacggttacccgcccggttcgtccgggtaacccgg

SEQ ID NO: 66502 - DNA, 658 bp, Homo sapiens
  misc_feature: GYAE6OF01AYEIK.51.59.F04.1.454.CMB.1.raw
  modified_base (376)..(376): a, c, t, g, unknown or other
  misc_feature (376)..(376): n is a, c, g, or t
tcagcgatcgtatacacgaccggtgctcgatttagtacacacacttagggattggggggggagcctagctgtgctgtgggtccaggaggcagaactctgggtgtctcaccatggcctggatcccctctacttcctccccctcctcactctctgcacaggctctgaggcctcctatgagctgacacagccaccctcggtgtcagtcgtccccaggacacgacggccaggatcacctgctcgtaggagatgcattcgaccaaaccgatatgtcttacgttggtaccagcagaacggccgggccgacggccccgtggtggttgggtgtacgtagtaagtaaagacactggaaggacggtcctacggaagggtactccgnggagcgtattccgtctcgggcctaccgtaggtaccgaacgggtaacgaaccggtctaacgagttacggccagtacgaggtgggacgtaccgaacggtcgaaggacgggacggtacggcgtagaacttagttattacgtactaactaccaacgaacgaaccgtaaccgttagttacggttaacttagttaccggttaccgttaccgggtacgtacggtaccggaaaccgttacgggtaccctaacccgggtaccgttacgggtaccgtaccgtaacccccggg

SEQ ID NO: 66503 - DNA, 804 bp, Homo sapiens
  misc_feature: GYAE6OF01CCXAJ.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttcctccccctcctcactctctgcacaggctctgacggccctcctatgagctagacacacgcccctaccgtccggtgttaccgaggttccgtccccgaagacgaaggaccggaccgaggactccaccgtcgtacgtacgtaggggaatcgtcggtacctattaccggaacccaaaaccggtataagtacgtaacgttacgttttacggtaccgaacggaccgaaacgggtaacggacccggggacccaccgggtcccccgtagggttggtttagggtcgtaaaggttagtaaacgttaaaacgaacgtaacgtacggaaccggtaaccggtacccggtacgtaacgggtaaccgttccccgaggtaacgtacgtacgttcctcgtacggtacctccggtacggtacgaaccgggtaacgtaccggtaacgtaaccgtacgtccgggtaaccaggttacacgggtcggtaacgtcggaacgcggtaacggaaggtacggacgacggttagtaaccttagtttaaacgttacgtaacaacgttaacacgaaccggtaaacgtaccttaagttacgtaagtttaaccggttgttaacccggtaaccggtaagtaccggtaacccggtaaccgtaaacggttccccggttaaaccgtccggggtttgtaaaccccgg

SEQ ID NO: 66504 - DNA, 856 bp, Homo sapiens
  misc_feature: GYAE6OF01DSW4V.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttcctccccctcctcactctctgcacaggctctgaggcctcctatgagctgacacacgcccacccgtcggtgtcagtcgtccccaggacacggacggccaggactccacctgctcgtggagatgctattcgacccaaaccgtattactgtactttagttcggtaccaggtacgaaggaaccggcccggggcccgaccgggtcccccgttggttcggtttcgggtagtagttagtaaacgtaaaacgaccgtaacgtaggaacggaccggtccctacggagggtaccttcccgtaggacgtcgtacttccgtcgtggtcctaccgaggtacgaggaccgacgtacgacgtacgtcggactaacgtcgaggtacgggacgtccggaacggtccgaagggacggtaacgggtacggtaccgtaaggtaaccgtttaagttttaacgtttacggtaaacctttaaaccgtaacccgtaaaccggtaaaccgtaaaccccgttaaccgttaaaccgggtttttaaacgggttttaaccccggtttttaaacggttttacccgggttttaaacccccgggtttttaaacccggggttaaaacccggtttaccccggggtaaaccccgggtttaaaaacccccccgggttaaaccgggttttaccccccgggggtttaaacccccccggttttcccggggggtaaccccggggttttaaaacccccccgggg

SEQ ID NO: 66505 - DNA, 681 bp, Homo sapiens
  misc_feature: GYAE6OF01EQ4V5.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttcctccccctctcactctctgcacaggctctgagcctcctatgagctgacacagcccacccgtggtgtcagtcgtccccaggacagacggccaggactccacctgctcgtggagatgactattcgaacccaaaaccgtattactgtactttagttacggtaaccacggacgaaggaacggcccgggaccgacggtccccgtggttcggttgggtagtacgtagtaaataaacgactacgtaggacgtacgacccgtcgaacgggtactccgtaggacgtaccgtagtttccgtcggttcgaccgtaccggtacgggtacggtaacgggtaaccgtaaccggtacgtacgtacggttacgacctagtacgtaggtacggtaccgtaccggaacggtacgaggaacgggaagcggtacgtaggtaacttatttagttacgtaacctaataccgaacgaccgaacgtacctagttacggttacgttagttcggttacgttacggaaccgttcgacccgttaacgacgtacgcccgttacggtcggtaacccg

SEQ ID NO: 66506 - DNA, 637 bp, Homo sapiens
  misc_feature: GYAE6OF01DZ1V0.51.59.F04.1.454.CMB.1.raw
  modified_base (104)..(104): a, c, t, g, unknown or other
  misc_feature (104)..(104): n is a, c, g, or t
  modified_base (254)..(254): a, c, t, g, unknown or other
  misc_feature (254)..(254): n is a, c, g, or t
tcagcgatcgtatacacgaccggtgctcgatttagtacacacacttagggattgggggggggagcctagctgtgctgtgggtccaggaggcagaactctgggtntctcaccatggcctggatccctctacttcctccccctcctcactctctgcacaggctctgaggcctctatgagctgacacacgcccacccgtcggtgtcaggtcgtaccccaggacaggaccggccgaggactccacctgctcgtagganatcgacattacgaccaaaccgatatgtacttagttcggtaccagcaggaacggccgggccgaccggtccccgtggttcggttggtagtagtagtaagaaacgacacgtaggacgacggtcccgtacggacggactacccgtgacgtacgtacttcctcgtcggtcctaccgtacggtacgaacgggtacctaacgggtaccacgtacgttccggactacgtgtacggtggacgtaccgagggacagggacggacggaggctagtacttagttatcgtataactacaacgacgacctacgttagttacgttagttacttcggttactaacggtacgtcggaccgtaaccgacgtccctaccggtcgtcggtccaccgtaacccg

SEQ ID NO: 66507 - DNA, 672 bp, Homo sapiens
  misc_feature: GYAE6OF01CP7UT.51.59.F04.1.454.CMB.1.raw
  modified_base (103)..(103): a, c, t, g, unknown or other
  misc_feature (103)..(103): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
tcagcgatcgtatacacgaccggtgctcgatttagtacacacacttagggattggggggggagcctagctgtgctgtgggtccaggaggcagaactctgggtntctcaccatggcctggatccctctacttctccccctcctcactctctgcacaggctctgaggcctcctatgagctgacacacgcccaccctcggtgtcagtcgtccccaggacacggacggccaggactccacctgctcgtggantgcattcgaccaaacgntagtgtacttagttcggtaaccagcgaaggaaccggcccgggaccgaccggtccccgtggttcggttgggtcgtaagttagtaaagtaaaacggactacgtaggaacggtaccggtacccgtacggaacgggtaccttcccggtaggacggtcgttaacttccgtccgtcggtcccgttcccggaacgggttcggaacgggaaccgtaaccggtcctacgtagttacggactagtcggaagtcggacgtccgaggaccgtaggaggacgaggtctagtacttaattacgttacgaactactaccaactaacgtacctaacgtagttaccgtaacttgtcgttacgttacggaacgttcgaccgtaaccgacggttccctacccggttgacggtccgacgtaaccccg

SEQ ID NO: 66508 - DNA, 735 bp, Homo sapiens
  misc_feature: GYAE6OF01C0MQT.51.59.F04.1.454.CMB.1.raw
  modified_base (63)..(63): a, c, t, g, unknown or other
  misc_feature (63)..(63): n is a, c, g, or t
  modified_base (248)..(248): a, c, t, g, unknown or other
  misc_feature (248)..(248): n is a, c, g, or t
tcagcgatcgtatacacgaccggtgctcgatttagtacacacacttagggattggggggggancctagctgtgctggtgggtccaggaggcagaactctgggtgtctcaccatggcctggatcccctctacttcctccccctcctcactctctgcacaggctctgacggccctcctatgagctagacacacgcccaccgtcggtgtcagtccgcccaggacagcggccagatcacctgctcgtagganagtgactattacgaaccaaaccgtaataagtcggtactttaagttccgggtaaccaggaaccgaacggaaacgggccccccggggtaccaaccgggtccccgttaggttacggtttgggtagtaagtacgttaaaataaaacggactacgtaaggaacggtacggtaccccgtaggaacgggtacttacccgtaggacgtacgtaacgtttccgtcgttacggccgtaccgaacggtacgaacgggaacgtaaccggtacacgtacgttcggaaccagtcgtaaggtacggattacccgagggacgaaggtacggaacggtcggtagtaacgtaacgttaattacgttacgactaaaccgtaacaaacgacgtaaccaccgtaagtttacggtaaacttttagcgtttaaaccgtacgggtaactcggacccgtaagtaacccgtccggtaacccggttcgtcgggtaaccaccggtaaacccccgg

SEQ ID NO: 66509 - DNA, 678 bp, Homo sapiens
  misc_feature: GYAE6OF01B4AWW.51.59.F04.1.454.CMB.1.raw
  modified_base (232)..(232): a, c, t, g, unknown or other
  misc_feature (232)..(232): n is a, c, g, or t
tcagcgatcgtatacacgaccggtgctcgatttagtacacacacttagggattgggggctgtgggtccaggaggcagaactctgggtgtctcaccatggcctggatccctctacttcctccccctcctcactctctgcacaggctctgaggcctcctatgagctgacacagcccaccctggtgtcagtcgtccccaggacacggacggccaggactcaccctgctcgtgganatgctattcggaacccaaaaccgattatgtacttacgttggtacccagtacaacggaacggcccgggccacggtcccccgtggttcggttggtagtatagtaataaacgacacgtagacggacgcccgtagacggtactcccgagtacgcgtacttcgtcgtcggtacgtcgaaggtccggaagggaccgtaaccgggtacacgtaacgtcgacctatacggtacggttcggaaccggttccgagggtacgagggaacggaccggagggtctagtactttatacgttgtaactactaacgtaacgaacgtacctaaccgtagtttacgttaacgttacgttacgttacgttaccggtactacgtacgtaaccggacggttacgtaccccggtcgtacgggtacccacgtaacccccggaacgaccccaacccctcgtacgtccccg

SEQ ID NO: 66510 - DNA, 738 bp, Homo sapiens
  misc_feature: GYAE6OF01AMZ0W.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatgcctggatccctctacttcctccccctcctcactctctgcacaggctctgacggcctcctatgacgctgacacacgcccaccctcggtcgtcacgtcgtcccccgaggacaggacggccaggatccacctgctctggacgatgcattcgacccaaaccgattaatgtactttattggaccacgtacagaaccggccggccaacggtccccgtggttcggttgggttacgtaacgttaggttaaacgtaaaacgtacctaaccgttcgggaacggtaccggtcccccgtacggtaacggggaccgtttacccccgagggtaccggtaccgtaacgttttacccgtcggttaaccggttcccgtacccggtagggtacccggaacgggtaaccgaaaccggttccgtaacgtacgttacggacctacgtacgtaggtcgggaccgttacggacgaccgtagggtaacggacgaggtacgtcgtaacgttacttattcgactacgtaacacgaacacgtaacgttacgttacgtaactttcgttaggttaccgttaccggtacgtaaccgtaaccggtaacccgttaacggttacccgtacccgttcccggttacggtaaccccggg

SEQ ID NO: 66511 - DNA, 735 bp, Homo sapiens
  misc_feature: GYAE6OF01CWVZF.51.59.F04.1.454.CMB.1.raw
  modified_base (252)..(252): a, c, t, g, unknown or other
  misc_feature (252)..(252): n is a, c, g, or t
  modified_base (385)..(385): a, c, t, g, unknown or other
  misc_feature (385)..(385): n is a, c, g, or t
tcagcgatcgtatacacgaccggtgctcgatttagtacacacacttagggattgggggctgtgggtccaggaggcagaactctgggtgtctcaccatggcctggatccctctacttcctcccccctcctcactctctgcacaggctctgacggcctcctatgagctgaccacacgcccacccgtcggtgtccaggtccgtcccccgaagggaccaaggtccggaccgaaggactccacctcgctcgtagganatgtcattccgaccaacgatagtgtacttagttcgactgacaagacggtccggccacggtcccctggtcgttggtacgtagtagtaataaacgactacggtgtacggacggtcccgtagacggtacctaccgnggtaccgtcgttacgttccgtacgtcgtacctacggtacggtgaacgggacctaccggtactactcgttacgcctacgtacgagggtacggtacggtaccgagggacaaggggtaacggacggtacggaacgttacggttaattacgtttacgtacgtaccgtaaacggtaaccctaacggaaaccgttaccctaacggtttaccggtttaacggttacttttaccgtaggtttaccggtaaccgtccggtaaccgaacccggtaccgtaacggtcccgttacccgttcgggtacccggacccaccggtaccccaaacccggtacccctaacccgtggttccctaacccg

SEQ ID NO: 66512 - DNA, 767 bp, Homo sapiens
  misc_feature: GYAE6OF01AW9WG.51.59.F04.1.454.CMB.1.raw
  modified_base (260)..(260): a, c, t, g, unknown or other
  misc_feature (260)..(260): n is a, c, g, or t
tcagcgatcgtatacacgaccggtgctcgatttagtacacacacttagggattgggggctggggagcctagctgtgctgtgggtccaggaggcagaactctgggtgtctcaccatggcctggactccctctacttcctccccctcctcactctctgcacaggctctgacggccctcctagtgagctgaccacacgcccacccgtcggtgtcagtcgtccccgaggacacggacggccaggactcaccgtgcttcgtgganagtgactacgttacgaccctaaaccgtatacgtcgtactttagttacggtaaccgtaagacgaacggaacgggccccgggacccgtaccggtccccgttggttcggtttacgggtagtagttagttaaacgtaaacgaccgtacgtacggacggtaccggacccgtacgtaacgggtacctccggtaggacgtacgttacgtttaccgtcgttccggtacctaccggtaacgggtaccggaacgggtaaccgtaaccggtacctaacggtacggttaccggtaccgtacgtacgtacggtacgggtaccgtccggaacggacgacgggtaacgggacggtaccggtacgtacgtaactttacgttacgtttacgtactaaccgtaacgaacgtaacgtaccgtaaccgttgttaacgggttacctttacggttacttaccggttacgtaccgtacgtaccggtaaacccggtaccgtacccggtacggttcccggtaggtaccccgg

SEQ ID NO: 66513 - DNA, 676 bp, Homo sapiens
  misc_feature: GYAE6OF01D4BOW.51.59.F04.1.454.CMB.1.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
tcagcgatcgtatacacgaccggtgctcgatttagtacacacacttagggattggggctggggagcctagctgtgctgtgggtccagggaggcagaactctgggtgtctcaccatggcctggactccctctacttcctccccctcctcactctctgcacaggctctgagcctcctatgagctgacacacgcccacccgtcggtgtcagtccgtccccgaaggacaggaccggccaaggntccacctgctcgtagganatgctagttcgaccaaacgatatgtactttatcggtaccagacgaaggaacggcccgggaccgaccggtccccgtggttggttggtgtagtagtaaagtaaacgacgtacgtggaagacggcctacgagggacctccgtagacgtcgtacttaccgtcgtcggtcctcgacgggtacgaacggggaaccaacggttacacgtacgttcgaccgtatcgaggtcggacgtcgacggcgaggacgggacgacggtacgtgtaacttagtttacgttacgtaacaactaccgaacgaaccgaacctaaccgttacgttaacggtttactttaacggttacggttaccggtttaacggaaccgttacgaacccggtaaccgtaacgggtacccgtacccgggttcccggttcgggtaaccccg

SEQ ID NO: 66514 - DNA, 665 bp, Homo sapiens
  misc_feature: GYAE6OF01B3IKV.51.59.F04.1.454.CMB.1.raw
  modified_base (240)..(240): a, c, t, g, unknown or other
  misc_feature (240)..(240): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttcctccccctcctcactctctgcacaggctctgaggcctcctatgagctgacacacgcccaccctcggtgtcagtcgtcccaggacaggacgcaggatcactgctcgnggagatgctattcgaccaaaaccgtatagtgtactttatggtaccagcaaggaacgcccgggccacggtcccctggtaggtttggtagtaagttagtaagtaaaagacgactggagacggtccttacgagggtactcccgtgacgtcgtatttcctcgtggtccctaccgacctacgaaggacaagtcggtaccatacttacgaacctagtacgtagtcggaacgtccgaagggacaaacggtaaggaccggacggtcgtaaggtacctttagttttaccgtacggttaactaactttcccgttaacgagtaacctaattcgaacggtttacgggtttaatttacgtgggtttacccgttaccgggttaaacggttcgggaaacccgttaacgggcccttaaacccgggtccgtttaacccgggg

SEQ ID NO: 66515 - DNA, 657 bp, Homo sapiens
  misc_feature: GYAE6OF01BMPJD.51.59.F04.1.454.CMB.1.raw
  modified_base (462)..(462): a, c, t, g, unknown or other
  misc_feature (462)..(462): n is a, c, g, or t
  modified_base (477)..(477): a, c, t, g, unknown or other
  misc_feature (477)..(477): n is a, c, g, or t
  modified_base (526)..(526): a, c, t, g, unknown or other
  misc_feature (526)..(526): n is a, c, g, or t
  modified_base (576)..(576): a, c, t, g, unknown or other
  misc_feature (576)..(576): n is a, c, g, or t
tcagcgatcgtatacacgaccggtgctcgatttagtacacacacttagggattgggggctgtgggtccaggaggcagaactctgggtgtctcaccatggcctggatccctctacttcctccccctcctcactctctgcacaggtctctgacggcctcctatgacgctagacacacgcccacccgttcggtagtcaaggtccgtaccccgaggacacggaccggcccgaggtactccacctgcctcggtaggagataggtaacttcgaaccctaaaacgatacttgtactttaagtacggtaccagacgaggaaccggtcccgggaccgtaccggccccgttaggttggttcgggtataagtacggttaaataaacgacctagtaggacgtaccggacccgtagacgggttaccctctacggacgtcgtacttcgcgtagccgtcgtaacggcggaggactancaacgtgtacgaccntacgaggtcgacgcgtagacggagacggagacggtctagttacgtattntacgtatacaacacgacgactacgtagttacggtattgtacgttcgtacngtacgacgtaaccgagtcccgtacgtacggtcgaccgaacccggtaccgacccggacctacccgaccttcgaccgttcccg

SEQ ID NO: 66516 - DNA, 655 bp, Homo sapiens
  misc_feature: GYAE6OF01EFCE4.51.59.F04.1.454.CMB.1.raw
  modified_base (176)..(176): a, c, t, g, unknown or other
  misc_feature (176)..(176): n is a, c, g, or t
  modified_base (186)..(186): a, c, t, g, unknown or other
  misc_feature (186)..(186): n is a, c, g, or t
  modified_base (199)..(199): a, c, t, g, unknown or other
  misc_feature (199)..(199): n is a, c, g, or t
  modified_base (245)..(245): a, c, t, g, unknown or other
  misc_feature (245)..(245): n is a, c, g, or t
  modified_base (394)..(394): a, c, t, g, unknown or other
  misc_feature (394)..(394): n is a, c, g, or t
  modified_base (488)..(488): a, c, t, g, unknown or other
  misc_feature (488)..(488): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttcctcccctctcactctctgcacaggctctgacgcctcctatgngactgacacncgccaccctcggngtcagtcgtccccaggaccagacgccagctcaccgtgctcgtgganatgctattcgaccaaaccgatatgtcttaagttcggtacctagcgaagaacggtcccgggacgtacggcccgttaggtgttacggtgtattagtaagtaagactagtgacggacgcccttaggaggttccaccgtgacggtgtacttcngttcggacctccgaggtacgacgggtaacacggtaccacgtacgttcggactacgtacgacgttagggcctacggacggagaaggacggacggnggtactacggtacttaagttacgttagtaccgtaaataccaaccgaaggaaccctaacgttacgttaacggtttacccgttaattacgggtttaccttaaccgggacttacgggaacccgtacggtaaacgtccccgaaaccgggttcccggtaaggggttaacccc

SEQ ID NO: 66517 - DNA, 725 bp, Homo sapiens
  misc_feature: GYAE6OF01D7YBT.51.59.F04.1.454.CMB.1.raw
tcagcgatcgtatacacgaccggtgctcgatttagtacacacacttagggattgggggctgtgggtccaggaggcagaactctgggtgtctcaccatggcctggatccctctacttctccccctctcactctctgcacaggctctgaggcctctatgagctgacacagcccacccgtggtgtcagtcgtccccgaggacagaccggccaggatccacctgcctcgtggacatcgactagttcgacccgaaaacgtattaagttgtacttttaagttcgggtaacccagaccaaaggaaccggcccggggaccaacgggtcccccttgggttcggtttcgggtagtaactttaggtaaactaaaacggactacgttaggaacggtaaccggtcccgttacggacgggtaaccttcccgtaggaccgcgttactttctacgtcggtccttacggacgggttcgaacgggtacctaacgggtcaacgttcggttacggacctagttacgtacgggttcggacgtccggaaggaccgaagggaacggacggagcgttaaggtacttagtttacgtcgtaacgaacttacaaacgtacgtaacctaccgttagttttacggtaacttagttacgttacgttaccggtattcggtacgtaaccgtacggttcccgtacggtccgtgggtaaccaccgtacccgaaacggccccaaccgtgtccggtaaccc

SEQ ID NO: 66518 - DNA, 1060 bp, Homo sapiens
  misc_feature: GYAE6OF01EOAQE.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttcctccccctcctcactctctgcacaggctctgacgcctcctatcgagctgacacacgccctacccgtggtcgtcgacgtccgtccccgaaggaccgacggaccggtcccaagggtacttacccacccgtgtaccttcggtaggggaagtatcggacctacgtttacggaacccgaaaacccgtaattaacgttacgtccgtttttaacgttaccgggttaaccaaggtaacccgaaacgggaaaccggggccccggggtacccggtacccggggtcccccgtttagggttcgggttttacgggtacgtaatttaacggttaaaagtaaaacggtaaccgtaacgttacgggtaaccgggaaccggtacccccgtaacgggtaacgggtaacccgtccccgttacggaaccggtaccgttaacgttttcccggtaccgtcgggttaccccgttaccggggtaacgggttacccggaacgggggtaaacccccgttaaaccgggtaccgttaaaccggttaacccgtttccgggaaacccttacgggttaaccgggtaaccgggttaacgggtaccccgggttaaacccgggaacgggtaacccgggtaaaggggaaccggggtaaacccgggtaacgggtaccggttaaacgttaaacggttttaacgttttaacggtttaacggtaaaccttaaaaaccgttacccggaaacgtaaacccgttaacccggttaaacccgttttaacttttaaaccgggggttaaccttttttaaaccgggttaagggttttaaaccccggtttaacggggtttaaacccccggttaagggtaaacccccccggtttaaaacggggtaaccccgggttttaaaccccggttaaccccccggggttttaccgggttaacccgggggtaaaccccccggg

SEQ ID NO: 66519 - DNA, 758 bp, Homo sapiens
  misc_feature: GYAE6OF01ECF0X.51.59.F04.1.454.CMB.1.raw
  modified_base (102)..(102): a, c, t, g, unknown or other
  misc_feature (102)..(102): n is a, c, g, or t
  modified_base (201)..(201): a, c, t, g, unknown or other
  misc_feature (201)..(201): n is a, c, g, or t
  modified_base (734)..(734): a, c, t, g, unknown or other
  misc_feature (734)..(734): n is a, c, g, or t
tcagcgatcgtatacacgaccggtgctcgatttagtacacacacttagggattggggggggagcctagctgtgctgtgggccaggaggcagaactctgggtntctcacatggcctggactccctctactcctccccctcctcactctctgcacaggctcgtgacgcctactatgagctagacacgcgccctacccgtggtntacacggtccgtaccccaaggaaccacggacccgacgaaaggtctacccgacccttagccctttgtagggataggtccgaacgttacgttacggaacccctaaaaccgtacgttattcggtactttaaggtaacggtaaccaaggtacgaaccggaaccggtccccggaccgtaacccggtcccgttaggtcggtttagtagtagtagttaaagtaaacgactacggtaagtaccggaccggtacccgtaggaacggttcctacccggtagaccgttacgttaccttaccgtcgttaccgtacccgtacccggtaagggtaccggaaacgtaaccggaacggttaacctaaccggtcgtacggacctacgtacggaagtcgtacgtaccgagggtacgagggacgacggacgtcgtagtactttagttactacggtacaacgtacaacgacaactaacgtagttattaccggttagtacgtccggttaagacctccggtaaccgcggtaaaccggttcccaccgggtttaacnccgggtacaacccccggtaacccg

SEQ ID NO: 66520 - DNA, 694 bp, Homo sapiens
  misc_feature: GYAE6OF01D2OPH.51.59.F04.1.454.CMB.1.raw
  modified_base (187)..(187): a, c, t, g, unknown or other
  misc_feature (187)..(187): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
tcagcgatcgtatacacgaccggtgctcgatttagtacacacacttagggattgggggggggagcctagctgtgctgtgggtccaggaggcagaactctgggtgtctcaccatggcctggactccctctacttctccccctcctcactctctgcacaggctctgaggccctcctatgagctgacacncgccacccgtggtntcagtcgcccaggacaggacgcaganccactgctgngganatgctattcgaccaaaccgatagtgtacttagtcggtaccagacgaagaacggccgggaccgacgggtcccgtggttcggttgggtagtagtagtaaataaacggactacgtaggacggacggtcccgtaggaacgggtctcccgtaggacgacgttacttccgtcgtcggcctacgacgggtcgaacgggacgtaacgtccgactcgtcgaccgtatcgaggtgacgtcgacggacgacggacggaggtcggtacgtaggtacttaagtttacgttacgtaaacgtaactaaccgaaactaacgacctaaccgttacggttttaccggtaaacttttacggttacggtttaccggttaccgggtaacgttcgggaacccgttaacggtaaacccggttccccggtaacccggttcccggttaccgggtaccgaaccccgggtaaacccccgg

SEQ ID NO: 66521 - DNA, 812 bp, Homo sapiens
  misc_feature: GYAE6OF01BMBKD.51.59.F04.1.454.CMB.1.raw
  modified_base (134)..(134): a, c, t, g, unknown or other
  misc_feature (134)..(134): n is a, c, g, or t
  modified_base (400)..(400): a, c, t, g, unknown or other
  misc_feature (400)..(400): n is a, c, g, or t
  modified_base (437)..(437): a, c, t, g, unknown or other
  misc_feature (437)..(437): n is a, c, g, or t
  modified_base (516)..(516): a, c, t, g, unknown or other
  misc_feature (516)..(516): n is a, c, g, or t
tcagcgatcgtatacacgaccggtgctcgatttagtacacacacttagggattggggggtgggtccaggaggcagagctctgggaatctcaccatggcctggacccctctcctgcctccccctcctcactttcngacacagtctctgacggcctctagtcgagtctaggacacacgaccctacctcgagtcgtactgtcgtccaccggaaggaaccgaaaaccggacctaaaggtactacccgtacgttcgttaccggtttagggaacgtacgtcggtaccgttaacggaaacctaaaaaggtactttcggtacttttacggtttcgactaacgtacgaggaccgtacggccggaccgtacggtaccgtagttacgttcgtatacgttatcggtacgganacccaacgtaccggacccgtacccgtagtactaccgnggttaaggacgtcctacggtcgtcgaccgtacgtacgggtgaacggtctaacggggtccctaccgtatacgttaacctnaccgtacgggtacgaaccgtggtacggacggtacgtaacggtaggtacctaacggtaccctaagttacgttaggttacacggtaacgtaacgagtacgggtaagttaggggttcgttaccggggtacggggttaaccgggttacgggggaccgggttaacggggaacgggtaccgttagggtaacccggtccggtaaccgggttctaacggggtacccctaagggacccgtaccggtccggtaccccgcccggttacgtaccgtcccgttccgttaccccgttccgttaccccccg

SEQ ID NO: 66522 - DNA, 763 bp, Homo sapiens
  misc_feature: GYAE6OF01BL5O4.51.59.F04.1.454.CMB.1.raw
  modified_base (103)..(103): a, c, t, g, unknown or other
  misc_feature (103)..(103): n is a, c, g, or t
  modified_base (185)..(185): a, c, t, g, unknown or other
  misc_feature (185)..(185): n is a, c, g, or t
tcagcgatcgtatacacgaccggtgctcgatttagtacacacacttagggattggggggggagcctagctgtgctgtgggtccaggaggcagaactctgggtntctcaccatggcctggatccctctacttcctccccctcctcactctctgcacaggctctgacggcctctatgagctgacacncgcccaccgtggtgtcagtccgtaccccgaggacaggaccggccaaggtctccacgtcgcctcgtagggacgtatcgactacgttacgaacccgaaacgtattagtcgtactttacgttacgtaccgacgacgaacggaacgcccgggaccgtaccggtcccgttggttcggttggtacgtagttagtaaagtaaacgtacgtacgtaggaacggaccggtacccgtacgacgggtaccgtacccgtgacgtacgtacgttccgtcgtacgggccgttaccggacggtaccggaacgggaaccgtaaccggtactaacggttacgtaccggacctagtacggtacggtcgaacggtaccgaaggtacggagggacggaggacggtacgttaacgtacgtttaagtttacgttacggtaactaactaaccgtaaacgtaaccgtacgtaacctttaaggttaccgtttaaaccttaggttacggtttaaccggtacggtaacgttacccggaccggttaaacccgtaacggttccccggtaccggttaccgtacggggtaccctaccgggaaaccccgg

SEQ ID NO: 66523 - DNA, 834 bp, Homo sapiens
  misc_feature: GYAE6OF01C1OE2.51.59.F04.1.454.CMB.1.raw
  modified_base (64)..(64): a, c, t, g, unknown or other
  misc_feature (64)..(64): n is a, c, g, or t
  modified_base (161)..(161): a, c, t, g, unknown or other
  misc_feature (161)..(161): n is a, c, g, or t
  modified_base (200)..(200): a, c, t, g, unknown or other
  misc_feature (200)..(200): n is a, c, g, or t
tcagcgatcgtatacacgaccggtgctcgatttagtacacacacttagggagttggggggggancctagctgtgctggtgggtccaggaggcagaactctgggtgtctcaccagtggcctggactccctctacttccctcccctctcactctctcgcacgnggctcgtgacggtcctctatgagctgacacgtacgcccnccgttcggtatcgtacgtccggtcccgaaggaccgaaggtccggaccaaggtactcctaccgttgaccttggtagggactacgtggtacctagttaccggaaaccctaacggtattacgtacggtttacctttaaggttaccgggaaccacggacgaacgggtaacccgggaccccggtaaccgacccggttcccgttgggtttaacggttacggtagtaaacgttacgtaaaacgtaacgtacacggttaggaccggtaccgtacctacgggtaacgaccttaccggaggtaccggttcgttcgttaccgttcggacccgtccggttaaccggttaaggacccggtaacggggtaacctaccgggttactaaacgtaccggtttccggaccaacggttacggttaaagggccccggaaagttaccccgaaggggccgtaaacgggcggaaaccgttgggtacctacgttaatttacgttagttcggaaaccctataaccgacgtaaccggaccttacggtattttaccggaaattccgggtacgtttaccggaaacgccgggtccctaaaaacggggtcccgttaacgggttcccgttaaccgggtgacccccgaacggtaaccccggtaccc

SEQ ID NO: 66524 - DNA, 831 bp, Homo sapiens
  misc_feature: GYAE6OF01D4140.51.59.F04.1.454.CMB.1.raw
  modified_base (186)..(186): a, c, t, g, unknown or other
  misc_feature (186)..(186): n is a, c, g, or t
tcagcgatcgtatacacgaccggtgctcgatttagtacacacacttagggattgggggctgtgggtccaggaggcagaactctgggtgtctcaccatggcctggatccctctacttcctccccctcctcactctctgccacaggctctgaggcctcctatgagctgacacacgcccaccctcggtntcagtcgtccccgaggacacgaccggccgaggactccacctgcgtcgtaggagagtcgctattacgaacccaaaaccgtattacgttacgtactttagttacgggttaacccagtaccgaaacgggtaacggacccgggaccccgaccggtcccccgttgggtttcggtttagggttacggtagttaggtaaaagtaaaacggtacctaccggttaggaacggtaccgggtaccctacggtacgggtaaccgtacccgtaggaaccgtcgtacgtttccgtacgtcggtccgtaccggtacgggtaccggaacggggaccgtaaccggtcgaacgtacgttaccggacgtacgtacggtaggtacggacgtaccgggtaaggacggaagggaacgggaccggtacgggtactaccgttaaacgtttactttaacgtttacgtaacctaaacgtaacgaaacgttaacgaaccttaacccgttagttaaccggtttaattaccggtttaccgttaccggttaaccggtaaccgttacgacccggtaaccggtaaccggttaccccgtaacccgggttccgtacgggttacccaacccgggtaccctaaaccccggaccccctaaacccgtccgttccgtaaccccg

SEQ ID NO: 66525 - DNA, 879 bp, Homo sapiens
  misc_feature: GYAE6OF01D71DT.51.59.F04.1.454.CMB.1.raw
  modified_base (64)..(64): a, c, t, g, unknown or other
  misc_feature (64)..(64): n is a, c, g, or t
  modified_base (104)..(104): a, c, t, g, unknown or other
  misc_feature (104)..(104): n is a, c, g, or t
  modified_base (111)..(111): a, c, t, g, unknown or other
  misc_feature (111)..(111): n is a, c, g, or t
  modified_base (127)..(127): a, c, t, g, unknown or other
  misc_feature (127)..(127): n is a, c, g, or t
  modified_base (157)..(157): a, c, t, g, unknown or other
  misc_feature (157)..(157): n is a, c, g, or t
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
tcagcgatcgtatacacgaccggtgctcgatttagtacacacacttagggagttggggggggancctagctgtgctgtgggtccaggaggcagaactctgggtntctcacntggcctggactccctntacttcctcccctcctcactctctagcacnggctctaggcgtccctactagtcgagcagacacgtgtcccnccgtcgggtntacgacgttccacccgagaccgaggtacgcctaggacacctaccgtgtcctgtaggatctgtacgtacgttacgaacccgaaaacgttgttacgttcgttactttaacgttacggtaccaacggcgtaaacggaacccggccccgggtaccgaacccgggtttccccgtttggttcccggggttaggtacgttaaccggtaagttaaacgtaaacgttaccgtaccggtttacggaaaccgggtcccgtttaaaccccggacgggttaaacggttaccccgttccccggttaacgggaccggtccttttaacccggtttccgtacccggggtttccggttaacccgttacgggtaaaccggttaccggaaacggggtaacccgtacgtaacccgttacgttaacgtccggtaaccttagtttacggaacggggtacggtaccgttccggtaaggacgggtaacggtaaccgggcggtacggtaccgttacgtaacgttttagttaccgttaacgaccttaaacggtaccgaaacggtacctaccgttaacggttaccgttttacgttaccggtattttaccggtaacccggttaggtttacccgtgaaacccggtcccgttacggttacccgacccggtacggttacggtcccacccggggttaaaccccg

SEQ ID NO: 66526 - DNA, 798 bp, Homo sapiens
  misc_feature: GYAE6OF01DL55X.51.59.F04.1.454.CMB.1.raw
  modified_base (190)..(190): a, c, t, g, unknown or other
  misc_feature (190)..(190): n is a, c, g, or t
tcagcgatcgtatacacgaccggtgctcgatttagtacacacacttagggattggggctggggagcctagctgtgctgtgggtccaggaggcagaactcgtgggtgtctcaccatggcctggatccctactacttcctccccctcctcactctctgcacaggctctgacgcctcctatcgagctgacacncgacccaccgtcggtgtcacgtccgtaccccaggacacggaaccggccgaggtactccacctggcctacgtaggacgagtcgtcgtaacgttcgaacccgtaaaaccgtattagtacgttactttaacgtttacggtaaccagtacgaaggaaccggccccgggacccgtaccgggtccccgttggttggttggtagtaacgtagtaagtaaacgaacgacgttaggaacggtaccggtacccgtacggaacgggtacctacccggtagaccggtacgtaactttccgtaccggtaccggtaccgttaccgggacgggttaccggaacggggtaaacccgtaaccgggttaacctaccgttacggttaccggtaccgtagtaccggagggtacggtaccggtacgacggacgtaagggacggacggagtcgtaagttaacgttagtttacgttacgtaacgtaccttaaccgaactaacgtaaccctacgttacgtttaccggttaacgtttacgttacggtttaccggtaaccggtacgtacccggtaacccggtaaccggttaaacccggttcccgtttaacccggtcggttaccgggtaaccccg

SEQ ID NO: 66527 - DNA, 536 bp, Homo sapiens
  misc_feature: GYAE6OF02GPR0V.51.59.F04.1.454.CMB.1.raw
tcagcgatcgtatacacgaccggtgctcgatttagtacacacacttagggattgggggctgtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaagccgggcacggcccctgtgttggtgatgtaataaagacactgagacggccctgagggactcccgtgacgcgattctctggctccaggtcagggacaacggtcacagttggccatcagtggagtccgaggcaggaggacgaggctgacttattattgacaatcaacagaccacctagtttaggtaactttatgttcgttacgaactgaccgaaccgaaggtccaccgtccgtgggtcacgcccgaaggccccaacccctacgtcgtacc

SEQ ID NO: 66528 - DNA, 492 bp, Homo sapiens
  misc_feature: GYAE6OF02G3BQV.51.59.F04.1.454.CMB.1.raw
  modified_base (480)..(480): a, c, t, g, unknown or other
  misc_feature (480)..(480): n is a, c, g, or t
tcagcgatcgtatacacgaccggtgctcgatttagtacacacacttagggattggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacacggtcacattggccatcagtggagtccaggcagaggacgaggctgactattattgtcaatcaacagacaccattgtacttatgtcttacggactgcgacaggtcaccgttcngggtcagacccg

SEQ ID NO: 66529 - DNA, 506 bp, Homo sapiens
  misc_feature: GYAE6OF02JB71P.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggactcccgtgagcgattcctctggctccgaggtcagggacaacggtcacattggaccatcagtggagtccgaggcagaggcgaggctgactattattgtacaatcaacagacacattgtacttatgttcttacggacttgacgtactacggtctaccgtcgtaggtaccg

SEQ ID NO: 66530 - DNA, 486 bp, Homo sapiens
  misc_feature: GYAE6OF02G09SC.51.59.F04.1.454.CMB.1.raw
  modified_base (454)..(454): a, c, t, g, unknown or other
  misc_feature (454)..(454): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccgaggtcagggacaacggtcacagttgccatcagtggagtccaggcagaggacgaggctgactattatgtcaatcaacagacacattgtacttntgttctcgatgacgacaagtcacgtctggtcc

SEQ ID NO: 66531 - DNA, 532 bp, Homo sapiens
  misc_feature: GYAE6OF02ID5H6.51.59.F04.1.454.CMB.1.raw
tcagcgatcgtatacacgaccggtgctcgatttagtacacacacttagggattgggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgccaaaaccgatatgcttattggtaccagcagaagccggccaggcccctgtgttggtgatgtaataaagacactgagaggccctacagggatccctgacgcgattctctggctccgaggtcagggacaacggtcacattggccatcagtggagtcaggcagaggacgaggcagactattattgtacaattacaaacagaacacctaattggtacttattcgtctttacggaactcggtaccgaacctaacggtcctacccggttccgtgggtaccagtaaccccgg

SEQ ID NO: 66532 - DNA, 506 bp, Homo sapiens
  misc_feature: GYAE6OF02G5WA6.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtcgttggtgatgtataaagacactgagaggccctcgagggactccctgagcgattctctggctccgaggtcagggacaacggtcacattggccatcagtggagtccaggcagaggacgaggctgactattattgtacaatcaaacagacacctattgtacttatgtcttcgaactgacgaccgaaggtccaccgttccgtggtaccg

SEQ ID NO: 66533 - DNA, 543 bp, Homo sapiens
  misc_feature: GYAE6OF02JHO6Z.51.59.F04.1.454.CMB.1.raw
  modified_base (276)..(276): a, c, t, g, unknown or other
  misc_feature (276)..(276): n is a, c, g, or t
  modified_base (474)..(474): a, c, t, g, unknown or other
  misc_feature (474)..(474): n is a, c, g, or t
  modified_base (488)..(488): a, c, t, g, unknown or other
  misc_feature (488)..(488): n is a, c, g, or t
tcagcgatcgtatacacgaccggtgctcgatttagtacacacacttagggagttgggggggagcctagctgtgctgtgggtccaggaggcagaactctggtgtctcaccatggcctggactccctctacttcctcccctcctcactctctgcacagctctgacggcctcctatgagctgacacacgccacccgtcggtcgtcacgtcgtacccgacggacgacgacggcaggactccaccgtgctctggagatgacagttcgaccaaaccgatatngcttattggtaccagacacgaagaccggccaggcccgtgtgtggtgatagtataaagacactagagagccgtcaggagtcctcgagacgatctcgtcgcgtcgacggtacgacggacgaacgtacgacatagacatacgagtaggagtacgaggacgagagacgaggacgtagacgtatattagtactaactacacanacacatagtacgtntatcgtacgttacgtacgtacgtacgtaccgtaacggtacgtaccgtacgtacgg

SEQ ID NO: 66534 - DNA, 513 bp, Homo sapiens
  misc_feature: GYAE6OF02F6RO0.51.59.F04.1.454.CMB.1.raw
  modified_base (239)..(239): a, c, t, g, unknown or other
  misc_feature (239)..(239): n is a, c, g, or t
  modified_base (501)..(501): a, c, t, g, unknown or other
  misc_feature (501)..(501): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcgagggatccctgagcgattctctggctccaggtcagggacaacggtcacattggccatcagtggagtccgaggcagaggacgaggctgacttattattgtcaatcaacagaccactattggtacttatgtacttcggaactgcgaccaaggtcaccgtcctgggtaccacgacccaaggcccaacccnctcgtcactccg

SEQ ID NO: 66535 - DNA, 530 bp, Homo sapiens
  misc_feature: GYAE6OF02HD03P.51.59.F04.1.454.CMB.1.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
tcagcgatcgtatacacgaccggtgctcgatttagtacacacacttagggagttggggggaggcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctcnggagatgcatgcaaaccgntatgcttattggtaccagcagaagccggccaggcccctgtcgtgtgatgtataaagcactgagaggccctcgagggactcccgtgacggcattcgtctggcctccgaggtacacgggacaacgggtcactagttggccctatccgagtcggagtccgaggcaagaagaccgaggtcagacttattctgtacaatgtcaagacatctagtcggttaacttgtgttacttacggaacgtcggaacgtaaggtccgtaccgtccgtagtcacgtacccg

SEQ ID NO: 66536 - DNA, 609 bp, Homo sapiens
  misc_feature: GYAE6OF02I9RZH.51.59.F04.1.454.CMB.1.raw
  modified_base (367)..(367): a, c, t, g, unknown or other
  misc_feature (367)..(367): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgacccaaaccgatatgctttattcggtaccagcagaaggcccgggccacggccccgtgtggttggtgagtgtaagtaaagactacgtggacgacggcccgtcgacgggactcccgngacgcgtattctcgtcggcctccgaggtcgagggacctaacgggtcacgtagttcggacctagtcgaggtggtacgtccgaggacgaggacgggaccggaggtcgtagtaacttagtttagttacgttactaactacgaaacaacgtaccacctagtttacggttaacttagttacgttaccgttacggtactaggtaccgtaaccgtaacggttcccgtaccggttcccgtgggtaacccg

SEQ ID NO: 66537 - DNA, 533 bp, Homo sapiens
  misc_feature: GYAE6OF02I9HUI.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggccaggcccctgtgttggtgatgtataaagacactgagaggccctcgagggactcccgtgagcgattctctggactccaggtcgagggacaacggtcactattggccatcagtgagtccaggcagaggacggaggcctagacttattattgtactaatacaacgaagacacctattaggtacttagtgtcttaggaactcgcgtaaccgtacggtccaaccggttccgtgggttaccacgtaccccgg

SEQ ID NO: 66538 - DNA, 506 bp, Homo sapiens
  misc_feature: GYAE6OF02HJXRN.51.59.F04.1.454.CMB.1.raw
  modified_base (314)..(314): a, c, t, g, unknown or other
  misc_feature (314)..(314): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctnagggatccctgagcgattctctggctccaggtcagggacaacggtcacattggccatcagtggagtccaggcaggagacgaggctgactattattgtcaatcaacagacacctattggtacttatgttcttcgaactgcgaccaaggtcaccgtctgggtcagcccaggacccacccactcgtccacttccg

SEQ ID NO: 66539 - DNA, 545 bp, Homo sapiens
  misc_feature: GYAE6OF02INVSK.51.59.F04.1.454.CMB.1.raw
  modified_base (242)..(242): a, c, t, g, unknown or other
  misc_feature (242)..(242): n is a, c, g, or t
  modified_base (437)..(437): a, c, t, g, unknown or other
  misc_feature (437)..(437): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgatatgcttattggtaccagcagaagccggccaggcccctgtgttggtgatgtataaagacactgagaggccctcgagggactccctgacgcgattctctggctccaggtcagggacaacgggtcaacagttggccatcgagtggacgtccgaggcaggaggacgaggctgacttagttnttgtcaattcaaacagaccaaccgatttaggtaccttagtcggttacttcgggtaacttggaccggaaccgtaacgggttcccgaaccggttcccgtaggggtacccg

SEQ ID NO: 66540 - DNA, 540 bp, Homo sapiens
  misc_feature: GYAE6OF02GOFF8.51.59.F04.1.454.CMB.1.raw
  modified_base (315)..(315): a, c, t, g, unknown or other
  misc_feature (315)..(315): n is a, c, g, or t
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggcccctgtgttggtgatgtataaagacactgagaggccctnagggatccctgagcgattctctggctcaggtcagggacaacggtcacattggccatcagtggagtccgaggcaggaggaacgaggctagacttagttattgtacaatcaacaagaccaaccgatttcggtaacttagtgttacttacggaacttggaccgaccgtaaggtccaaccggttccgtagggtccacgcccgaacggccccaaccccgtactcgtaccc

SEQ ID NO: 66541 - DNA, 605 bp, Homo sapiens
  misc_feature: GYAE6OF02HXMK6.51.59.F04.1.454.CMB.1.raw
tcagcgatcgtatacacgaccggtgctcgatttagtacacacacttagggattgggggctgtgggtccaggaggcagaactctgggtgtctcaccatggcctggatccctctacttctcccctcctcactctctgcacaggctctgaggcctcctatgagctgacacagccacctcggtgtcagtgtcccaggacagacggccaggatcacctgctctggagatgcattcgaccaaaaccgatatgcttattggtaccagcagaagccgggccaggcccctgtgttggtgatgtaataaagacactgagacggccctcgagggactcccgtgacgcgattctcgtggctaccgaggtcaaggggacctaaacgggtcaactagtttcggaccagtccaggtgggtagtccgaggacaaggagggacgaggctggaacttattattgtactaaatcaaacacggaaccaacgtaattggttaacttagttagttcctttacggaacttggaccgtaaccggtaacggtccctaaccggttcccgtacggggttaccacgggtaaccccgaaacggtaccccgaaacccccgtacgtcggtaacccc

SEQ ID NO: 66542 - DNA, 553 bp, Homo sapiens
  misc_feature: GYAE6OF02IVLNL.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaagccggccaggcccctgtgttggtgatgtaataagacactgagacggccctgagggactcccgtgagcgtattctctcggctccgaggtcagggacaacggtcacgtattggccatcgagtggacgtccgaggcgaggaggacgaggctaggtacttagtttagttgtactaactacaacgaagaccaacctagtttacggtaacttagttcgttacgttaccggtaacgttcgacgtaccgaaggttccacccggttccgtggtacccg

SEQ ID NO: 66543 - DNA, 498 bp, Homo sapiens
  misc_feature: GYAE6OF02HPLMC.51.59.F04.1.454.CMB.1.raw
tcagcgatcgtatacacgaccggtgctcgatttagtacacacacttagggattgggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtcgttggtgatgtataaagacactgagaggccctcagggatccctgagcgattctctgctccaggtcagggacaacggtcacattggccatcagtggagtccaggcagaggacgaggctgactattattgtacaatcaacagacaccattgtacttatgtcttacggactgcgaccaggtcaccgtctcggtcagtacccg

SEQ ID NO: 66544 - DNA, 921 bp, Homo sapiens
  misc_feature: GYAE6OF02IM397.51.59.F04.1.454.CMB.1.raw
tcagcgatcgtatacacgaccggtgctcgattttagtacacacacttagggtagtttgggggctggggagacctagctgttcgcctgtagggtaccacggagggcagaactctgggtgtctcaccatggcctggatcccgtctacttcttcccctcgtcactctctgcacaggctctgacggcctcctatgagctagacacgagccacccgttcggtagtcacgttggtcccccagggaccaggtaccggtccaagggactaccgaccttgcgtcgtggacagtggccaatttcgaccgtaaaacccggaattacgttggaccgttaagttcggttacccaacggtaccaaggaacggtccgggggacctacggggacccccgttagggttacggtttagggttcggaactttacggttaatttaaaaacgggaacctaacgttacggaaacgtacgggacccccgttacgaacgggggtaacttaccccgtagggtaacgacggtaactttccgtaccgtacgggtacccgtacccggtaacgggtaccgtaaacgggggaaccctaaaacggggttcctaaacgtaacgtttacggggacctaacgttacgaaacggttacgggaaccgttcccggaacggtaccgtaacgggtaaacggggaaccgggtaagggtacccggttaggttaacccgtttaaagtttttaacgtttaaggttaccgtaaaacgttaaccgtaaaaccgtaaacgttaaccgtaaacccgttaagtttaaccgggttaaaccgttttaactttaccggttttaacccgtttaacccgggttaaaccgtttaacgggtaccccggtttaacccggtaaacggggttacccctaaacccggggtttaccccggttaaccgggggttaaccccgg

SEQ ID NO: 66545 - DNA, 560 bp, Homo sapiens
  misc_feature: GYAE6OF02GULJ0.51.59.F04.1.454.CMB.1.raw
  modified_base (445)..(445): a, c, t, g, unknown or other
  misc_feature (445)..(445): n is a, c, g, or t
  modified_base (466)..(466): a, c, t, g, unknown or other
  misc_feature (466)..(466): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaaggcccgggccacggcccctgtcgttggtgatgtataaagcactgagacggccctagacgggactcccgtaggacgacgtacttcgtcgtcggcctccgagggttccaggggacctaacggtcactagttcggaccagtcaggtggacgtcgaggcagaggacgngctgacttattattgactaancaacagaacacctagttacgttacttagtgttacgttcggtaactcgaccgtaccgtaggtccctaccggtccggtaggtccgaccgtacccgg

SEQ ID NO: 66546 - DNA, 575 bp, Homo sapiens
  misc_feature: GYAE6OF02GGID5.51.59.F04.1.454.CMB.1.raw
  modified_base (225)..(225): a, c, t, g, unknown or other
  misc_feature (225)..(225): n is a, c, g, or t
  modified_base (447)..(447): a, c, t, g, unknown or other
  misc_feature (447)..(447): n is a, c, g, or t
tcagcgatcgtatacacgaccggtgctcgatttagtacacacacttagggattgggggctgtgggtccaggaggcagaactctgggtgtctcaccatggcctggatccctctacttctcccctcctcactctctgcacaggctctgaggcctcctatgagctgacacagcccaccctcggtgtcagtcgtccccaggacagacgccaggatcacctgctctgganatgcattgaccaaacgatatgcttatggtaccagcagagccggccagccctgtgtgtgatgtataagacatgagacgcctgaggactccgtagacgcgattctcgtggtcctacgaggtcgaagggaccaacggtcaacgtagttcggacctatcgtagtcggacgtccgaggcaaggacgggacgaggcgttagaacgttattaagttgactaatccaaanagaaccactatttaggtaaccttagtcgttacttacggaacctgaaccgtaaccggtaacggttacctaacccggtcgtaccgggtacaccgaccccgaaaggaccccctaacccctagtcgtaaccc

SEQ ID NO: 66547 - DNA, 550 bp, Homo sapiens
  misc_feature: GYAE6OF02G86DK.51.59.F04.1.454.CMB.1.raw
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgacccaaaaccgatatgcttattggtaccagcagaagccgggccaggcccctgtgttggtgatgtaataaagacacgtgagaggccctgagggatcccgtgagcgattctcgtggctcgaggtcagggacaacggtcaactattcggccatcgaggtggacgtccgaggcaggaggacgaggctgaacttatttattgtacaatcaacagacctaccagttacggtacttatcgttcgttacggaactgaccgaccgtaggtccaccggttccgtgggtaccacggacccaacggcccaacccactccgtactcttacccg

SEQ ID NO: 66548 - DNA, 554 bp, Homo sapiens
  misc_feature: GYAE6OF02FFPOZ.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagagccggccaggcccctgtgttggtgatgtaataaagacactgagaggccctcagggactcccgtgacgcgattctcgtggctccgaggtcagggacaacggtcacgtattcggccatcgagtgggagtccgagggcaggaggacggaggactgactatttagttagtactaagtacaaacagaaccaaccgttatttacggtacgtttagtcgtacgttaccggtaacttcggaccgtaccgaaacggttcccaccggtccgtcgggtaaccg

SEQ ID NO: 66549 - DNA, 536 bp, Homo sapiens
  misc_feature: GYAE6OF02HWOOP.51.59.F04.1.454.CMB.1.raw
  modified_base (397)..(397): a, c, t, g, unknown or other
  misc_feature (397)..(397): n is a, c, g, or t
  modified_base (461)..(461): a, c, t, g, unknown or other
  misc_feature (461)..(461): n is a, c, g, or t
  modified_base (481)..(481): a, c, t, g, unknown or other
  misc_feature (481)..(481): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgccaaaccgatatgcttattggtaccagcagaagccgggcaggcccctgtgttggtgatgtaataaagacacgtgagacggccctcgagggtactcccgtgagcgtattcgtcgtggcctccgaggtcgacgggacaacggtccaanagttggacctatcaggtgacgtccgaggcaggaggacgaggctgactattatgtacaatacaanacgacactattggtaacttntcgttacgtacgtactgaccgtaaccaaggtccaacccggttccgtagggtaccg

SEQ ID NO: 66550 - DNA, 570 bp, Homo sapiens
  misc_feature: GYAE6OF02HZTF2.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattgtaccagcagaagccgggccaggcccctgtgttggtgatgtataaagacactgagacggccctcgagggactcccgtagagcgtaattctcgtggcctccgaggtcgagggaccaacgggtcacgtagttcggccatcgagtggagtccgaggcaggaggacgaggctagacttattagttcgtacaattaccaaacacgaacaccgtagttacggtactttagttcgttacgttaccggtaactcggtaccgaaccgtaacggtccacccggttccggtacgggttccacggtacccccgg

SEQ ID NO: 66551 - DNA, 519 bp, Homo sapiens
  misc_feature: GYAE6OF02FOBFL.51.59.F04.1.454.CMB.1.raw
  modified_base (216)..(216): a, c, t, g, unknown or other
  misc_feature (216)..(216): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacngacggccaggatcacctgctctggagatgcattgccaaaccgatatgcttattggtaccagcagaagccggccaggcccctgtggttggtgatgtataaagacacgtgagaggccctcgagggactccctgagcgattctctggctccgagtcaggacacggnacnttggcatcagtggatccgaggcagaggacgaggctagacttattattgtacaatcaaactagacacctattcggtacttatcgttcttacggtaacgttcgcgtaccgtaaggtccacccggttccgtgggtacccg

SEQ ID NO: 66552 - DNA, 730 bp, Homo sapiens
  misc_feature: GYAE6OF02J2E4D.51.59.F04.1.454.CMB.1.raw
  modified_base (105)..(105): a, c, t, g, unknown or other
  misc_feature (105)..(105): n is a, c, g, or t
  modified_base (311)..(311): a, c, t, g, unknown or other
  misc_feature (311)..(311): n is a, c, g, or t
tcagcgatcgtatacacgaccggtgctcgatttagtacacacacttagggattggggctggggagcctagctgtgctgtgggtccaggaggcagaactctgggtntctcaccatcggcctggactccctctacttcctcccctctcactctctgcacagctctgacgcctctatgacgctgacacacgccaccgtggtgtccacggtcgtaccccgaggaccacggaccggccaagggtacttccgaccgttcggccttcggtaggaactacgttcggtacctaacgtttccgaacccgtaaaacccggtntttaaccgtacgttaccgtttaacggttaccggtaaccgacgtaccgaaccgggaaccggcccgggtaccgtacgggtcccgttggttacggttaggtacgtagtacgtaaacgtaaacgaccgtacgttacggaacggtccggtacccgtacggtaacggtacctacccggtagacggtactacgttccgtcgtccgtaccgtacgtacggtaccggacggtaaccgtacggtacacgtacgttcggaccgttagacgtaacggtacggtaccgtagacggtaacgacgacgtacggtacgtacgtagtacgttattacgtacgtaacaacgttaccaacgtacgtacctacgttacgttacgtactcgtcgtacgtaacgctacgacctacgtaccgcgtaccgtcgacgtaacccg

SEQ ID NO: 66553 - DNA, 550 bp, Homo sapiens
  misc_feature: GYAE6OF02F6Y0S.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgccaaaccgatatgcttattggtaccagcagaagccgggccacggcccctgtgttggtgatgtataaagacactgagaggccctcgagggactccgtgagcgattctctggctccgaggtcgagggacaacggtcactagttggccatcgaggtcggagttccgaggcaggagacggaggctgacttattattgtacgtaatacaaacagaaccactagtttaggtaactttagtcgtttaccgttacggtaacttcgaccgtaaccgaacggttccacccggttccgtgggtaacccg

SEQ ID NO: 66554 - DNA, 792 bp, Homo sapiens
  misc_feature: GYAE6OF02IUUH8.51.59.F04.1.454.CMB.1.raw
tcagcgatcgtatacacgaccggtgctcgatttagtacacacacttagggattgggggggggagcctagctgtgctgtgggtccaggaggcagaactctgggtgtctcaccatggcctggatccctctacttctcccctcctcactctctgcacaggctctgaggcctcctatgagctgacacagcccacccgtcggtgtcagtcgtcccccaggacagacggccaggatcacctgctcgtggagatgcattcgaccaaaccgatatgcttatcggtacagcagaacgccgggccacggccctggttgtggtgatgtaataaagacacgtagagacggccctacgagggactcccgtgagcgtattcgtcgtcggtcctaccgtacgggtccggaacggggtacccgtaaccggggttacctaaccgtagtttccgggaccctacgttaccgtaaggttacggggtaccggtacccggaagggtaccggaaggggaaaccggggtaaccgggtaccggggtacgttaacggttaaccgtttaagttttaacggttttacgggtaaccctaaaacgttacccgtaaaaacgtaacccggaaacccttaaacccgttacgttttaacgggtttaaccttttttacggtttaacgttttaacccgggttttaaccccggggaacccgttttacggggaacccccggttaaaccggtaaacccgggttttcccctaacccccggggttttaccggtttaaccccggggtaccctaaaccgggtaaccccccccggg

SEQ ID NO: 66555 - DNA, 685 bp, Homo sapiens
  misc_feature: GYAE6OF02HAF8L.51.59.F04.1.454.CMB.1.raw
  modified_base (245)..(245): a, c, t, g, unknown or other
  misc_feature (245)..(245): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggccaggactcacctgctctgganatgcattcgaccaaacgatatgcttattggtaccagcaggaacgccgggaccacggcccctgtgttggtgatgtaataagacacgtgaggacgccctacgaggggtactcccgtagacgtcgtacttccgtcgtcggtcctaccggtaggtaccgaacggggtaaccgtaaacggtttacgtaaggtttcgggaccctaacgtcgagggtacggtacggtcccgaacggtcgaagggacggtaacggagggtacgtacgtaacgtttaacgtttacgtttacgtaaccgtaaacgtaccaaacggtacgaacctaaccgtaacgtttaacgggttactttacgttacggtttaccgttaacggtaaccgttacgaccggtaacccgtaaggtcccgtaaccggttccgtacggggtacctacccggaccccgtaacccgg

SEQ ID NO: 66556 - DNA, 632 bp, Homo sapiens
  misc_feature: GYAE6OF02F87GF.51.59.F04.1.454.CMB.1.raw
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttcctcccctcctcactctctgcacaggctctgaggcctcctatgagctgacacagcccacccgtcggtgtcagtcgtccccaggacaggacgccaggatcacctgctcgtgganatgcattcgaccaaaccgntatgtcttagttgtaccagcagaacgccggcacggccctgtgtggngatgtataagcactgagacggccctgagggactcccgngacgtcgtacttctcgtcggcctaccggaggtccgaagggtacctaacgggtcacgtagttcggacctagtcgaggtacggtacgtaccgaggtccgaaggtacggacggtacggtaccgtaggtaactttagttacgtttcgaactaaagtaccaaacgtacgtaacctaaccgtaagttacggttaactttacgttacggttccgttaacgggtaacttccggaccgtaacgtaaccggtccgtaacccggttcggttacgggtacccaacggtaacccccgg

SEQ ID NO: 66557 - DNA, 964 bp, Homo sapiens
  misc_feature: GYAE6OF02GIPVI.51.59.F04.1.454.CMB.1.raw
  modified_base (105)..(105): a, c, t, g, unknown or other
  misc_feature (105)..(105): n is a, c, g, or t
tcagcgatcgtatacacgaccggtgctcgatttagtacacacacttagggattggggctggggagcctagctgtgctgtgggtccaggaggcagaactctgggtntctcaccatggcctggatccctctacttccccctccctcactctctgcacagcgtctgaggcctcctactgagctgtacacacgccacccgtccggtggtcacgtacgtcccgacgaacgacgaccggaccgacggagtcctaccgtacgtctacgttacggagaacgttcgtacggactttacgtaacccggaaaacccgtaaacttaagttcgtacgtttaacgttttacgggttacccggaacgtacggtaacggaaacggggtaccccggggccccggtaaaccggtcccccgggtttccggttagggtttcggggtttaccggtaagtttaccggttaaagtttaaaaacgaaacgaaccggttagaacgggaaccggtccccgttaccggaacggggtaccgttacccgttccgggtaaaggtaccggttaacgttttaccttccgggtttaccggaccggtttaccccgtaaacggggttaaccgggtaaccgggggtaaccggaaaacccgggtttacccggaaacttaaccggttttacgggtaacccccgtaagttaccggttaaacgggtccgggtaacggtaccgttaacggggaccgtaaacgggaacggggaacccggtaaggggtacgtttaccggtaaaccgtttaaacggtttttagttaccgtttaaacggtaactttaaaacccgaacgtaaaaccgtaaccgttaaacccgttaacggtttagtttaccgttttaaagttccgtttaaccggtttcgggtaaacccgtagttaaccccggaacgtaaaccggtttcccggtaccccggtttccgggttacgggtacccggtaacccccg

SEQ ID NO: 66558 - DNA, 557 bp, Homo sapiens
  misc_feature: GYAE6OF02GF21W.51.59.F04.1.454.CMB.1.raw
  modified_base (447)..(447): a, c, t, g, unknown or other
  misc_feature (447)..(447): n is a, c, g, or t
  modified_base (520)..(520): a, c, t, g, unknown or other
  misc_feature (520)..(520): n is a, c, g, or t
tcagcgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgctattcgaccaaacgatatgcttattggtaccagcagaagccggccaggcccctgtcgttggtgacgtgtaataaagacactggagacggccctgagggactccgtggacgcgtacttctcgtggctccgaggtcgaagggacaacggtcactagttcggcctagtcgaggtcggagtccgaggacaggacggacgaggctagattatattagcaatcaanacgactaccagttacgtacttatgttcgtacggtaactgacgtacgaggtaccacggttccggtcgggtaccncgacccgaacggccaaccccgatccgtacacttcccg

SEQ ID NO: 66559 - DNA, 763 bp, Homo sapiens
  misc_feature: GYAE6OF02HQ6M1.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgagcctcctatgagctgacacacgcccacccgtggtgtcagtcgtccccaggacaggaccggccaggactccaccttgctcgtggatatgctattacgaccgaaaccgatatgtacttaagttcggtaccagcgaaggaacggtcccgggccgaacggcccccgttggttacggttgggttgaagttaggttaaagttaaacgactaacgttacggaaggaccggtaccccgtgaacgggtctaccccgtagacggtacgtaacttttccgtaccggtcggtacccgttaccgggtaacgggttaccggaaccggggtaacccgtaacccggggtttacccaaacggttacggtttccggggtaaccctaagttaccgaagggtttacgggaaccggttacccggtaacgggaccgtaagggacgggtacggacgggttacgtacggtaattacgtttagttacgtaaccgtaattaaccaaacgacgtaacctaccgttaggtttacggttaacttacgttcggttacgttaccggtaaccgttaggacccgtaaccggtaaggttaccccggtacccggttccggttacggtaacccg

SEQ ID NO: 66560 - DNA, 552 bp, Homo sapiens
  misc_feature: GYAE6OF02IOQ1F.51.59.F04.1.454.CMB.1.raw
  modified_base (421)..(421): a, c, t, g, unknown or other
  misc_feature (421)..(421): n is a, c, g, or t
tcagcgatcgtatacacgaccggtgctcgatttagtacacacacttagggagttggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaccgatatgcttattgtaccagcagaacgccgggccacggcccctgtgttggtgatgtataaagacatgagacgccctagagggactccctagagcgtattctctggcctccgaggtcgagggacaacggtcacagttcggaccatcgagtggacgtcaggcagngacgagctagacttattattgtacaattacaaacacgacacctagttacggttactttagtcgttacttaccgggaactttacggccgtaaccgtaacggttcccgtaaccggttccgtacgggttacccg

SEQ ID NO: 66561 - DNA, 526 bp, Homo sapiens
  misc_feature: GYAE6OF02HRR06.51.59.F04.1.454.CMB.1.raw
  modified_base (433)..(433): a, c, t, g, unknown or other
  misc_feature (433)..(433): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttactggtaccagcagaagccaggccacggccctgtcttggttattataaagtactttgagacggccctcgacgggacccctgacgcgtattctcgtggctccagctcagcgacaacagtcacgttcgaccatcagtgagtccaggcagaggacgagctgactatacngtacagtcatcagacagcgtagtcggactacgttagtcgttacgtagttacgggcgggtaacgggaccctaaacgttccggacccgttaccgg

SEQ ID NO: 66562 - DNA, 646 bp, Homo sapiens
  misc_feature: GYAE6OF02HCX1O.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacacgcccaccctcggtgtcagtcgtccccaggacagacggccaggatcacctgctctggagatgctattgaccaaaccgatatgtcttagttggtaccagcagacggccggccacggccctgtggttggtgtatgtaataaagactacgtagagacgccctacgaggactccgtagacgcgtattctcgtggcctccgaggtcgagggaccgaacggtcacgtacgttcggacctacgtcgtaacggtcgggacggttccgaacgggtaccggaagggacgggaacggacggtcgtaggtaaccgttaagtttacgttagtaccaaagttccgaaaacgtacgaacctaccgttagtttacgggttaactttagttaccggtttacgttaaccgggtaacgttaccggtaccggtaacccggtaacgggtaccccgtacccggttccggtaccggtaacccg

SEQ ID NO: 66563 - DNA, 504 bp, Homo sapiens
  misc_feature: GYAE6OF02I9D4E.51.59.F04.1.454.CMB.1.raw
  modified_base (426)..(426): a, c, t, g, unknown or other
  misc_feature (426)..(426): n is a, c, g, or t
  modified_base (500)..(500): a, c, t, g, unknown or other
  misc_feature (500)..(500): n is a, c, g, or t
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaaccgatatgcttattggtaccagcaagaagccgggccaggcccctgtgttggtgatgtataaagacactgagaggccctcgagggactccctgagcgattctctggctcgaggtcagggacacggtcacattggccatcagtggacgtcaggcagaggacgaggctgactattattgtacatcaanagacacctattgtacttatgtctacgactcgcaccgaaggtccacgtcctagtcacgcccacgaccacccactntacc

SEQ ID NO: 66564 - DNA, 496 bp, Homo sapiens
  misc_feature: GYAE6OF02FPYB3.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggactccctgagcgattctctggctccgaggtcagggacaacggtcactattggccatcagtggagtccaggcagaggacgaggctgactattattgtacaatcaacagacacattgtacttatgtcttggactgacgacaggtcaccgtcctggtcagcccg

SEQ ID NO: 66565 - DNA, 631 bp, Homo sapiens
  misc_feature: GYAE6OF02GQINR.51.59.F04.1.454.CMB.1.raw
  modified_base (246)..(246): a, c, t, g, unknown or other
  misc_feature (246)..(246): n is a, c, g, or t
tcagcgatcgtatacacgaccggtgctcgatttagtacacacacttagggattgggggctggggagcctagctgtgctgtgggtccaggaggcagaactctgggtgtctcaccatggcctggatccctctacttctccccctcctcactctctgcacaggctctgaggcctcctatgagctgacacacgcccaccctggtgtcagtcgtccccaggacagacgccaggactcacctgctcgtgganatgctattcgaccaaaccgatatgtcttagttggtacccagacaaggacggccgggccacgggtcccctggttgtggtgtagtagtaagtaaagactacgagacgacggtccctcgagggtactccgaggagcgtattccgtcgtcggcctaccgaggtacgacgggtaaccgacggtacaacgtgtacgccgtagtcgaggtggacgttaccgaggcagggacggacggacggacctaagttacttagttacgtactaactacaaacgtaacgactaccgtagtttacggttacttagttcgttacggttaacgggtaaccgtacgtaaccggtaacggtaccggttaccggacccggttaccggttacgggtacaacccgggg

SEQ ID NO: 66566 - DNA, 801 bp, Homo sapiens
  misc_feature: GYAE6OF02JQK1U.51.59.F04.1.454.CMB.1.raw
  modified_base (183)..(183): a, c, t, g, unknown or other
  misc_feature (183)..(183): n is a, c, g, or t
tcagcgatcgtatacacgaccggtgctcgatttagtacacacacttagggagttggggggggagcctagctgtgctgtgggtccaggaggcagaactctgggtgtctcaccatggcctggatccctctacttcctcccctcctcactctctgcacgaggctctggacggccctacctatgganctagacacacgcccacccgtcggtgtcagtcgtaccccgaggacaggaccgccgaggatccacctgcctcgtagggaatatgacctagttccgaacccaaaaccgattaatcgtaccgtttagttacggtaaccgacgacgaacggtaaaccgggtccccggggaccgaaccggtcccccgttaggttcgggtttagggaggtaagttaggttaaacgtaaacggtacgtaacggtagggaacggaaccgggtcccgtaacggtaacggggtacctcccgtaggacggtaccgttacgttccgttacggcggtcctaccgggtacggtacgtaacgggacgtaaccggtacactaggttccggactacgacggtaggacggtaccgtaccgagggtacgaagggacgggtaacggtaccgggtataacgggttaactttaacggttttaacgttaccggtaaactaacggttaaacccgtaactaacccggaaaccgttaccgttaagtttaccgggttaactttcggttacttaccggttaacgtaaccgtacggtaccgtaaccggttaccggaccgttacccggttacggtccgggtaccgacccgtaaccccgg

SEQ ID NO: 66567 - DNA, 620 bp, Homo sapiens
  misc_feature: GYAE6OF02GVPZO.51.59.F04.1.454.CMB.1.raw
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctcgtggagatgctagttcgacccaaaaccgatatgtctttagttggtaccagcagaacgcccgggccacggcccctgtcgttggtgatgtaataaagacacgtgagacgccctcgacgggactccctgacgcgtattctcgtcgctccgagtcgaggactaacggcacgtatcggccatcgaggtggacgtcgaggcgaggacggacgaggtctagtacttagttagttacgtactaactaccaaacgaacgtaaccgaaccttagtttacgttaacgtttaacgttcgttaacgtttaccgaacgttacgaccgtaacggtaacggtaccgtacccggttacgttccgggaaccgtaccgacccggtaaccggacccctaaccccgtacgtcgtacccg

SEQ ID NO: 66568 - DNA, 795 bp, Homo sapiens
  misc_feature: GYAE6OF02H93SS.51.59.F04.1.454.CMB.1.raw
tcagcgatcgtatacacgaccggtgctcgatttagtacacacacttagggattggggggggagcctagctgtgctgtgtgtcaggaggcagaactctgggtgtctcaccatggcctggatccctctacttctccccctctcactctctgcacaggctctgacggcctctatgagctgacacacgccacccgttggtcgtcagtcgtcccgaaggacaggaccggtaccaggactaccgtaccgtgtacttcgtagggacgtattcgacttaagtttcgaacccgtaaaaccgattaacgtcgtacttttagttacggtacagtacgaagaccgggaccggacctacgggttccccgtggttcggttcggtacgtaactttgtaaaagttaaaacggacctacggtaggaacggttacggacccgttacggtacgggaccttcccgtaggacgtacgtaacgtttccgtcgttacggtaccggttaccggaagggttacccggaacgggtaaccgttaaaccgggtaccttaaacggtaacggtttcgggtacccgtaaggttacccgtaacgggttcgggtaaaccgtacccggtaagggtacccgtaagggtaaacccggaacgggtcggtaaccgttaccgttaaaggtttaactttacgttacggttactaaacgttaaccaacgtagacccgttaaccgtagtttacgttaactttagtccggttaaccttacggacttacggaccgtacgtaacggttcccctacggtccggttaccggtacaaccccgg

SEQ ID NO: 66569 - DNA, 652 bp, Homo sapiens
  misc_feature: GYAE6OF02JIM5H.51.59.F04.1.454.CMB.1.raw
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctcgtggagatgcattcgaccaaaccgatactgtcttagttcggtacccagacaaggaaacggcccgggaccgaacggcccccgtggttggttgggtgacgttagttaagtaaagaaccactggacgacggccctacgacgggtactcccgtagacgcgtattctcgnggctcnggtacgagggacacggtcactagttcgccagtacaggtaggacgtccgaggacgacggaacggtacgacgggtactcggtaactttagtttacgttacgtacaacttaacaaacgaacgtaaccaccgtagtttaacggttaacttacggttacgtttaccgttacgggtaaccgttaggaccccgttaaccggtaaccgggtaccccgttaacccggtttccggtaccgggttaacccgg

SEQ ID NO: 66570 - DNA, 601 bp, Homo sapiens
  misc_feature: GYAE6OF02GI9S2.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttcctccccctcctcactctctgcacaggctctgaggcctcctatgagctgacacagcccaccctcggtgtcagtcgtcccccaggacaggacggccaggatccacctgctcgtggagatgcattcgaccaaaccgatatgtcttatggtaccagcaaggacgccgggccacggcccctgtggttggtgatgtaataaacgacactggacgacggccctagacgggctcccgtagacgacgtattcctcgtcggtcctccgagggtcgagggactaaccggtcaactagtcggcatacgtagtggaccgtcgagggacaaggaggacggaggtccgagtacttaagtttatcgttacaagttaccaaacacgaacctacctagtttaacggtactttaacgtacggtttaccgttaacggacttacggacgtaccgtaaacggttccgtacccggttcggtacggtaccg

SEQ ID NO: 66571 - DNA, 587 bp, Homo sapiens
  misc_feature: GYAE6OF02H4L46.51.59.F04.1.454.CMB.1.raw
  modified_base (243)..(243): a, c, t, g, unknown or other
  misc_feature (243)..(243): n is a, c, g, or t
  modified_base (351)..(351): a, c, t, g, unknown or other
  misc_feature (351)..(351): n is a, c, g, or t
tcagcgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagcccaccctcggtgtcagtcgtcccaggacagacggccaggatcactgctctggagatgcattcgaccaaacgntatgacttattcggtaccagcagaacggccgggcacggcccctgttgttcggtgatgtaataaagacagtgagacggccctgaggactcccgtagacgacgtattctnggtcctcaggtcacgggaacaacggctacgtagttacggccagtcgaggtggacgtaccgaggtcagggaacgggacgaggctagtaccttagttattcgtactaactacaacgaacaccacctagtttacgtaactttatcgttacgttacgtacgtacgaccggaacgtaacgtccaccggtccgtacggtaccacggacccgaaccggtaccccaaacccgtcctagtacccg

SEQ ID NO: 66572 - DNA, 711 bp, Homo sapiens
  misc_feature: GYAE6OF02I103A.51.59.F04.1.454.CMB.1.raw
  modified_base (257)..(257): a, c, t, g, unknown or other
  misc_feature (257)..(257): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttcctcccctcctcactctctgcacaggctctgacggcctcctatgagtctgacacgagcccacccgtcgggtctcacgtccgtaccccaggacaggaccgccgaggactccacctgctcgtgganatgctagtccgacctaaacgatactgtactttacgttacggaacctagacgaaggtaaccggccccgggaccgaccggttccccgttggttcggtttagggtcgtaagttaggtaaacgttaaaacggcgtacgtacgggaacgaccggtcccgtacggacgggtacctcccgagtaacgtcgtacttcgtcggtcgtccgtaccgcgtacgacggactacgacgtactgtacgactacgtacgacgtacgggtactacggacggtacaagggacgggaccggaggtaccgtacgttaacgttagtttcgtacggtaactaacgtaccgaacgtaaccgacttaccggttagttacgtttaacgtagtttacggttccgtaaccggttagtacccggtaccgttaaccgggtaccgttacccggttacccggttaccgggtaccggtaacccgg

SEQ ID NO: 66573 - DNA, 723 bp, Homo sapiens
  misc_feature: GYAE6OF02GVY9B.51.59.F04.1.454.CMB.1.raw
tcagcgatcgtatacacgaccggtgctcgatttagtacacacacttagggattggggctggggagcctagctgtgctgtgggtccaggaggcagaactctgggtgtctcaccatggcctggatccctctacttctcccctctcactctctgcacaggctctgaggcctctatgagctgacacagccaccctggtgtcagtcgtccccaggacaggaccgctaggactcacctgctctggacgatgctattcgaccaaaaccgattagtgtccttaagttcggtaaccagacgaagaacgggcccgggaccgaccgggtcccccttaggttggtttcgggtgtaagttaggttaaataaaacggactacgttgaacggtacggcccctaggacgggtacctcccgtaggacgtacgtacttccgtcgtacggtccgtaccgtaggtccgtaacgggaccgtaacggtaccaacgtgttaccggacctacgtccggagggtcggacgtacccgtagggacaggggaacgtaccgggaggtccgtagtaagttaacttttacgttacggttaacaaacgttaaccgaaacgtaacggtaaccctaacgttacggtttacgtttaaccgtttaaggtttaacggtttaccgttaacccgggtaaagtccggtaaccaaccgggttaaccggtacccgtaaccccgggttcggtaccggtaaccccgg

SEQ ID NO: 66574 - DNA, 532 bp, Homo sapiens
  misc_feature: GYAE6OF02G9UV6.51.59.F04.1.454.CMB.1.raw
  modified_base (244)..(244): a, c, t, g, unknown or other
  misc_feature (244)..(244): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattcgaccaaaccgatatgcttattggtaccagcagagccggccaggccctggtgttggtgatgtataaagcactgagacggccctgagggactcccgtgacgcgtacttctcgtggcctccgaggtccgaggaccacggtcactagttcggcatcgaggtggtacgtccgaggcgagacggacgagctagactattagtgtacaatcaacagaccactattaggtacttagtcgttcttacggtactgaccgaccgtaggtccgtaccgttccgtggtacccg

SEQ ID NO: 66575 - DNA, 617 bp, Homo sapiens
  misc_feature: GYAE6OF02GJAYV.51.59.F04.1.454.CMB.1.raw
  modified_base (381)..(381): a, c, t, g, unknown or other
  misc_feature (381)..(381): n is a, c, g, or t
  modified_base (459)..(459): a, c, t, g, unknown or other
  misc_feature (459)..(459): n is a, c, g, or t
tcagcgatcgtatacacgaccggtgctcgatttagtacacacacttagggattgggggggggagcctagctgtgctgtgggtccaggaggcagaactctgggtgtctcaccatggcctggatccctctacttcctccccctcctcactctctgcacaggctctgaggcctcctatgagctgacacagccacccgtcggtgtcagtcgtccccaggacagacggccaggatcacctgctcgtggagatgcattcgaccaaaccgatatgtcttattggtaccagcaaggaacgcccgggaccacggcccctggttcggttgggtgatgtaataaaagacactggagacggtcccagaaggactcccgtgacgacgtattccngtcgctccgaggtcgagggtacaacggtcacgtagttcggacctagtcgaggtcggacgtcgaggacaggtaggacgnggtctagacttagtagttgtacgtaaattaccgaaacacgaactaaccgttaagttcgttacctttagtacggtttcgttaccggtaacgtccggtaaccgtaaccggtaacggtacccgtacccggttacgtacggggtaccgacggtaacccccgg

SEQ ID NO: 66576 - DNA, 724 bp, Homo sapiens
  misc_feature: GYAE6OF02IC8W3.51.59.F04.1.454.CMB.1.raw
  modified_base (201)..(201): a, c, t, g, unknown or other
  misc_feature (201)..(201): n is a, c, g, or t
tcagcgatcgtatacacgaccggtgctcgatttagtacacacacttagggattggggctggggagcctagctgtgctgtgggtccaggaggcagaactctgggtgtctcaccatggcctggatccctctacttctccccctcctcactctctgcacaggctctgacggcctcctatgagctgacacagcccaccctcggtntcagtcgtccccaggacagaccggccaggactcaccgtgcctcgtggacgatcgacagttcgaacccaaaaccgtatacgtgtacctttagttacggtacacgacgaacgaacggcccgggacccgaacgggtccccttggttagttcgggtagtactagtaagtaaaggacacgtagacgacggtccctacggagggtactcccgtaggacgtacgttattcccgtagtccggtacctaccggtagggttacgaaacgggtaccgtaaccggtaccgtaacctacggttaccggacctaacgtacgtaggttacgggacgtacccggtaaggacgaaggacgggacggtacggacgttacggaagtttagttacgtttacgacttaaactaccgaaagtaaccgtaacctaacgttagtttacggttaccgtttaagttacgttaccgggttaacgtaaccggttacgaacccgtaaccggttaccggtacccgtacccggttaccgggttaggtaacccgg

SEQ ID NO: 66577 - DNA, 579 bp, Homo sapiens
  misc_feature: GYAE6OF02JZ1BI.51.59.F04.1.454.CMB.1.raw
  modified_base (162)..(162): a, c, t, g, unknown or other
  misc_feature (162)..(162): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
tcagcgatcgtatacacgaccggtgctcgatttagtacacacacttagggagttggggggggagcctagctgtgctgtgggtccaggaggcagaactctgggtgtctcaccatggcctggatccctctacttcctcccctcctcactctctgcacaggctcngagcctctatgagctgacacacgcccacccgtgtgtccagtcgtccccgaggacaggacgcaggntcacctgctgnggagntgcatcgacaacgatatgacttgttcgacagcgagtaacgccggaccgagccctgtgtcgtgatagtataagacacgtggacgcggtccgtccgagggtacctccgagtacgtactacgttcctcggtgtaccgccggtaagcgggtaacgtaacgaaccgtcgactacggtccggactatacgtaggtcgacgtcgaacgggtcagggaaggtaccgagtactcgtaacttagttacgttacgaacttacacgaaactgtacgtactgttacgtacttgtccgtcacgtacgacgtcaacgaccgtcgaccttaccggcggtaccacccgtaccg

SEQ ID NO: 66578 - DNA, 777 bp, Homo sapiens
  misc_feature: GYAE6OF02JTE7L.51.59.F04.1.454.CMB.1.raw
  modified_base (304)..(304): a, c, t, g, unknown or other
  misc_feature (304)..(304): n is a, c, g, or t
tcagcgatcgtatacacgaccggtgctcgatttagtacacacacttagggattgggctggggagcctagctgtgctgtgggtccaggaggcagaactctgggtgtctcaccatggcctggactccctctacttcctccccctcctccactctctgcacaggctctgacggcctcctatgacgctgacctacacgccctaccgtggtactcacggtcgtaccccgaggacacgaccggccaaggtactcccgaccgtcgcttacgtagggacgatcggacctacgttacggaaccctaaaaccgnttaagtcgtactttacgttacggaaccaggtaacacggtacgccggtaccacggtcccttaggttggttcgtagtacgtagttaataaacggtacctacgtagggtaaccggtacggtaccccgtagggtaacgggtacctaccgggtaggacgtacggtaacctttcggccgttagggccctaccgggtaggtaccgtaacgggaaccgtaaccggctaaccgtcgttacggactacgtacgtacgggtacggacgtaccgtaggaccgacgggacgggtaccgacggtcgttaacgtacttaagttaacgttacggtaactaaccgggttaccaaaaggtcccgtaacgtaacccgtttagtttaaccgggtttacctaacgggttacggttaccgttaaaccgggacgttaccggtaacccggtaacgttaacccggtaccggtacccggtttaacggcgggttaacccg

SEQ ID NO: 66579 - DNA, 767 bp, Homo sapiens
  misc_feature: GYAE6OF02G0BYS.51.59.F04.1.454.CMB.1.raw
  modified_base (376)..(376): a, c, t, g, unknown or other
  misc_feature (376)..(376): n is a, c, g, or t
  modified_base (539)..(539): a, c, t, g, unknown or other
  misc_feature (539)..(539): n is a, c, g, or t
tcagcgatcgtatacacgaccggtgctcgatttagtacacacacttagggattggggggggagcctagctgtgctgtgggtccaggaggcagaactctgggtgtctcaccatggcctggactccctctacttcctccccctctcgcttctctgcacaggctctgacggcctctagtgacgctagacacacgtcccacccgtggtcgtacacggtccgtaccccgaggaccaggaccggaccaggactcctaccgtgccgttcgaggagtatcggctaagttccgaaccgaaaaccgtatagttcgtactttagttaggtaaccacgacgaaggaaccggcccgggacctaccggcccgtggtttacggtttagggntacgtacggtaataaaacggctacggaggtaacggaccggtccctacgggacggtaccttccggacggtaggtcccgttaacgttccggtcgtaccggcccgtacggtacggggtacgaacgggaaccgttaaccgtcgtaactacggtaccggacccttaanaaccggtggtacgggtacgtaccgggaccgaaggacggggtaagtcggtaacggtcgtttacgaagttacgttaaggttacctaccgtaacgtaacaaaccgacggaaaccttaccgtaagtttacgttacgttacggtacgtttccggtaccgaacgttccggtaacccgtaacgtacggttacccccggcggttttaccgggaccgtacccggaaccaaccccggg

SEQ ID NO: 66580 - DNA, 739 bp, Homo sapiens
  misc_feature: GYAE6OF02JFIPU.51.59.F04.1.454.CMB.1.raw
  modified_base (158)..(158): a, c, t, g, unknown or other
  misc_feature (158)..(158): n is a, c, g, or t
  modified_base (268)..(268): a, c, t, g, unknown or other
  misc_feature (268)..(268): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
tcagcgatcgtatacacgaccggtgctcgatttagtacacacacttagggattggggctggggagcctagctgtgctgtgggtccaggaggcagaactctgggtgtctcaccatggcctggactccctctacttcctcccctctcactctctgcacgngctctgacgcctcctagtgagctagacacgacgcccacccgttcggtgttcaggtccgtaccccgaggaacacggaccggtccaaggtactccacctgcctgtaggacgntgctactacggaccaaacgtattagtgtactttagtacggtaacagcgaaacggccggacccggccgaccggtcccgttggtacggttggtanaattaggtaaanaacgtaccgtagtacggacggtacgtcccgtaggacggtacctccggtagacgtctacgttcctgccggtactccgagggtaccgacggttaaacgccgtacgaacgtgtaccggacaagtcggtaaggtaccgggtacgcccgggagtaaccggaggttaaccgggacggtaccgttaggtaacctttaagggttaaattttacccgggttagaaaccttaacgtaaccctaaaggaaccaccgtttaccgttagtttaacccgttaggttttaacctcggtttaacccggttactaaccgggacttaaccccggggacgttaaacccggggttccctaaccccgggttggtaccgggttaaccc

SEQ ID NO: 66581 - DNA, 827 bp, Homo sapiens
  misc_feature: GYAE6OF02IRP23.51.59.F04.1.454.CMB.1.raw
  modified_base (159)..(159): a, c, t, g, unknown or other
  misc_feature (159)..(159): n is a, c, g, or t
  modified_base (777)..(777): a, c, t, g, unknown or other
  misc_feature (777)..(777): n is a, c, g, or t
tcagcgatcgtatacacgaccggtgctcgatttagtacacacacttagggattggggctggggagcctagctgtgctgtgggtccaggaggcagaactctgggtgtctcaccatggcctggactccctctacttctccccctctcactctctcgcacgnggcctctggacgccctctatgagctcgaccacacgccctaccgtcggtctcgtacggttccgtaccccgaaggaccacggaccggaccgaggtacctccacccgtgccgttacgagggtactacgtcgtctacgttacgaacccgaaaccgtagtaccgttcgtaacgtttacgttacggaaccgtacggacgaacggtaaccggtccccgggacccgtacccggtcccgttggtttacgggttacgtacggttaccgtaaaggttaaacgtaaaccgacgttaacggtacggtaacgggaccgttacccggtaacgacggggttacccttccggtaaggtacgtaccggttaactttcccggttcggtaccgtcccggtaaccgggtacgggtaacgaacccggggttaacctacccgggttacaaccggttcggtttaaccgacccgttaagtacggtacggttacggaccgttaccggcgggtaacaacggggtaaaccgacgggtacggtacgtttacgtacgtttaaacgtttcgttaacgacgtaattaaccgaaccgtactaacgttacctaggtttacgtttaccgtacgtttacgtaccggttaaccgngtaacccggagtaacccggtaccgtccggttccgtaccggtcggtacccg

SEQ ID NO: 66582 - DNA, 812 bp, Homo sapiens
  misc_feature: GYAE6OF02IHME3.51.59.F04.1.454.CMB.1.raw
  modified_base (156)..(156): a, c, t, g, unknown or other
  misc_feature (156)..(156): n is a, c, g, or t
  modified_base (161)..(161): a, c, t, g, unknown or other
  misc_feature (161)..(161): n is a, c, g, or t
  modified_base (193)..(193): a, c, t, g, unknown or other
  misc_feature (193)..(193): n is a, c, g, or t
  modified_base (297)..(297): a, c, t, g, unknown or other
  misc_feature (297)..(297): n is a, c, g, or t
  modified_base (709)..(709): a, c, t, g, unknown or other
  misc_feature (709)..(709): n is a, c, g, or t
tcagcgatcgtatacacgaccggtgctcgatttagtacacacacttagggattggggctgggggagcctagctgtgctgtgggtccaggaggcagaactcgtgggtgtctcaccatggcctggactccctctacttcctccccctcctcactctcngcacngctcgtgacgtcctcctatgagctgacacgcnccctacccgtggtctcgagtccgtaccccgaggacacggaccggaccgaggactccgacctcgccgtgaggactagtcgactacgttccgaacccgaaaacgtnttacgtcgttacgtttaagttccggaccagacgaacggaccggccccggaccgtcccggtcccttggttacggttcggagtaacgttaaggtaacgtaaagaccgtacggtagaccggtaccgtccgtacggaacggtccgttcccgaggtactcgttaccgttcgtccggtacggtcctaccgggtacggaaccggtacgggaaccgtaacggtcctaacgttacggttaccggactaaccgttacggaggttaccgggtaccgttacggacggtaccgaacggggtaaccggcggtaccggtcggttaaacggtaagttttaaacgtttcgttaaaccggttaacccgtaaataaccggttaaacaaacccgggttaacctaacccggttttagtacccggtttttaacnccgggtttaaccgttacgggttaaccccggtaagttcccggtaaacccggttaacccggttaccggacccggttacccgttacccggggtagtaacccccggg

SEQ ID NO: 66583 - DNA, 787 bp, Homo sapiens
  misc_feature: GYAE6OF02I09WI.51.59.F04.1.454.CMB.1.raw
  modified_base (252)..(252): a, c, t, g, unknown or other
  misc_feature (252)..(252): n is a, c, g, or t
tcagcgatcgtatacacgaccggtgctcgatttagtacacacacttagggattggggggggagcctagctgtgctgtgggtccaggaggcagaactctgggtgtctcaccatggcctggatccctctacttcctcccctctcactctctgcacaggctcgtggacggccctcctagtgagctgacacacgcctacccgtggtgtcgagtcgtcccgaggacaggaccgtccaggactcaccgtgcgttacgnggagtactcgcgtattcggaccctaaacgacttatcggtacttagttcgtaccgagacgacgaacgggcccggacgacggtccccgttggtcggttcggtagtagtacgtaattaacggacctagtggaacgcggtaccctaggtacggacctaccggtagaccgggttacacgtttccgtcggtaccgtacgttacggtaccggtacgggtaacgggaaaccgtaccggtaccgtaacttaccgggttacgaacctacggttagtacgggtaaacggttcgaacccgggttagggaacggttacggaacgggttaacgcggtaccgttaagtaaccgttggtttaaaccgtttcggaaccttaaggtaaccttaacgggacgttaaccccgtaagttaacggtttccggtttaagttccggttttaacggtcccgttttaaaccgggaagttcccgggaaccgttaacccgggttaacggtcccgttaaaccccggggtttcggtaccggttaacgcccccggtaaaccccggg

SEQ ID NO: 66584 - DNA, 1143 bp, Homo sapiens
  misc_feature: GYAE6OF02ID05B.51.59.F04.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
tcagcgatcgtatacacgaccggtgctcgatttagtacacacacttagggattggggctggggagcctagctgtgctgtgggtccaggaggcagaactctgggtgtctcacatggcctggactcctctacttcctcccctcctcactctctgcacacggctctgagtcctactatgagctgacacacgccctacccgtcggtntcgacgtccgtaccccgaaggacacggaccggccgaggtactaccgaccttgcgttcgnggganagttcgtactagttaccgaaaccaacggtattacgtcgtacttttacgtacggtaccgagtacgaacggaccggaccgggaccgtccggtacccgtggtttggttacggtacgtaagttaacggtaacgtaaaacggtaccgtacgtacggtaaaccgggtcgtacccggttaacggacgggttacccgttaccggtacggtaaccggtttacccggttaacgtttaaccccgtttcccgggtttacggggtaccccctttaaccggggtaacggggtttaaccccgggtaaacggggggttaaacccccgttaaacccggtttaaaccccgggttaaccgggtttaaaaccgggttttccccgggggtaaaaacccctttaaaccggggtttaacccggggttaaacgggggttttaaaaccccgggggggaaacccgtttttaacccccggggggaaaaaccggggtttccccggggaaaaaacggggggttttccccgggggaaaaaacggggggtttaccccgggggtttaaccccgggttttttaaaaaccgggggtttaaaacccttttaaaacccgggggtttttttttcctaaaaacccccgggggttttaaaaccttaaacccgttttaaacccgggtaaaaaacccggtaccggtttaaaacccccgtttttaaggtttaacgggttttaacccggttttaaacccgggttttttacgtacccggggggttttttaaaccccttttaacccggggggtaaacgtttaaaccccggttcccgggttaaaacccggggttaaaccccgggtttaaccccggtttaacccccgggttaccggggtttacgggtttaaaacccccccggg

SEQ ID NO: 66585 - DNA, 693 bp, Homo sapiens
  misc_feature: GYAE6OF02JXE8J.51.59.F04.1.454.CMB.1.raw
  modified_base (501)..(501): a, c, t, g, unknown or other
  misc_feature (501)..(501): n is a, c, g, or t
tcagcgatcgtatacacgaccggtgctcgatttagtacacacacttagggagttggggggggagcctagctgtgctgtgggtccaggaggcagaactctgggtgtctcaccatcggcctggactccctctacttctcccctctcactctctgcacaggctctgacggcctctatgagctgacacacgccctaccgtcggtcgtcagtcgtccccaaggtaccaggaccggccgaaggactaccacctgcctcgtaggagatcggactagttacggaccaaaacgatactcgtactttaacgttcggacctaagcgtaaggaaccggacccgggaccgtacgggaccccgttaggttacgtttacgggagtacgttacgtaaacgtaaaacggaccgtacgtacggaacggacggtaccctacggacgggtactccgtgacgtacgtattctcgtcggctaccgaggtcgaacgggacacggtctacgtgttcggactacgngtacggtacggtacgtccgaggacagggtaacgaggtacggctaacgtacttaagttagttacgtactaacgtacgaaactacgaacctacgtaacgttcggttacttacggtcgttacgttaacgggtactacggtacgaaccgttaggtaccctaaccggttaccgtcgggtaccctaccggtaacccgg

SEQ ID NO: 66586 - DNA, 667 bp, Homo sapiens
  misc_feature: GYAE6OF02H6I50.51.59.F04.1.454.CMB.1.raw
  modified_base (88)..(88): a, c, t, g, unknown or other
  misc_feature (88)..(88): n is a, c, g, or t
  modified_base (135)..(135): a, c, t, g, unknown or other
  misc_feature (135)..(135): n is a, c, g, or t
  modified_base (268)..(268): a, c, t, g, unknown or other
  misc_feature (268)..(268): n is a, c, g, or t
  modified_base (555)..(555): a, c, t, g, unknown or other
  misc_feature (555)..(555): n is a, c, g, or t
  modified_base (572)..(572): a, c, t, g, unknown or other
  misc_feature (572)..(572): n is a, c, g, or t
tcagcgatcgtatacacgaccggtgctcgatttagtacacacacttagggattgggggggggagcctagctgtgctgtgggtccaggnggacagaactctgggtgtctcaccatggcctggatccctctactccncccctcctcactctctgcacaggctctggagcctcctatgagctgaccacacgccctaaccccgtcggtgtacgaggtccggtacccccgaggaccgaaggaccggcccaggactcgacctggctcgtagganagtcgactagttacgaccgaaaaccgtagtacgtgtattacgttacggtaaccgaacgtacgaacggaaaccggccccgggaccgaccggttacccccgtggttggtgggttagaagttagtaaagtaaacgacgacgtaggagaccggaccgtacggaacgggtactccgtacggacgtacgtacctcgtcgtcgtacgtccgaacggtcgaacggtacgtaacggtactacgtagtgacctgtacgtcggtaggccgtcgacgacgagacgggagtgcgtacgtntattacgtagtactaanaacgaactcgaactactacgttagttacttgtcgtcgtacgtagtaccgtaccggaacgttggtacccgacgttcgtaccggtacacgtaacccg

SEQ ID NO: 66587 - DNA, 843 bp, Homo sapiens
  misc_feature: GYAE6OF02JRTGO.51.59.F04.1.454.CMB.1.raw
  modified_base (270)..(270): a, c, t, g, unknown or other
  misc_feature (270)..(270): n is a, c, g, or t
tcagcgatcgtatacacgaccggtgctcgatttagtacacacacttagggattgggggggggagcctagctgtgctgtgggtccaggaggcagaactctgggtgtctcaccatggcctggactcccctctacttcctcccctcctcactctctgcacaggctctgacggcctcctatgacgtctgacacgacgccctacccgtcggtgtcctagtcgtccccgaggacacggacggccaaggactcaaccgtcgacctcgtagggaagtntcgactagttacgaaccgtaaaccgtactagtcgtaccgtttacgttacggtaaccgagtaacgaacggaaccggccccgggtacccggtaccggccccgttggttacggtttaggtacgtaacggtacgtaaaaacgtaaccgtaacgtaccgtacggaacggtaaccgtcccggtaacggtaccgggtacttcccgtagtaccggtacgttaaccgtttcctacggtaccggtccgtacccggtaacgggtaccggtaacgggtacccgggtaaaccgtcctaaacgttcggtttaaaccgggaccccttaggttacggtacgggttaacggggtaacccgttacggaccgggaacggttaacgggaaacgggtacgtaacggggtaccttacgggtaaaccttagtttaccgttacggtaacgtaaccgtaactaaaagcccgtaaactaaccgttacgtttaacgttaccgttaacgttaccggttaccttaaccgggtaactaccgggtaacccacgggttacggcccgttaaccgtccgggttacgtacccgggtaccaaccccggg

SEQ ID NO: 66588 - DNA, 804 bp, Homo sapiens
  misc_feature: GYAE6OF02HFI8A.51.59.F04.1.454.CMB.1.raw
  modified_base (281)..(281): a, c, t, g, unknown or other
  misc_feature (281)..(281): n is a, c, g, or t
tcagcgatcgtatacacgaccggtgctcgatttagtacacacacttagggattggggctggggagcctagctgtgctgtgggtccaggaggcagaactcgtgggtgtctcaccatggcctggatcctctacttctcccctcctcactctctgcacaggcttctaggacggccttacctagtgacgtcctgaccaacacgccctacccgttcggtcgttacgaggtccgtccccgaaggacgacggacggccgaggaacttccacctcgcgtcgtagggtanacgtgactacgtcggaaccaaaccgtattacgtacttactttaagttcggttaaccgaggacgaacggaaccgggcccgggaccggtaccggtccccgttgggtttcggtttcgggtagtaacgttaggtaaacgttaaaacgacctaacggtacggaacgggcccggtaaccgtacggaggtaccttaccggtacggacgtcgtacgttactcccggttacggtcccgtaccgacggttaccggaacgggtaaccggtaaccgtacgtaacgtacggtttacggacctacggtaccggttaggtaccgggttacgacccggacggaacgtaacgggaaccggacgggaaccggtactacgggttaaaactttcggttttaacgtaacggttactaaacggttaaacaacgtacgtaaccgtaccttaggtttacgttttaacgtcttacggtttacttaaccggagttaaccgggcctttaaacggaccggttacccgttaccggttacgtaccggtacccg

SEQ ID NO: 66589 - DNA, 727 bp, Homo sapiens
  misc_feature: GYAE6OF02F1IUQ.51.59.F04.1.454.CMB.1.raw
tcagcgatcgtatacacgaccggtgctcgatttagtacacacacttagggattggggggggagcctagctgtgctgtgggtccaggaggcagaactctgggtgtctcaccatggcctggatccctctacttcctccccctcctcactctctgcacaggctctgaggcctcctatgagctgacacacgcccacccgtcggtgtcagtcgtccccaggacacgacggccaggactccacctgctcgtggagagtgctattcgaccaaatcgatagtgtctttagttaggtacccagcaggaacggcccgggccaccggtcccccgttaggttcggttggtagagtagtaaagtaaaagtaccacgtacgaggaccggtccctaggacgggtacctcccgtaggacgacgttacttaccgtcgtcggtccgtaccgtacgggtacggaacgggaacgtaaccggtactaacgtacggttcggacctagtaccgtagggtacggtacggtacccggaagggaccgtaacgggaacgggtaaccggaagggtaccgtaacggttaacgttagtttacgtttacgtaactaacgtaaccgaaaacgtacgaaccctaacggttagtttaccgttaaacgttgttaccggttaccggttacggtaaccgttccggtaacggtaccgtaccggttacccgtacccggttaccgggttcggtacgtaacccccggg

SEQ ID NO: 66590 - DNA, 162 bp, Homo sapiens
  misc_feature: GYAE6OF01C7Y8J.49.73.G07.1.454.CMB.1.raw
  modified_base (162)..(162): a, c, t, g, unknown or other
  misc_feature (162)..(162): n is a, c, g, or t
tcagagtcgagagacacgaccggtgctcgatttagctctacgctcagggcacgaccggtgctcgatttagtcacgcgagaaagggaaaggggctggccctgacgtgtttctgttcccaccctcctctctctcgactctgagcgggctggcaaggcgcatagn

SEQ ID NO: 66591 - DNA, 161 bp, Homo sapiens
  misc_feature: GYAE6OF01BUTN5.49.73.G07.1.454.CMB.1.raw
  modified_base (161)..(161): a, c, t, g, unknown or other
  misc_feature (161)..(161): n is a, c, g, or t
tcagagtcgagagacacgaccggtgctcgatttagctctacgctcagggcacgaccggtgctcgatttagtcacgcgagaaagggaaggggctggccctgacgtgtttctgttcccaccctcctctctctcgactctgagcgggctggcaaggcgcatagn

SEQ ID NO: 66592 - DNA, 159 bp, Homo sapiens
  misc_feature: GYAE6OF01B51X7.49.73.G07.1.454.CMB.1.raw
  modified_base (159)..(159): a, c, t, g, unknown or other
  misc_feature (159)..(159): n is a, c, g, or t
tcagagtcgagagacacgaccggtgctcgatttagctctacgctcagggcacgaccggtgctcgatttagtcacgcgagaagggaaggggctggccctgacgtgtttctgttcccacctcctctctctcgactctgagcgggctggcaaggcgcatagn

SEQ ID NO: 66593 - DNA, 183 bp, Homo sapiens
  misc_feature: GYAE6OF01AR45E.49.73.G07.1.454.CMB.1.raw
  modified_base (182)..(183): a, c, t, g, unknown or other
  misc_feature (182)..(183): n is a, c, g, or t
tcagagtcgagagacacgaccggtgctcgatttagctctacgctcaggcacgaccggtgctcgatttagctctacgctcagggcacgaccggtgctcgatttagtcgatagtgaagggctatgcgtcttcatcttcccgcctcctctctctagactctgagcgggctggcaaggcgcatagnn

SEQ ID NO: 66594 - DNA, 160 bp, Homo sapiens
  misc_feature: GYAE6OF01A3KMY.49.73.G07.1.454.CMB.1.raw
  modified_base (160)..(160): a, c, t, g, unknown or other
  misc_feature (160)..(160): n is a, c, g, or t
tcagagtcgagagacacgaccggtgctcgatttagctctacgctcagggcacgaccggtgctcgatttagtcacgcgagaaagggaaggggctggccctgacgtgttctgttcccgccctcctctctctcgactctgagcgggctggcaaggcgcatagn

SEQ ID NO: 66595 - DNA, 195 bp, Homo sapiens
  misc_feature: GYAE6OF01AUM7G.49.73.G07.1.454.CMB.1.raw
  modified_base (193)..(195): a, c, t, g, unknown or other
  misc_feature (193)..(195): n is a, c, g, or t
tcagagtcgagagacacgaccggtgctcgatttagctctacgctcagggcacgaccggtgctcgatttagctctacgctcagggcacgaccggtgctcgatttagtcacgcgagaaggaagggctggccctgacgtgtttctgttcccaccctcctctctctcgactctgagcgggctggcaaggcgcatagnnn

SEQ ID NO: 66596 - DNA, 162 bp, Homo sapiens
  misc_feature: GYAE6OF01EC5D0.49.73.G07.1.454.CMB.1.raw
  modified_base (162)..(162): a, c, t, g, unknown or other
  misc_feature (162)..(162): n is a, c, g, or t
tcagagtcgagagacacgaccggtgctcgatttagctctacgctcagggcacgaccggtgctcgatttagtcacgcgagaaagggaaaggggctggccctgacgtgtttctgttcccgccctcctctctctcgactctgagcgggctggcaaggcgcatagn

SEQ ID NO: 66597 - DNA, 161 bp, Homo sapiens
  misc_feature: GYAE6OF01DMPC1.49.73.G07.1.454.CMB.1.raw
  modified_base (161)..(161): a, c, t, g, unknown or other
  misc_feature (161)..(161): n is a, c, g, or t
tcagagtcgagagacacgaccggtgctcgatttagctctacgctcagggcacgaccggtgctcgatttagtcacgcgagaaagggaaagggctggccctgacgtgtttctgttcccgccctcctctctctcgactctgagcgggctggcaaggcgcatagn

SEQ ID NO: 66598 - DNA, 198 bp, Homo sapiens
  misc_feature: GYAE6OF01B3PQT.49.73.G07.1.454.CMB.1.raw
  modified_base (194)..(198): a, c, t, g, unknown or other
  misc_feature (194)..(198): n is a, c, g, or t
tcagagtcgagagacacgaccggtgctcgatttagctctacgctcagggcacgaccggtgctcgatttagctctacgctcagggcacgaccggtgctcgatttagtcacgcgagaaagggaaggggctggccctgacgtgttctgttcccgcctcctctctctcgactctgagcgggctggcaaggcgcatagnnnnn

SEQ ID NO: 66599 - DNA, 160 bp, Homo sapiens
  misc_feature: GYAE6OF01B6EWG.49.73.G07.1.454.CMB.1.raw
  modified_base (160)..(160): a, c, t, g, unknown or other
  misc_feature (160)..(160): n is a, c, g, or t
tcagagtcgagagacacgaccggtgctcgatttagctctacgctcagggcacgaccggtgctcgatttagtcacgcgagaaagggaaggggctggccctgacgtgtttctgttcccacctcctctctctcgactctgagcgggctggcaaggcgcatagn

SEQ ID NO: 66600 - DNA, 163 bp, Homo sapiens
  misc_feature: GYAE6OF01BIDKK.49.73.G07.1.454.CMB.1.raw
  modified_base (162)..(163): a, c, t, g, unknown or other
  misc_feature (162)..(163): n is a, c, g, or t
tcagagtcgagagacacgaccggtgctcgatttagctctacgctcagggcacgaccggtgctcgatttagtcacgcgagaaagggaaaggggctggccctgacgtgtttctgttcccaccctcctctctctcgactctgagcgggctggcaaggcgcatagnn

SEQ ID NO: 66601 - DNA, 161 bp, Homo sapiens
  misc_feature: GYAE6OF01D95AQ.49.73.G07.1.454.CMB.1.raw
  modified_base (161)..(161): a, c, t, g, unknown or other
  misc_feature (161)..(161): n is a, c, g, or t
tcagagtcgagagacacgaccggtgctcgatttagctctacgctcagggcacgaccggtgctcgatttagtcacgcgagaaagggaaaggggctggccctgacgtgtttctgttcccgcctcctctctctcgactctgagcgggctggcaaggcgcatagn

SEQ ID NO: 66602 - DNA, 160 bp, Homo sapiens
  misc_feature: GYAE6OF01EUVLJ.49.73.G07.1.454.CMB.1.raw
  modified_base (160)..(160): a, c, t, g, unknown or other
  misc_feature (160)..(160): n is a, c, g, or t
tcagagtcgagagacacgaccggtgctcgatttagctctacgctcagggcacgaccggtgctcgatttagtcacgcgagaaagggaaagggtggccctgacgtgtttctgttcccgccctcctctctctcgactctgagcgggctggcaaggcgcatagn

SEQ ID NO: 66603 - DNA, 217 bp, Homo sapiens
  misc_feature: GYAE6OF01B2KFS.49.73.G07.1.454.CMB.1.raw
  modified_base (198)..(217): a, c, t, g, unknown or other
  misc_feature (198)..(217): n is a, c, g, or t
tcagagtcgagagacacgaccggtgctcgatttagctctacgctcagggcgacgaccggttgctcgatttagctctacgctcagggcacgaccggtgctcgattagtcacgcgagaaagggaaggggctggccctgacgtgtttctgttcccgcctcctctctactcgacctctgagcgggctggcaaggcgcatagnnnnnnnnnnnnnnnnnnnn

SEQ ID NO: 66604 - DNA, 208 bp, Homo sapiens
  misc_feature: GYAE6OF01AO25T.49.73.G07.1.454.CMB.1.raw
  modified_base (208)..(208): a, c, t, g, unknown or other
  misc_feature (208)..(208): n is a, c, g, or t
tcagagtcgagagacacgaccggtgctcgatttagctctacgctcagggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 66605 - DNA, 209 bp, Homo sapiens
  misc_feature: GYAE6OF01BHRQA.49.73.G07.1.454.CMB.1.raw
  modified_base (208)..(209): a, c, t, g, unknown or other
  misc_feature (208)..(209): n is a, c, g, or t
tcagagtcgagagacacgaccggtgctcgatttagctctacgctcagggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 66606 - DNA, 155 bp, Homo sapiens
  misc_feature: GYAE6OF01EF2VK.49.73.G07.1.454.CMB.1.raw
  modified_base (155)..(155): a, c, t, g, unknown or other
  misc_feature (155)..(155): n is a, c, g, or t
tcagagtcgagagacacgaccggtgctcgatttagctctacgctcagggcacgaccggtgctcgatttagtcacgcgagaaagggaaagggctagcgtgttcctgttcccaccctcctctctctcgactctgagcgggctggcaaggcgcatagn

SEQ ID NO: 66607 - DNA, 208 bp, Homo sapiens
  misc_feature: GYAE6OF01BLO4E.49.73.G07.1.454.CMB.1.raw
  modified_base (206)..(208): a, c, t, g, unknown or other
  misc_feature (206)..(208): n is a, c, g, or t
tcagagtcgagagacacgaccggtgctcgatttagctctacgctcagggcacgaccggtgctcgatttagagagagtgtgttgggtttggggaagaggaagactgacggtcccccaggagttcaggtgctgggcacagcggcctgggctgcctggtcaaggactacttcctcgtagcactctgagcgggctggcaaggcgcatagnnn

SEQ ID NO: 66608 - DNA, 180 bp, Homo sapiens
  misc_feature: GYAE6OF01CAZ09.49.73.G07.1.454.CMB.1.raw
  modified_base (159)..(180): a, c, t, g, unknown or other
  misc_feature (159)..(180): n is a, c, g, or t
tcagagtcgagagacacgaccggtgctcgatttagctctacgctcagggcgacgaccggtgctcgatttagtcacgcgagaagggaagggctggccctgacgtgttctgttcccgcctcctctctctcgactctggagcgggctggcaaggcgcatagnnnnnnnnnnnnnnnnnnnnnn

SEQ ID NO: 66609 - DNA, 134 bp, Homo sapiens
  misc_feature: GYAE6OF01CO8O4.49.73.G07.1.454.CMB.1.raw
  modified_base (119)..(134): a, c, t, g, unknown or other
  misc_feature (119)..(134): n is a, c, g, or t
tcagagtcgagagacacgaccggtgctcgatttagctctacgctcgagggcacgaccggtgctcgatttatccacaccctcctctctctcgactctgagcggctggcaaggcgcatagnnnnnnnnnnnnnnnn

SEQ ID NO: 66610 - DNA, 143 bp, Homo sapiens
  misc_feature: GYAE6OF01BBXVP.49.73.G07.1.454.CMB.1.raw
  modified_base (143)..(143): a, c, t, g, unknown or other
  misc_feature (143)..(143): n is a, c, g, or t
tcagagtcgagagacacgaccggtgctcgatttagctctacgctcagggcacgaccggtgctcgatttagctctacgctcagggcacgaccggtgctcgatttagtatctgatagttgggagcgggctggcaaggcgcatagn

SEQ ID NO: 66611 - DNA, 209 bp, Homo sapiens; identical to SEQ ID NO: 66605
  misc_feature: GYAE6OF01EE8MW.49.73.G07.1.454.CMB.1.raw
  modified_base (208)..(209): a, c, t, g, unknown or other
  misc_feature (208)..(209): n is a, c, g, or t

SEQ ID NO: 66612 - DNA, 202 bp, Homo sapiens
  misc_feature: GYAE6OF01DKE13.49.73.G07.1.454.CMB.1.raw
  modified_base (189)..(202): a, c, t, g, unknown or other
  misc_feature (189)..(202): n is a, c, g, or t
tcagagtcgagagacacgaccggtgctcgatttagctctacgctcgagggcacgaccggtgctcgatttacgctctacgctcagggctacgaccggtgctcgatttagtcgatagtgaagggctatgcgtcttcatcttcccaccctcctctctcttcgactctgagtcgggctggcaaggcgcatagnnnnnnnnnnnnnn

SEQ ID NO: 66613 - DNA, 162 bp, Homo sapiens
  misc_feature: GYAE6OF01AT5AL.49.73.G07.1.454.CMB.1.raw
  modified_base (162)..(162): a, c, t, g, unknown or other
  misc_feature (162)..(162): n is a, c, g, or t
tcagagtcgagagacacgaccggtgctcgatttagctctacgctcagggcacgaccggtgctcgatttagtcacgcgagaaagggaaaggggctggccctgacgtgtttctgttcccaccctcatctctctcgactctgagcgggctggcaaggcgcatagn

SEQ ID NO: 66614 - DNA, 160 bp, Homo sapiens
  misc_feature: GYAE6OF01BZYZC.49.73.G07.1.454.CMB.1.raw
  modified_base (160)..(160): a, c, t, g, unknown or other
  misc_feature (160)..(160): n is a, c, g, or t
tcagagtcgagagacacgaccggtgctcgatttagctctacgctcagggcacgaccggtgctcgatttagtcacgcgagaaagggaaagggctggccctgacgtgtttctgttcccgcctcctctctctcgactctgagcgggctggcaaggcgcatagn

SEQ ID NO: 66615 - DNA, 298 bp, Homo sapiens
  misc_feature: GYAE6OF01EHR1M.49.73.G07.1.454.CMB.1.raw
  modified_base (167)..(167): a, c, t, g, unknown or other
  misc_feature (167)..(167): n is a, c, g, or t
  modified_base (281)..(298): a, c, t, g, unknown or other
  misc_feature (281)..(298): n is a, c, g, or t
tcagagtcgagagacacgaccggtgctcgatttagctctacgctcagggcgacgaccggtgctcgatttagctctacgctcagggcacgaccggtgctcgatttagctctacgctcagggcacgaccggtgctcgatttagagagagtgtgttgggtttgggggaanaggaagactgacggtccccccaggagttcaggtgcgtgggcacagcggccctgggctgcctggtcaaggactactcctctctcgactctgagcgggctaggcaaggcgcatagnnnnnnnnnnnnnnnnnn

SEQ ID NO: 66616 - DNA, 165 bp, Homo sapiens
  misc_feature: GYAE6OF01EN24I.49.73.G07.1.454.CMB.1.raw
  modified_base (162)..(165): a, c, t, g, unknown or other
  misc_feature (162)..(165): n is a, c, g, or t
tcagagtcgagagacacgaccggtgctcgatttagctctacgctcagggcacgaccggtgctcgatttagtcacgcgagaaagggaaaggggctggccctgacgtgtttctgttcccgccctcctctctctcgactctgagcgggctggcaaggcgcatagnnnn

SEQ ID NO: 66617 - DNA, 238 bp, Homo sapiens
  misc_feature: GYAE6OF01D1FWD.49.73.G07.1.454.CMB.1.raw
  modified_base (182)..(238): a, c, t, g, unknown or other
  misc_feature (182)..(238): n is a, c, g, or t
tcagagtcgagagacacgaccggtgctcgatttagctctacgctcaggggtagcgtcgtacgctcagggcacgaccggtgctcgatttagtcacgcgagaaagggaaggggctggccctgacgtgtttctgttcccaccctctctctctcgactcgtgagcgggactggcaaggcgcatagnnnnnnnnnnnnnnnnnnnnnnnnnnnnnnnnnnnnnnnnnnnnnnnnnnnnnnnnn

SEQ ID NO: 66618 - DNA, 163 bp, Homo sapiens
  misc_feature: GYAE6OF01A808G.49.73.G07.1.454.CMB.1.raw
  modified_base (163)..(163): a, c, t, g, unknown or other
  misc_feature (163)..(163): n is a, c, g, or t
tcagagtcgagagacacgaccggtgctcgatttagctctacgctcagggcacgaccggtgctcgatttagtcacgcgagaaagggaaagggggctggccctgacgtgtttctgttcccaccctcctctctctcgactctgagcgggctggcaaggcgcatagn

SEQ ID NO: 66619 - DNA, 162 bp, Homo sapiens
  misc_feature: GYAE6OF01AWHFW.49.73.G07.1.454.CMB.1.raw
  modified_base (161)..(162): a, c, t, g, unknown or other
  misc_feature (161)..(162): n is a, c, g, or t
tcagagtcgagagacacgaccggtgctcgatttagctctacgctcagggcacgaccggtgctcgatttagtcacgcgagaaagggaaggggctggccctgacgtgtttctgttcccaccctcctctctctcgactctgagcgggctggcaaggcgcatagnn

SEQ ID NO: 66620 - DNA, 162 bp, Homo sapiens
  misc_feature: GYAE6OF01ED79A.49.73.G07.1.454.CMB.1.raw
  modified_base (160)..(162): a, c, t, g, unknown or other
  misc_feature (160)..(162): n is a, c, g, or t
tcagagtcgagagacacgaccggtgctcgatttagctctacgctcagggcacgaccggtgctcgatttagtcacgcgagaaagggaaaggggctggccctgacgtgttctgttcccacctcctctctctcgactctgagcgggctggcaaggcgcatagnnn

SEQ ID NO: 66621 - DNA, 175 bp, Homo sapiens
  misc_feature: GYAE6OF01A5YFE.49.73.G07.1.454.CMB.1.raw
  modified_base (159)..(175): a, c, t, g, unknown or other
  misc_feature (159)..(175): n is a, c, g, or t
tcagagtcgagagacacgaccggtgctcgatttagctctacgctcagggcacgaccggtgctcgatttagtcacgcgagaaacggaaggggctggccctgacgtgttctgttcccacctcctctctctcgactctgagcgggctggcaaggcgcatagnnnnnnnnnnnnnnnnn

SEQ ID NO: 66622 - DNA, 162 bp, Homo sapiens
  misc_feature: GYAE6OF01DTZ9U.49.73.G07.1.454.CMB.1.raw
  modified_base (161)..(162): a, c, t, g, unknown or other
  misc_feature (161)..(162): n is a, c, g, or t
tcagagtcgagagacacgaccggtgctcgatttagctctacgctcagggcacgaccggtgctcgatttagtcacgcgagaaagggaaagggctggccctgacgtgtttctgttcccaccctcctctctctcgactctgagcgggctggcaaggcgcatagnn

SEQ ID NO: 66623 - DNA, 208 bp, Homo sapiens; identical to SEQ ID NO: 66604
  misc_feature: GYAE6OF01EBDOJ.49.73.G07.1.454.CMB.1.raw
  modified_base (208)..(208): a, c, t, g, unknown or other
  misc_feature (208)..(208): n is a, c, g, or t

SEQ ID NO: 66624 - DNA, 209 bp, Homo sapiens; identical to SEQ ID NO: 66605
  misc_feature: GYAE6OF01A0WJU.49.73.G07.1.454.CMB.1.raw
  modified_base (208)..(209): a, c, t, g, unknown or other
  misc_feature (208)..(209): n is a, c, g, or t

SEQ ID NO: 66625 - DNA, 212 bp, Homo sapiens
  misc_feature: GYAE6OF01D5XPD.49.73.G07.1.454.CMB.1.raw
  modified_base (208)..(212): a, c, t, g, unknown or other
  misc_feature (208)..(212): n is a, c, g, or t
tcagagtcgagagacacgaccggtgctcgatttagctctacgctcagggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnn

SEQ ID NO: 66626 - DNA, 209 bp, Homo sapiens; identical to SEQ ID NO: 66605
  misc_feature: GYAE6OF01AY0W0.49.73.G07.1.454.CMB.1.raw
  modified_base (208)..(209): a, c, t, g, unknown or other
  misc_feature (208)..(209): n is a, c, g, or t

SEQ ID NO: 66627 - DNA, 214 bp, Homo sapiens
  misc_feature: GYAE6OF01CX6DR.49.73.G07.1.454.CMB.1.raw
  modified_base (208)..(214): a, c, t, g, unknown or other
  misc_feature (208)..(214): n is a, c, g, or t
tcagagtcgagagacacgaccggtgctcgatttagctctacgctcagggcacgaccggtgctcgatttagagtgagctcgttgggtttgggggaagaggaagactgacggtcccccaggagttcaggtgctgggcacagcggccctgggctgcctggtcaaggactacttcctctctcgactctgagcgggctggcaaggcgcatagnnnnnnn

SEQ ID NO: 66628 - DNA, 160 bp, Homo sapiens; identical to SEQ ID NO: 66599
  misc_feature: GYAE6OF01CM55K.49.73.G07.1.454.CMB.1.raw
  modified_base (160)..(160): a, c, t, g, unknown or other
  misc_feature (160)..(160): n is a, c, g, or t

SEQ ID NO: 66629 - DNA, 155 bp, Homo sapiens
  misc_feature: GYAE6OF01AE6BG.49.73.G07.1.454.CMB.1.raw
tcagagtcgagagacacgaccggtgctcgatttagctctacgctcagggcacgaccggtgctcgatttagtcacgcgagaaaggaagggctggcctgacgtgttctgttcccacctcctctctctcgactctgagcgggctggcaaggcgcatag

SEQ ID NO: 66630 - DNA, 164 bp, Homo sapiens
  misc_feature: GYAE6OF01EBTES.49.73.G07.1.454.CMB.1.raw
  modified_base (163)..(164): a, c, t, g, unknown or other
  misc_feature (163)..(164): n is a, c, g, or t
tcagagtcgagagacacgaccggtgctcgatttagctctacgctcagggcacgaccggtgctcgatttagtcacgcgagaaagggaaagggggctggccctgacgtgtttctgttcccaccctcctctctctcgactctgagcgggctggcaaggcgcatagnn

SEQ ID NO: 66631 - DNA, 161 bp, Homo sapiens
  misc_feature: GYAE6OF01BRZDX.49.73.G07.1.454.CMB.1.raw
  modified_base (160)..(161): a, c, t, g, unknown or other
  misc_feature (160)..(161): n is a, c, g, or t
tcagagtcgagagacacgaccggtgctcgatttagctctacgctcagggcacgaccggtgctcgatttagtcacgcgagaaagggaaggggctggccctgacgtgtttctgttcccgcctcctctctctcgactctgagcgggctggcaaggcgcatagnn

SEQ ID NO: 66632 - DNA, 197 bp, Homo sapiens
  misc_feature: GYAE6OF01EXKJN.49.73.G07.1.454.CMB.1.raw
  modified_base (115)..(115): a, c, t, g, unknown or other
  misc_feature (115)..(115): n is a, c, g, or t
  modified_base (167)..(197): a, c, t, g, unknown or other
  misc_feature (167)..(197): n is a, c, g, or t
tcagagtcgagagacacgaccggtgctcgatttagctctacgctcgagggcacgaccggtgctcgatttagtcacgcaagaaagggaaagggggctggccctggaccgtgtttcngttcccaccctccgtctctctcgactctgagcgggctggcaaggcgcatagnnnnnnnnnnnnnnnnnnnnnnnnnnnnnnn

SEQ ID NO: 66633 - DNA, 487 bp, Homo sapiens
  misc_feature: GYAE6OF01B450H.49.73.G07.1.454.CMB.1.raw
  modified_base (459)..(459): a, c, t, g, unknown or other
  misc_feature (459)..(459): n is a, c, g, or t
  modified_base (480)..(480): a, c, t, g, unknown or other
  misc_feature (480)..(480): n is a, c, g, or t
tcagagtcgagagacacgaccggtgctcgatttagctctacgctcagggcacgaccggtgctcgtttagagagagtgtgttgggtttggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactatactgtcagtcatcagacagtagnggcacttctgtcgtattcggnggacggg

SEQ ID NO: 66634 - DNA, 195 bp, Homo sapiens
  misc_feature: GYAE6OF01EA35W.49.73.G07.1.454.CMB.1.raw
  modified_base (194)..(195): a, c, t, g, unknown or other
  misc_feature (194)..(195): n is a, c, g, or t
tcagagtcgagagacacgaccggtgctcgatttagctctacgctcagggcacgaccggtgctcgatttagacgacagctcagggcacgaccggtgctcgatttagtcacgcgagaaagggaaggggctggccctgacgtgtttctgttcccgcctcctctctctgactctgagcgggctggcaaggcgcatagnn

SEQ ID NO: 66635 - DNA, 250 bp, Homo sapiens
  misc_feature: GYAE6OF01AZ47R.49.73.G07.1.454.CMB.1.raw
  modified_base (249)..(250): a, c, t, g, unknown or other
  misc_feature (249)..(250): n is a, c, g, or t
tcagagtcgagagacacgaccggtgctcgatttagctctacgctcagggcacgaccggtgctcgatttagctacgctctaagggaaagggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 66636 - DNA, 163 bp, Homo sapiens; identical to SEQ ID NO: 66618
  misc_feature: GYAE6OF01BE2IS.49.73.G07.1.454.CMB.1.raw
  modified_base (163)..(163): a, c, t, g, unknown or other
  misc_feature (163)..(163): n is a, c, g, or t

SEQ ID NO: 66637 - DNA, 159 bp, Homo sapiens
  misc_feature: GYAE6OF01DKJLC.49.73.G07.1.454.CMB.1.raw
  modified_base (159)..(159): a, c, t, g, unknown or other
  misc_feature (159)..(159): n is a, c, g, or t
tcagagtcgagagacacgaccggtgctcgatttagctctacgctcagggcacgaccggtgctcgatttagtcacgcgagaaagggaagggctggccctgacgtgtttctgttcccgcctcctctctctcgactctgagcgggctggcaaggcgcatagn

SEQ ID NO: 66638 - DNA, 163 bp, Homo sapiens; identical to SEQ ID NO: 66618
  misc_feature: GYAE6OF01BRR37.49.73.G07.1.454.CMB.1.raw
  modified_base (163)..(163): a, c, t, g, unknown or other
  misc_feature (163)..(163): n is a, c, g, or t

SEQ ID NO: 66639 - DNA, 167 bp, Homo sapiens
  misc_feature: GYAE6OF01EWN5L.49.73.G07.1.454.CMB.1.raw
  modified_base (160)..(167): a, c, t, g, unknown or other
  misc_feature (160)..(167): n is a, c, g, or t
tcagagtcgagagacacgaccggtgctcgatttagctctacgctcagggcacgaccggtgctcgatttagtcacgcgagaaagggaaagggggctggccctgacgtgttctgttcccacctcctctctctcgactgaggcggctggacgaggcgcatagnnnnnnnn

SEQ ID NO: 66640 - DNA, 161 bp, Homo sapiens
  misc_feature: GYAE6OF01EBMVX.49.73.G07.1.454.CMB.1.raw
  modified_base (159)..(161): a, c, t, g, unknown or other
  misc_feature (159)..(161): n is a, c, g, or t
tcagagtcgagagacacgaccggtgctcgatttagctctacgctcagggcacgaccggtgctcgatttagtcacgcgagaaagggaaggggctggccctgacgtgttctgttcccacctcctctctctcgactctgagcgggctggcaaggcgcatagnnn

SEQ ID NO: 66641 - DNA, 497 bp, Homo sapiens
  misc_feature: GYAE6OF01A7E9C.49.73.G07.1.454.CMB.1.raw
  modified_base (469)..(469): a, c, t, g, unknown or other
  misc_feature (469)..(469): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtactttgagagggcctcgacgggacccctggacgcgattctctggctccagctcagcgacaacagtcacgttgaccatcagtggagtccgggcagaggacgaggctgactagttactgtcagtcatcagacaggtagngcacttctgtctagttcgggcggacggg

SEQ ID NO: 66642 - DNA, 535 bp, Homo sapiens
  misc_feature: GYAE6OF01CGJNW.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttacgtggtaccagcagaacgccaggccaggcccctgtctgatctatttaataaagtactttgagaggcctcgacgggacccctgagcgtacttctcgtggcctccagtcctcagccgacaacagtccacgttgaccatcgagtggacgtccgggcaggaaggacggaggctagacttattcgtgtcagtcatacgagagtaggtacgtcggacctacgttcgtagttcggttaagttccggggacgggtaaccggg

SEQ ID NO: 66643 - DNA, 164 bp, Homo sapiens; identical to SEQ ID NO: 66630
  misc_feature: GYAE6OF01A8NKN.49.73.G07.1.454.CMB.1.raw
  modified_base (163)..(164): a, c, t, g, unknown or other
  misc_feature (163)..(164): n is a, c, g, or t

SEQ ID NO: 66644 - DNA, 510 bp, Homo sapiens
  misc_feature: GYAE6OF01D6NGQ.49.73.G07.1.454.CMB.1.raw
  modified_base (225)..(225): a, c, t, g, unknown or other
  misc_feature (225)..(225): n is a, c, g, or t
  modified_base (429)..(429): a, c, t, g, unknown or other
  misc_feature (429)..(429): n is a, c, g, or t
  modified_base (481)..(481): a, c, t, g, unknown or other
  misc_feature (481)..(481): n is a, c, g, or t
  modified_base (502)..(502): a, c, t, g, unknown or other
  misc_feature (502)..(502): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctnaggacagaccggccagtatcacctgctctggagatgcattgaccaaagcaatatgtcttactggtaccagcagaagccaggccaggcccctgtcttgatctatttataaagtactttgaggagggcctcgacggacccctgagcgtattctctgctccagctcgagcgacaacagtcacgttgaccatcagtggacgtccgggnaaggaggacgaggtcgtagactattacgtgtcagtctatcgagacaggtagngcacttctgtacgtattcggnggaacggg

SEQ ID NO: 66645 - DNA, 208 bp, Homo sapiens; identical to SEQ ID NO: 66604
  misc_feature: GYAE6OF01CMB10.49.73.G07.1.454.CMB.1.raw
  modified_base (208)..(208): a, c, t, g, unknown or other
  misc_feature (208)..(208): n is a, c, g, or t

SEQ ID NO: 66646 - DNA, 225 bp, Homo sapiens
  misc_feature: GYAE6OF01CVV2O.49.73.G07.1.454.CMB.1.raw
  modified_base (210)..(225): a, c, t, g, unknown or other
  misc_feature (210)..(225): n is a, c, g, or t
tcagagtcgagagacacgaccggtgctcgatttagctctacgctcagggcacgaccggtgctcgatttagagagagtgtgttgggtttgggggaagaggaagactgaccggtccccccaggagttcaggtgctgggcacagcggccctgggctgcctggtcaaggactacttcctctctcgactctgagcgggctggcaaggcgcatagnnnnnnnnnnnnnnnn

SEQ ID NO: 66647 - DNA, 512 bp, Homo sapiens
  misc_feature: GYAE6OF01CBM20.49.73.G07.1.454.CMB.1.raw
  modified_base (427)..(427): a, c, t, g, unknown or other
  misc_feature (427)..(427): n is a, c, g, or t
  modified_base (496)..(496): a, c, t, g, unknown or other
  misc_feature (496)..(496): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagaccggccagtatcacctgctctggagatgcattgccaaagcaatatgcttactggtaccagcagaagccaggccaggcccctgtcttgatcatttataaagtactttgagagggcctacgacgggacccctgagcgtattcctctggctccagctcagcgaacaacagtcacgttgaccatcagtggagtccgggnaggaggacgaggtctagacttattactgtcagtccatcgagacaggtagtgctacgtttctgttacgtnttcgggcggtaacggg

SEQ ID NO: 66648 - DNA, 509 bp, Homo sapiens
  misc_feature: GYAE6OF01D2ECA.49.73.G07.1.454.CMB.1.raw
  modified_base (500)..(500): a, c, t, g, unknown or other
  misc_feature (500)..(500): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctggtgtctgtgtcctcaggacaggaccggccagtactcacctgctctggagatgcattgaccaaagcaatatgcttactggtaccagcagagcaggccaggcccctgtcttgatcatttaataaagtactttagagacgggcctcgacgggacccctgacgcgtattctcgtggctccagctcagcgaacaacagtcacgttgaccatcagtggagtccgggacaggaggacgagggctgactattactgtcagtcatcgagacagtagtggctacttctgttacgtagtcggnggtaacggg

SEQ ID NO: 66649 - DNA, 163 bp, Homo sapiens; identical to SEQ ID NO: 66600
  misc_feature: GYAE6OF01A23LU.49.73.G07.1.454.CMB.1.raw
  modified_base (162)..(163): a, c, t, g, unknown or other
  misc_feature (162)..(163): n is a, c, g, or t

SEQ ID NO: 66650 - DNA, 495 bp, Homo sapiens
  misc_feature: GYAE6OF01BB3YH.49.73.G07.1.454.CMB.1.raw
  modified_base (418)..(418): a, c, t, g, unknown or other
  misc_feature (418)..(418): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggnagaggacgagggctgactattactgtcagtcatcagacagtcgtggctacttctagtgtagttcggcgggtaacggg

SEQ ID NO: 66651 - DNA, 524 bp, Homo sapiens
  misc_feature: GYAE6OF01D3V32.49.73.G07.1.454.CMB.1.raw
  modified_base (213)..(213): a, c, t, g, unknown or other
  misc_feature (213)..(213): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtntctgtgtcttcaggacagacggccagtatcacctgctctggagatgcattgccaaagcaatatgcttactggtaccagcagagccaggccaggcccctgtcttgatcatttataaagactttgagagggcctcgaggacccctgagcgattctctggctccagctcagcgaacaacagtccacgttgacctatcaggtggaggtcccgggacaggaggacggaggtcgtagtactattactgtcagtcagtacgagacaggttagtcggactaccgttctacgttacgttagttccgggcgggtaaccggg

SEQ ID NO: 66652 - DNA, 163 bp, Homo sapiens
  misc_feature: GYAE6OF01C1V0B.49.73.G07.1.454.CMB.1.raw
  modified_base (160)..(163): a, c, t, g, unknown or other
  misc_feature (160)..(163): n is a, c, g, or t
tcagagtcgagagacacgaccggtgctcgatttagctctacgctcagggcacgaccggtgctcgatttagtcacgcgagaaaggaaggggctggccctgacgtgtttctgttcccgccctcctctctctcgactctgagcgggctggcaaggcgcatagnnnn

SEQ ID NO: 66653 - DNA, 497 bp, Homo sapiens
  misc_feature: GYAE6OF01DY5FJ.49.73.G07.1.454.CMB.1.raw
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtactttgagagggcctcgagggacccctgagcgattctctggctccagctcagcgaacaacagtcacgttgaccatcaggtggagtccgggcaggaggacgaggctgacttatactgtcagtcatcaganaggtagnggcacttctgtgtatcgggcggtaacggg

SEQ ID NO: 66654 - DNA, 510 bp, Homo sapiens
  misc_feature: GYAE6OF01BJAP4.49.73.G07.1.454.CMB.1.raw
  modified_base (429)..(429): a, c, t, g, unknown or other
  misc_feature (429)..(429): n is a, c, g, or t
  modified_base (452)..(452): a, c, t, g, unknown or other
  misc_feature (452)..(452): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagagccaggccaggcccctgtcttgatcatttaataaagtactttgagagggcctcgacgggacccctgacgcgattctctggcctccagctcgagccgacaacagtccacgttgacccatcagtggacgtccgggnagaggacgaggctgactattacngtcagtcagtcagacaggtgcggctacgttctcgtacgttgttccggcgggtaacggg

SEQ ID NO: 66655 - DNA, 161 bp, Homo sapiens
  misc_feature: GYAE6OF01AXKZ4.49.73.G07.1.454.CMB.1.raw
  modified_base (160)..(161): a, c, t, g, unknown or other
  misc_feature (160)..(161): n is a, c, g, or t
tcagagtcgagagacacgaccggtgctcgatttagctctacgctcagggcacgaccggtgctcgatttagtcacgcgagaaagggaaagggctggccctgacgtgttctgttcccgccctcctctctctcgactctgagcgggctggcaaggcgcatagnn

SEQ ID NO: 66656 - DNA, 571 bp, Homo sapiens
  misc_feature: GYAE6OF01DSPQR.49.73.G07.1.454.CMB.1.raw
  modified_base (164)..(164): a, c, t, g, unknown or other
  misc_feature (164)..(164): n is a, c, g, or t
  modified_base (264)..(264): a, c, t, g, unknown or other
  misc_feature (264)..(264): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttctccccctctcactctcngcacgagcgtctggacgaccgtctatagagctgacacagcccacccgtcggtgtctgtcgtcctcaggacagacggcctagtatccacctgctcgtgganatgctattcgaccaaagctaaatatgcttactgaccagcagacgccagccagcccctgtcttgatctattataaagcttgagaggcctacgacggaccctgagcgtattctcgtgtctcgagcacgagacgacaacgtagtctacgttcacctatacgaggtcggacggtccgggacgacggacgggaaccggaggtacgtacggtaacgttacgttacgtacgtacgtacgtacgatacgtaagaccgtaggtacggtcgtaccttaccgttcgttacggttacgttacggtcgggaacgggacgg

SEQ ID NO: 66657 - DNA, 165 bp, Homo sapiens
  misc_feature: GYAE6OF01CFSE9.49.73.G07.1.454.CMB.1.raw
  modified_base (160)..(165): a, c, t, g, unknown or other
  misc_feature (160)..(165): n is a, c, g, or t
tcagagtcgagagacacgaccggtgctcgatttagctctacgctcagggcacgaccggtgctcgatttagtcacgcgagaaagggaaggggctggccctgacgtgtttctgttcccacctcctctctctcgactctgagcgggctggcaaggcgcatagnnnnnn

SEQ ID NO: 66658 - DNA, 494 bp, Homo sapiens
  misc_feature: GYAE6OF01AMAJG.49.73.G07.1.454.CMB.1.raw
  modified_base (420)..(420): a, c, t, g, unknown or other
  misc_feature (420)..(420): n is a, c, g, or t
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgagggacccctgagcgattctctggctccagctcagcgacaacagtcacgttgaccatcagtggagtccgggnagaggacgaggctgactattactgtcagtcatcgagacagtagtgctacttcgtgtcgtnttcggnggaacggg

SEQ ID NO: 66659 - DNA, 536 bp, Homo sapiens
  misc_feature: GYAE6OF01C2XV3.49.73.G07.1.454.CMB.1.raw
  modified_base (452)..(452): a, c, t, g, unknown or other
  misc_feature (452)..(452): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtcgtcctcaggacagacggccagtatcacctgctctggagatgcattgaccaaagcaatatgcttactggtaccagcagaacgccaggccacggcccctgtccttgatctaattttaataaagtacttttaggaggtacgggcctacgacgggtacccctgacgcgtatttctcgtggcctccagcctcacgcgaacaacagtctacgttcgaccatcgaggtggagtccgggnaagaggacggaggtcagtactattatgtcagtcatcagacagttagtcggctacgtttctaggtcgttagtcgggcggaacggg

SEQ ID NO: 66660 - DNA, 492 bp, Homo sapiens
  misc_feature: GYAE6OF01DZSYY.49.73.G07.1.454.CMB.1.raw
  modified_base (463)..(463): a, c, t, g, unknown or other
  misc_feature (463)..(463): n is a, c, g, or t
  modified_base (484)..(484): a, c, t, g, unknown or other
  misc_feature (484)..(484): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagaccggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagnggcacttctgtcgtattcggnggaacggg

SEQ ID NO: 66661 - DNA, 507 bp, Homo sapiens
  misc_feature: GYAE6OF01APFJE.49.73.G07.1.454.CMB.1.raw
  modified_base (279)..(279): a, c, t, g, unknown or other
  misc_feature (279)..(279): n is a, c, g, or t
  modified_base (402)..(402): a, c, t, g, unknown or other
  misc_feature (402)..(402): n is a, c, g, or t
  modified_base (455)..(455): a, c, t, g, unknown or other
  misc_feature (455)..(455): n is a, c, g, or t
  modified_base (472)..(472): a, c, t, g, unknown or other
  misc_feature (472)..(472): n is a, c, g, or t
  modified_base (498)..(498): a, c, t, g, unknown or other
  misc_feature (498)..(498): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggcctcctatgagctgacacagcccaccctcggtgtctgtgtcctcaggacagacggccagtatcacctgctctggagatgcattgccaaagcaatatncttactggtaccagcagaagccaggccaggccctgtcttgatcatttaataaagtactttgagagggcctcgacggacccctgagcgattctctgctccagctcagcgacaacagtcacgttnaccatcagtggagtccgggcaggaggacgaggctagtacttattacgtgtacngtacatcagacaggtgnggctacgttctgtacgtagttcgggnggtaacggg

SEQ ID NO: 66662 - DNA, 670 bp, Homo sapiens
  misc_feature: GYAE6OF01E14XG.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagaccggccagtatcacctgcctctggagatgcattgaccaaagcaatatgcttactggtaccagcaagaacgccaggccacggcccctgtcttgatctatttaataaagtactttgagacgggcctcgacgggacccctgacgtcgtattctcgtggtcctccgacgtcctacgacgaccgaaaccaacgtacgtaccgaaccggtttacgaaccctacgtaccgtagggtacgggtaaccgggttcccggggacgtaacggggaacggggaaccgggaggggtaccgttacggtaaccgtttaagtttaaccgttcggttaccgtacggtttaccgaacgttaccgaacggtaaaccgtagggttaaggtacgggtaccttaaccgtttccgttacggttaccggtttacggtttccggggaccggggtaaaccggggg

SEQ ID NO: 66663 - DNA, 646 bp, Homo sapiens
  misc_feature: GYAE6OF01ED162.49.73.G07.1.454.CMB.1.raw
  modified_base (119)..(119): a, c, t, g, unknown or other
  misc_feature (119)..(119): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (258)..(258): a, c, t, g, unknown or other
  misc_feature (258)..(258): n is a, c, g, or t
  modified_base (635)..(635): a, c, t, g, unknown or other
  misc_feature (635)..(635): n is a, c, g, or t
tcagagtcgagagacacgaccggtgctcgatttagctctacgctcagggcacgaccggtggctcgtttagagagagtgtgttgggtttgggggtggtccaggaggcagaactctgggtntctcaccatggcctggatccctctacttctccccctctcactctctgcacagactctgaggccctcctatgtagctgacacagcccacccttcggtntctgtgtcctnaggacagacgccagtatcacctgctctgganatgcattgaccaaagcaaatatgacttactcggtaccagcagaacgccacggccacggccccttgtccttgacttctaagtttaataaagtactttgaacggtacgggcccttacgacgggtacccctgaacgcgtattccgtacgtggcctccgagcctacgacgtcgaactaacgtagttacctacgttacgaacctatacgtagggtcggaaccggtcccggggacgaacgggtaacgggtacccggtaagggtccgttaacggtaaacgtttaagttaaccgtaggttaccgacgttacgaacttcgaacggtaacctaggtacgttcgggtaccctaacgtttccgtaggttacccgttagtttcccggggnggtaaaccggg

SEQ ID NO: 66664 - DNA, 498 bp, Homo sapiens
  misc_feature: GYAE6OF01EA1BL.49.73.G07.1.454.CMB.1.raw
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagactttgagagggcctcgacgggacccctgagcgattctctggctccagctcagcgacaacagtcacgttgaccatcagtggacgtccgggacagaggacgagggctagactattactgtcagtcatcaganagtagngcacttctgtcgtagttcggnggaacggg

SEQ ID NO: 66665 - DNA, 512 bp, Homo sapiens
  misc_feature: GYAE6OF01EDRCP.49.73.G07.1.454.CMB.1.raw
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
  modified_base (504)..(504): a, c, t, g, unknown or other
  misc_feature (504)..(504): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtcgtcctcaggacagacggccagtatcacctgctctggagatgcattgaccaaagcaaatatgtcttactggtaccagcagaagccaggccacggcccctgtcttgatctatttaataaagtacttttgagagggcctcgacgggacccctgacgcgattctctggcctccagctcagcacaacagtcacgttgaccatcagtggacgtccgggacagaagggacgaggtctagactattactgtcagtcatcaganagtagnggtcacttctgtcgtagttcggnggtaacgg

SEQ ID NO: 66666 - DNA, 493 bp, Homo sapiens
  misc_feature: GYAE6OF01CF4T8.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgagggctgactattactgtcagtcatcagacagtgtggcacttctgtcgtattcgggcggtaacggg

SEQ ID NO: 66667 - DNA, 817 bp, Homo sapiens
  misc_feature: GYAE6OF01C05OK.49.73.G07.1.454.CMB.1.raw
tcagagtcgagagacacgaccggtgctcgatttagctctacgctcagggcacgaccggtgctcgtttagagagagtgtgttgggttggggtggtccaggaggcagaactctgggtgtctcaccatggcctggatccctctacttctccccctctcactctctgcacagactctgaggcctcctatgagctgacacagccacccgtggtgtctgtgtcctcaggacagacggccagtatcactgctctgagatgcattgaccaaagcaatatgcttacgtggtaccagcagaacgccgacggccgacgcccctgtcttgactactaatttaagtaaacgtacgttttaggaacggtacggggtacccttacggaaccggggtaacccccgttaggaaacggtccggtttaaactttcccgttaccggttaccgggtcccgttacccgtaacggtacccgttacccgaaacgggtaccccggaaaccgtaaaccgtaaccgggtttaacccgtaaacccggttttacggaaaccccttaacgttacccggtaacggggttttacggggaaccggggtttaccccgggggaacggtaaacggggtaaacccgggggaaccgggtaaacggggttacccgttaacggtaaaccgttttaacgtttaaaccgttcgggttaccgtaacggttacctaaacgttaccgtaaacgggtaaaccgttaagggttaaccgggttaccggtaacctttaacccggtttccgtttacggtttaccggtttaaccgggtttaccggggaccgggggttaaaacccgggg

SEQ ID NO: 66668 - DNA, 245 bp, Homo sapiens
  misc_feature: GYAE6OF01D1MUX.49.73.G07.1.454.CMB.1.raw
  modified_base (133)..(133): a, c, t, g, unknown or other
  misc_feature (133)..(133): n is a, c, g, or t
  modified_base (184)..(184): a, c, t, g, unknown or other
  misc_feature (184)..(184): n is a, c, g, or t
  modified_base (192)..(245): a, c, t, g, unknown or other
  misc_feature (192)..(245): n is a, c, g, or t
tcagagtcgagagacacgaccggtgctcgatttagctctacgctcagggcacgaaccgggtgctcgatttagctctaccgctcgaagggcacgaccggtcgctcgatttagcgatagtgaagggctatgcgtnttcactcttcccaccctcctctatctcgactctgagcgggctggccaaggngcatgcgnnnnnnnnnnnnnnnnnnnnnnnnnnnnnnnnnnnnnnnnnnnnnnnnnnnnnn

SEQ ID NO: 66669 - DNA, 625 bp, Homo sapiens
  misc_feature: GYAE6OF01CDR3X.49.73.G07.1.454.CMB.1.raw
  modified_base (224)..(224): a, c, t, g, unknown or other
  misc_feature (224)..(224): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatccacctgctctggagatgcattgccaaagcaatatgcttactggtaccagcagaagccaggccacggcccctgtcttgatctatttataaagtactttgagagggcctcgacggacccctgacgcgtattctcgtcggcctccgacgtcctacgacgccgaacaacgtagtccaacgtttacgaaccctagtccgtaggtacgggacggttcccggggacgaacgggtaacgggaacggtacggggtcttacggtaactttaacgtttacgtcggttaccgtacggttccaacgtccgaaacgtaccgtaaggttacggttcgggtaccctacgtttcgttaggttacccggttaacgtttcccggggcggggtaaaccgggg

SEQ ID NO: 66670 - DNA, 212 bp, Homo sapiens
  misc_feature: GYAE6OF01DMRKG.49.73.G07.1.454.CMB.1.raw
  modified_base (209)..(212): a, c, t, g, unknown or other
  misc_feature (209)..(212): n is a, c, g, or t
tcagagtcgagagacacgaccggtgctcgatttagctctacgctcagggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnn

SEQ ID NO: 66671 - DNA, 496 bp, Homo sapiens
  misc_feature: GYAE6OF01C7R3L.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctctatgagctgacacagcccacctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgacttattactgtcagtcatcgagacaagtgtggcactttctgttgttagtcgggcggtaacggg

SEQ ID NO: 66672 - DNA, 555 bp, Homo sapiens
  misc_feature: GYAE6OF01BRGKM.49.73.G07.1.454.CMB.1.raw
  modified_base (339)..(339): a, c, t, g, unknown or other
  misc_feature (339)..(339): n is a, c, g, or t
tcagagtcgagagacacgaccggtgctcgatttagctctacgctcagggtcacgaccggtgcttcgtttagagagagtgtgttgggtttgggggtgggtccaggaggcagaacgtctgggtgtctcaccagtcggcctggatccctctacttctccccctcctcactctctgctacagactctgaggcctcctagtgagctgaccacgaggccacccgtcggtgtctgtgtcctcaggacagacggccaagtatcacctgctctggagatgcattgccaaagcaatatgcttaactggtaccagcagaagccaggccaggcccctgtctgatcatttanaaagtctttgagtaggtcctcgacggaccctgacgtcgattctacgtcggctccagtctcagcgacaactagtcacgttcgaccgatacgaggtggacggtccgggacacggacggacgaggtccgtacgacctagttacctgtccacgttccagtccgacgtacacggtcgacggcctacgttcgtcgttacgttacgtcgggcgggtaaccggg

SEQ ID NO: 66673 - DNA, 499 bp, Homo sapiens
  misc_feature: GYAE6OF01CWTTA.49.73.G07.1.454.CMB.1.raw
  modified_base (491)..(491): a, c, t, g, unknown or other
  misc_feature (491)..(491): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtactttgagagggcctcgagggacccctggagcgattctctggctccagctcagcaacaacagtcacgttgaccatcagtggacgtccgggcaggaggacgaggctgacttattactgtcagtcatcagacagtgtggctacttctagtcgtagttcggnggtacggg

SEQ ID NO: 66674 - DNA, 573 bp, Homo sapiens
  misc_feature: GYAE6OF01DVRHN.49.73.G07.1.454.CMB.1.raw
  modified_base (118)..(118): a, c, t, g, unknown or other
  misc_feature (118)..(118): n is a, c, g, or t
  modified_base (226)..(226): a, c, t, g, unknown or other
  misc_feature (226)..(226): n is a, c, g, or t
  modified_base (332)..(332): a, c, t, g, unknown or other
  misc_feature (332)..(332): n is a, c, g, or t
  modified_base (440)..(440): a, c, t, g, unknown or other
  misc_feature (440)..(440): n is a, c, g, or t
tcagagtcgagagacacgaccggtgctcgatttagctctacgctcagggcacgaccggtgctcgtttagagagagtgtgttgggtttgggggtggtccaggaggcagaactctgggtntctcaccatggcctggatccctctacttctcccctcctcactctctgcacagactctgaggcctctatgagctgacacagccacctcggtgtctgtgtcctcaggacngacgccagtatcacctgctctggagatgcattgaccaaagcaatatgtcttactggtaccagcagaacgccgaggtccacggcccctgtccttgatctaatttaanaaagtactttgagacggcctcgaacgggaccctggacgctattctcgtgctcacgctcacgcaacaacgagtccagttacgaccatacgaaggttggacggtccgggnaacggacggtaacgagggtctacggtacttacgttacgtgtacaggtaccaattcggaaacgtagtaacggttaggtccgggtactaacgtttcgtacgttccggttaacgtttcggggacggtaaaccgggg

SEQ ID NO: 66675 - DNA, 503 bp, Homo sapiens
  misc_feature: GYAE6OF01D4I69.49.73.G07.1.454.CMB.1.raw
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (494)..(494): a, c, t, g, unknown or other
  misc_feature (494)..(494): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtactttgagagggcctcgacgggacccctgacgcgtattctctggctccagcctcagcgacaacagtcacgttgaccatcgagtggagtccgggcaaggaggacgaggctagactattactgtcagtcatcgaganagtagngcacttctagtcgtatcgggnggtaacggg

SEQ ID NO: 66676 - DNA, 497 bp, Homo sapiens
  misc_feature: GYAE6OF01A58B4.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgacgggacccctgagcgattctctggctccagctcagcgaacaacacgtcacgttcgaccatcagtggagtccgggcagaggacgaggctgactattactgtcagtcatcagacagtagtgcacttctgtagtagttcggcggtaacggg

SEQ ID NO: 66677 - DNA, 625 bp, Homo sapiens
  misc_feature: GYAE6OF01DVFU7.49.73.G07.1.454.CMB.1.raw
  modified_base (118)..(118): a, c, t, g, unknown or other
  misc_feature (118)..(118): n is a, c, g, or t
  modified_base (209)..(209): a, c, t, g, unknown or other
  misc_feature (209)..(209): n is a, c, g, or t
tcagagtcgagagacacgaccggtgctcgatttagctctacgctcagggcacgaccggtgctcgtttagagagagtgtgttgggtttgggggtggtccaggaggcagaactctgggtntctcaccatggcctggatccctctacttctccccctctcactctctgcacagactctgagcctctatgagctgacacagccacccgtggtntctgtgtcctcaggacagacggccagtatcacctgctctggagatgcattgaccaaagcaatatgtcttactggtaccagcagaacgccagccacggccctgtctgatcaatttaataaagtctttgagacgggtcctacgacggaccctgacgcgtattcgtcgtcggtctccgagtcctacgaacgtaccgaaacaactagtacctaacggttacgaaccctagtccgaacggttcgggacgttcccggggacaaggggtaaccgggacggtaacgggtccttaacggtaaccttaacgtttacgtcgttaacgtacgttaccgaatccgtaacggtaactacggttaacggtcgggtaccttaccgtttacgttggttaccgtttacggttcccggggacgggtaaaccgggg

SEQ ID NO: 66678 - DNA, 177 bp, Homo sapiens
  misc_feature: GYAE6OF01BMSN8.49.73.G07.1.454.CMB.1.raw
  modified_base (164)..(177): a, c, t, g, unknown or other
  misc_feature (164)..(177): n is a, c, g, or t
tcagagtcgagagacacgaccggtgctcgatttagctctacgctcagggcacgaccggtgctcgatttagtcacgcgagaaagggaaaggggctggccctgacgtgtttctgttcccaccctcctctctctcgactctgagcgggctaggctaaggcgcatagnnnnnnnnnnnnnn

SEQ ID NO: 66679 - DNA, 503 bp, Homo sapiens
  misc_feature: GYAE6OF01EEJHE.49.73.G07.1.454.CMB.1.raw
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttctccccctctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggcccctgtcttgatcatttataaagtactttgagaggcctcgacgggacccctgagcgattctctggctcagctcagcgacaacgagtcacgttgaccatcgagtggagtccgggcaggaggacggagcgtgacttatactgtcagtcatcgagacaggtgnggcacttcngttcgtagttcgggngggtaacggg

SEQ ID NO: 66680 - DNA, 547 bp, Homo sapiens
  misc_feature: GYAE6OF01C4TK8.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctctatgagctgacacagcccaccctggtgtctgtgtcctcaggacagacggccagtatcacctgctctggagatgcattgccaaagcaatatgcttactggtaccagcagaacgccaggccacggcccctgtcttgatctaatttataaagtactttggagacgggcctcgacgggacccctggacgcgtattctcgtcggtctccacgtcctcacggccgaacaacagtcctacgttcgaccctagtcaggtcggacggtccgggcaaggaggacgaggcgtgtacctattacgtgtcagtctatacgacgataggtagcggataccgttcgtgttcggttagttccgggcgggtaaaccggg

SEQ ID NO: 66681 - DNA, 583 bp, Homo sapiens
  misc_feature: GYAE6OF01DOCGO.49.73.G07.1.454.CMB.1.raw
  modified_base (244)..(244): a, c, t, g, unknown or other
  misc_feature (244)..(244): n is a, c, g, or t
  modified_base (375)..(375): a, c, t, g, unknown or other
  misc_feature (375)..(375): n is a, c, g, or t
tcagagtcgagagacacgaccggtgctcgatttagctctacgctcagggcacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtcggccccaggacagacggccaggtttcccngtgagggcaacaacattggtggtaaaggtgtgcactggtaccagcagaagccaggccacggcccctggtgttggtcgtccatgatgacagccgaccggccctcgagggactcccgtgacgcgtattttcgnggcctccgaagtcgtagggaaccacggccacccgtgacccgtcacgacgagggtcgaacgggccggggatcggacggccgaacgtatagtcgtgtaccgagggttcggtgggaattaggtagtacgtgcgttcggttccgggggtgttccgggcgggagggacctaggttcgaccggttcggttcggcacgcccgaggtccgtcccgg

SEQ ID NO: 66682 - DNA, 196 bp, Homo sapiens
  misc_feature: GYAE6OF01D472T.49.73.G07.1.454.CMB.1.raw
  modified_base (196)..(196): a, c, t, g, unknown or other
  misc_feature (196)..(196): n is a, c, g, or t
tcagagtcgagagacacgaccggtgctcgatttagctctacgctcagggcacgaccggtgctcgatttagcgagacgcgcagggcacgaccggtgctcgatttagtcacgcgagaaagggaaggggctggccctgacgtgtttctgttcccgccctcctctctctcgactctgagcgggctggcaaggcgcatagn

SEQ ID NO: 66683 - DNA, 162 bp, Homo sapiens; identical to SEQ ID NO: 66622
  misc_feature: GYAE6OF01ER484.49.73.G07.1.454.CMB.1.raw
  modified_base (161)..(162): a, c, t, g, unknown or other
  misc_feature (161)..(162): n is a, c, g, or t

SEQ ID NO: 66684 - DNA, 510 bp, Homo sapiens
  misc_feature: GYAE6OF01AV52M.49.73.G07.1.454.CMB.1.raw
  modified_base (420)..(420): a, c, t, g, unknown or other
  misc_feature (420)..(420): n is a, c, g, or t
  modified_base (463)..(463): a, c, t, g, unknown or other
  misc_feature (463)..(463): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagagccaggccacggccctgtcttgatcattataaagctttgagaggcctcgacggacccctgacgcgattctcgtgctcagctcgagcgaacaacagtacacgtgaccatcgagtcggagtccgggnaggaacggacgaggtctagacttatactgtcagtcatcgaganaggtgtcggactacgttcgtgttacgttacgttcgggcggtaacggg

SEQ ID NO: 66685 - DNA, 535 bp, Homo sapiens
  misc_feature: GYAE6OF01AJS78.49.73.G07.1.454.CMB.1.raw
  modified_base (405)..(405): a, c, t, g, unknown or other
  misc_feature (405)..(405): n is a, c, g, or t
  modified_base (525)..(525): a, c, t, g, unknown or other
  misc_feature (525)..(525): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgtcttactggtaccagcagaagccaggccacggccctgtcttgatctatttaataaagtactttgaggtacggcctcgacggacccctgacgcgtacttctcgtggcctccagctcgagcgaacaacncgtacacgttcaccatacgaggtggacggtccgggacaaggagggacggaggcgtagaacttagttacgtgtcagtcatcgagtacaggtcgtgctacgttcgtagttacgtgttcgggnggtaaccggg

SEQ ID NO: 66686 - DNA, 163 bp, Homo sapiens; identical to SEQ ID NO: 66618
  misc_feature: GYAE6OF01A20PI.49.73.G07.1.454.CMB.1.raw
  modified_base (163)..(163): a, c, t, g, unknown or other
  misc_feature (163)..(163): n is a, c, g, or t

SEQ ID NO: 66687 - DNA, 498 bp, Homo sapiens
  misc_feature: GYAE6OF01EIJ9U.49.73.G07.1.454.CMB.1.raw
  modified_base (224)..(224): a, c, t, g, unknown or other
  misc_feature (224)..(224): n is a, c, g, or t
  modified_base (490)..(490): a, c, t, g, unknown or other
  misc_feature (490)..(490): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatcacctgctctggagatgcattgccaaagcaatatgcttactggtaccagcagaagccaggccaggcccctgtcttgatcatttaataaagactttgagagggcctcagggacccctgagcgattctctggctccagctcagcgacaacagtcacgttgaccatcagtggagtccgggcaggagggacgagggctagactattactgtcagtcatcgagacaggtgtggcacttctgtcgtattcgggnggaacggg

SEQ ID NO: 66688 - DNA, 600 bp, Homo sapiens
  misc_feature: GYAE6OF01DOW5H.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctctatgagctgacacagccaccctcggtgtctgtcgtcctcaggacagacggccagtatcacctgctctggagatgcattgaccaaaacaatatgctttactggtaccagcaggaggccaggccaggcccctgtcgttggtagtattttaactaaagtactttgagacggcccctacgacgggacccctggacgtcgtactttctcgtcggtcctccgagccttcgaacggggtacaaaccgtacgtccaacccgtttcgaacccctagttccaacggttgggacgttccccggaccaagggacgggaacggaaggtcctacggtaacttaagttaccgtgtaccacggttcccgacagacagcgaggtaggctagttactggtacgttaggttacgggagggtacggcgtacggtcg

SEQ ID NO: 66689 - DNA, 501 bp, Homo sapiens
  misc_feature: GYAE6OF01AG7ED.49.73.G07.1.454.CMB.1.raw
  modified_base (492)..(492): a, c, t, g, unknown or other
  misc_feature (492)..(492): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgacgggacccctgagcgattctctggctccagctcacgcgacaacagtcacgttgaccatcagtggagtccgggcagaggacgaggctgactattactgtcagtcatcgagacaggtagtggcacgttctgttacgtattcgggnggtaacggg

SEQ ID NO: 66690 - DNA, 615 bp, Homo sapiens
  misc_feature: GYAE6OF01B0KCY.49.73.G07.1.454.CMB.1.raw
  modified_base (210)..(210): a, c, t, g, unknown or other
  misc_feature (210)..(210): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgagcctctatgagctgacacagcccaccctggtntctgtcgtcctcgaggacaggacggccagtatcacctgctctggagatgcattcgaccaaagactaatatgtcttacgtcggtaaccagcaagacgccgaggccacggccctgtcttagactactattaataaagtactttggaggacggtcctacgacgggaccctgacgtcgtacttctcgtcggcctccgagtcctacgacgaccgaacaacgtacgtacctacgttacgaacctagtacgtacggtcgggacgggtcccgggacgaagggaacgggacggacgggtcgtacggtacttaacgttacgtacgtacgtagtaccaagtacgaacgtacgtaggttacggtacgtacgttaccgtttcgtacggttacgtacggttccgggcgggtaaaccggg

SEQ ID NO: 66691 - DNA, 533 bp, Homo sapiens
  misc_feature: GYAE6OF01C2CW1.49.73.G07.1.454.CMB.1.raw
  modified_base (241)..(241): a, c, t, g, unknown or other
  misc_feature (241)..(241): n is a, c, g, or t
  modified_base (383)..(383): a, c, t, g, unknown or other
  misc_feature (383)..(383): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctctatgagctgacacagccaccctcggtgtctgtgtcctcaggacagacggccagtancacctgctctggagatgcattgaccaaagcaatatgcttactggtacagcagagccaggccacggcccctgtcttgatctatttaataaagtactttagagaggtcctcgacggacccctgagcgtattctcgtggcctccngcctcagcgacaacagtccacgtcaccatcgaggtggacggtccggcgaagacggacgaggtcgtgaacttattcgtagtcgtagtctatccgagagtaaggtgtcgtacctactttacgtcgttagttacggtcgggtcggaaccgggg

SEQ ID NO: 66692 - DNA, 683 bp, Homo sapiens
  misc_feature: GYAE6OF01D4NFW.49.73.G07.1.454.CMB.1.raw
tcagagtcgagagacacgaccggtgctcgatttagctctacgctcagggcacggaccggtgctcgtttagagagagtgtggttgggtttgggggtgggtccagggaggcagaactctgggtgtactcaccagtggcctaggatcccgtcttacgttcctccccctctcgtacctctctgctacagactctgaggcctactatgagctggacacgaggccacccgtggtcgtctggtcgtcctcgaggacaggacggccagtatcaccgtgctcgtgggacatcgactatcggaccaaagctaatacgtcggtaccttacgtacggtacccaggacgaacggaacgccgaagggcccgtacgggtcccctgttaccgtttgactacgttaagtttaaagtaaacgtacgttagggaaggtacgggtaccctacggaccggaccctaggaacgtcgtactttccgacggtcgtcctccgaacgtctacgaacgaccgtaaacaacgtacggtaccgtaacgttacgaacctagttacggaagggttacggacggtccgggaacagggaacggacggacggtacgtagtacttagttacgacgtagtacgtacgtagtacggaacggacgtaggtcggtacgtactacgttcgtacggttacgttacggtccgggacgggtaccgg

SEQ ID NO: 66693 - DNA, 574 bp, Homo sapiens
  misc_feature: GYAE6OF01DJVSR.49.73.G07.1.454.CMB.1.raw
  modified_base (255)..(255): a, c, t, g, unknown or other
  misc_feature (255)..(255): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctctatgagctgacacagcccaccctcggtgtctgtgtcctcaggacagacggccagtatcactgctctgganatgcattgccaaagcaatatgctttacgtgtaccagcagaacgccgaggccacggcccctgtcttagatactatttaataaagtacgtttagagtacgggcctacgacggaccctgacgcgtattctctcggctccagctcagcgaacaacagtcacgttcgaacctatcgaggtggacggtccgggacaagggacgggaacggacgggtctaggtaacttagttaccgtggttcaacgtcaagtcgaagtaacgtaggttacggtaccggacttaccgtttcgttacggttacggttacgttcgggcgggtaaacggg

SEQ ID NO: 66694 - DNA, 526 bp, Homo sapiens
  misc_feature: GYAE6OF01DKXWX.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggcctcctatgagctgacacagcccaccctcggtgtctgtcgtcctcaggacagacggccagtatcacctgctctggagatgcattgaccaaagcaatatgacttactggtaccagcagaagccaggccgacggcccctagtccttgatctaatttaataaagtactttgagagggcctcgacgggtacccctggacgcgtattctctggctccagctcagcacaacagtcacgttcgaccatcaggtcggacgtccgggcaaggaggacgaggtctgaactagttctgtcagtcagtcgaagtacaggtacgcgctacgttctagtcgtagtcgggcgggaacgg

SEQ ID NO: 66695 - DNA, 508 bp, Homo sapiens
  misc_feature: GYAE6OF01BEJVB.49.73.G07.1.454.CMB.1.raw
  modified_base (224)..(224): a, c, t, g, unknown or other
  misc_feature (224)..(224): n is a, c, g, or t
  modified_base (422)..(422): a, c, t, g, unknown or other
  misc_feature (422)..(422): n is a, c, g, or t
  modified_base (465)..(465): a, c, t, g, unknown or other
  misc_feature (465)..(465): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatcacctgctctggagatgcattgccaaagcaatatgcttactggtaccagcagaagccaggccaggcccctgtcttgatcatttataaagactttgagagggcctcgacgggacccctgagcgattctctggcctcagctcgagcgacaacagtcacgttgaccatcagtggagtccgggnagagggacgagggctaggacttattactgtcagtcatcgaganaggtagtggctacttctgttcgtacgttcgggcgggtaacggg

SEQ ID NO: 66696 - DNA, 545 bp, Homo sapiens
  misc_feature: GYAE6OF01C0CSN.49.73.G07.1.454.CMB.1.raw
  modified_base (400)..(400): a, c, t, g, unknown or other
  misc_feature (400)..(400): n is a, c, g, or t
  modified_base (456)..(456): a, c, t, g, unknown or other
  misc_feature (456)..(456): n is a, c, g, or t
  modified_base (535)..(535): a, c, t, g, unknown or other
  misc_feature (535)..(535): n is a, c, g, or t
tcagagtcgagagacacgaccggtgctcgatttagctctacgctcagggcacgaccggtgctcgtttagagagagtgtgttgggtttggggtgggtccaggaggcagaactctgggtgtctcaccatggcctggatccctctacttcctccccctctcactctctgcacagactctgaggcctcctatgagctgaccacagccaccctcggtgtctgtgtcctcaggacaggacggccagtatccacctgctcgtggagatgcattgaccaaagcaatatgtaccttaactggtaaccaggccaagaacgccgaggcccacggccccctgttcttagactactatttaataaaagtactttagaggacgggcctcgaacgggaccctgacgcgtatttcncgtggcctcagtctcaagcgaacaacgagtcacgttgacatcagtggagtccgganagaggacgaggtctagacttatcgtgtcagtcatcgaacgacgtagtgtcggcttacgttcgtgtacgttacgtcgggnggtaaacggg

SEQ ID NO: 66697 - DNA, 161 bp, Homo sapiens
  misc_feature: GYAE6OF01AX18H.49.73.G07.1.454.CMB.1.raw
  modified_base (160)..(161): a, c, t, g, unknown or other
  misc_feature (160)..(161): n is a, c, g, or t
tcagagtcgagagacacgaccggtgctcgatttagctctacgctcagggcacgaccggtgctcgatttagtcacgcgagaaagggaaggggctggccctgacgtgtttctgttcccacctcctctctctcgactctgagcgggctggcaaggcgcatagnn

SEQ ID NO: 66698 - DNA, 535 bp, Homo sapiens
  misc_feature: GYAE6OF01DCNXX.49.73.G07.1.454.CMB.1.raw
  modified_base (223)..(223): a, c, t, g, unknown or other
  misc_feature (223)..(223): n is a, c, g, or t
  modified_base (461)..(461): a, c, t, g, unknown or other
  misc_feature (461)..(461): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctggtgtctgtgtcctnaggacagacggccagtatccacctgctctggagatgcattgccaaagcaatatgcttacgtgtaccagcagagccgagccaggcccctgtcttagatctattttaataaaagactttgagacgggcctcgagggacccctgagcgtattctcgtcggctccagcctcacgcgaacaacagtccagttacgaacatcagtgaggtccgggcaggaggacggaggctacgtatacttacngtacacgtcaatcgtaagacgagtacggtggtacctacttcgtaggtacgttacgttcggcgggtaaaccgggg

SEQ ID NO: 66699 - DNA, 515 bp, Homo sapiens
  misc_feature: GYAE6OF01DB1W1.49.73.G07.1.454.CMB.1.raw
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacggccagtatcacctgctctggagatgcattgaccaaagcaatatgtcttactggtaccagcagaagccaggccacggcccctgtcttgatcatttaataaagtactttgagacgggcctcgacgggacccctgagcgattctcgtggctccagctcagcgacaacagtcacgttnaccatcagtggacgtccgggnaggaggacgaggctagacttattacgtgtacagtcatcgaagacagtgtggactacttcgtagtcgttacgttcgggcggtaacggg

SEQ ID NO: 66700 - DNA, 186 bp, Homo sapiens
  misc_feature: GYAE6OF01EK4PF.49.73.G07.1.454.CMB.1.raw
  modified_base (178)..(186): a, c, t, g, unknown or other
  misc_feature (178)..(186): n is a, c, g, or t
tcagagtcgagagacacgaccggtgctcgatttagctctacgctcagggtagctctacgctcagggcacgaccggtgctcgatttagtcacgcgagaaagggaaaggggctggccctgacgtgtttctgttcccaccctctctctctcgactctgagcgggctggcaaggcgcatagnnnnnnnnn

SEQ ID NO: 66701 - DNA, 641 bp, Homo sapiens
  misc_feature: GYAE6OF01A5FMJ.49.73.G07.1.454.CMB.1.raw
  modified_base (342)..(342): a, c, t, g, unknown or other
  misc_feature (342)..(342): n is a, c, g, or t
tcagagtcgagagacacgaccggtgctcgatttagctctacgctcaggggcacgaccggtgcctcgtttagagagagtgtgttgggtttgggggtgggtaccacggaggcagaactcctgggtgtctcaccatgggcctggatccctctacttctccccgtctcactctctgcacagacctctgaggcctcctatgagctgacacagcccacccgtcggtgtctgtgtcctcgagggaccagacggccaagtactcacctgcctctggagatgcattcgaccaaagcaatatgcttacgtggtaccagcacgaacgccaggccagccctgtctgatcattanaaacgtacttgagacggcctcgacggacccctgacgcgatctacgtggccgtccgagtcctcgacgtacgacaacgtacgtaccgacgttcgaaccgacgttacgaacggtcgggaacggttaccggggacgaacggtaacgggacggtacgggtacgtacggtaacttaagttacgtacggtaccgtacggtttacacgttacgaacggtaccgtacggtaccggtacgggtaccggtaaccggtttccgtacggtttacccggttaacggttcccggggtcggggtaaacccggggg

SEQ ID NO: 66702 - DNA, 753 bp, Homo sapiens
  misc_feature: GYAE6OF01AJVOI.49.73.G07.1.454.CMB.1.raw
  modified_base (142)..(142): a, c, t, g, unknown or other
  misc_feature (142)..(142): n is a, c, g, or t
  modified_base (229)..(229): a, c, t, g, unknown or other
  misc_feature (229)..(229): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctcctatgagctgaccacacgccacccgtcggtgtctggtcgtccctnagggacagaccggccagttactccacctgcctctggagatgcattcgaccaaagcaatatgccttacgtggtaccagactaagacgaccaggccaacggccctgtcttgactactatttaacgaaagttactttaggacgacggtcctacgacggtacccctagacgtcgtacttcgtacgtcgctaccgagccgttacgacgacgaaccgaacgtacgtaccgacgggttttacaacccgtacgttaccgacgggttaacgggtaccggttacccggggaacgtacgggtaaaccggggtacccgggaacggggtaccgttaacggggtaaaccgtttaaccggttaaccggtttaaccggtacccgttaaggttaccccgtaaacggttaccggtaaaaccggtaacggttaaccgggttaaagggttaccccgggtaacctttaacccgggtttaccggtttaccgggtttaaccgggttaacccgggtttaaccgggggcccgggggttaaaacccgggg

SEQ ID NO: 66703 - DNA, 497 bp, Homo sapiens
  misc_feature: GYAE6OF01BBNFB.49.73.G07.1.454.CMB.1.raw
  modified_base (488)..(488): a, c, t, g, unknown or other
  misc_feature (488)..(488): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagaccggccagtatcacctgctctggagatgcattgccaaagcaatatgcttactggtaccagcagaagccaggccaggcccctgtctgatcatttataaagactttgagaggcctcgacggacccctgagcgattctctggctccagctcagcgacaacagtcacgttgaccatcagtggacgtccgggcagacggacggaggctagactattactgtcagtcatcgagacaggtgtgactacttctgtgtgtcggnggtaacggg

SEQ ID NO: 66704 - DNA, 217 bp, Homo sapiens
  misc_feature: GYAE6OF01C6YAE.49.73.G07.1.454.CMB.1.raw
  modified_base (208)..(208): a, c, t, g, unknown or other
  misc_feature (208)..(208): n is a, c, g, or t
  modified_base (213)..(217): a, c, t, g, unknown or other
  misc_feature (213)..(217): n is a, c, g, or t
tcagagtcgagagacacgaccggtgctcgatttagctctacgctcagggcacgaccggtgctcgatttagtcgagctctctcgcgggcacgaccggtgctcgatttagtcgagctctctcgcgggcacgaccggtgctcgatttagcgagctctctcgcgggcacgaccggtgctgatttgcgaactctcgagcgggctggcaaggcncatgnnnnn

SEQ ID NO: 66705 - DNA, 512 bp, Homo sapiens
  misc_feature: GYAE6OF01ELP78.49.73.G07.1.454.CMB.1.raw
  modified_base (470)..(470): a, c, t, g, unknown or other
  misc_feature (470)..(470): n is a, c, g, or t
  modified_base (502)..(502): a, c, t, g, unknown or other
  misc_feature (502)..(502): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatctatttaataaagtactttgaggagggcctcgacggacccctgacgcgattctctggctccagctcagcgacaacagtcacgttcgaccatcaggtggacggtccgggcgaggaggacgaggctgactattacgtgtcagtcatcgaganagtaggtgctacgttctgtacgtagttcgggngggtaacggg

SEQ ID NO: 66706 - DNA, 655 bp, Homo sapiens
  misc_feature: GYAE6OF01AQI2B.49.73.G07.1.454.CMB.1.raw
  modified_base (250)..(250): a, c, t, g, unknown or other
  misc_feature (250)..(250): n is a, c, g, or t
tcagagtcgagagacacgaccggtgctcgatttagctctacgctcagggcacgaccggtgctcgtttagagagagtgtgttgggttgggggtgggtccgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccngcactggaaccaccaatgacgttggtacttataattctgtctcctgtaccaacaactaccccggcaaacgtaccccaaactcatgatcttgagtcagtgactcggcccgcgtaggggttttcctcgactcgtcctttccgtccggccttacccgaagttccgtcgggcaacgtcgaccgggtccctccccctagaccctactccttcgtcgggtccctaccgacggtcgtcggaagggaccgaagggtccttagggtaattttaacgttaccgttcggacctaacgtcccttacaaacgttactaaaacccgaaaactaaactaaaaccgtcgtttagggggttcggttacccgggtcgggacccggtaaaccaaacttcggaaccccgttccgtaacggtcccg

SEQ ID NO: 66707 - DNA, 562 bp, Homo sapiens
  misc_feature: GYAE6OF01CQ5SD.49.73.G07.1.454.CMB.1.raw
  modified_base (212)..(212): a, c, t, g, unknown or other
  misc_feature (212)..(212): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttctccccctcctcactctctgcacagactctgaggcctcctatgagctgacacagccaccctcggtntctgtgtcctcaggacagacggccagtatcacctgctctggagatgcattgaccaaagcaaatatgtcttactcggtaaccagccaagaacgccaggccacggcccctgtcttgatctaatttataaagtactttgagaggcctcgacggaccctgagcgtattctacgtggcctccagctcgagtcgaactaacacgtcacgttagaccatcgtagtcggagtccgggacgaaggacgggacggaggtcgtagtacttaattacgtgtactacggtcaatcgaacggtataggtacgtggtaccttacgttcgtaggttccgttaaggttccgggcgggtaaaccgggg

SEQ ID NO: 66708 - DNA, 732 bp, Homo sapiens
  misc_feature: GYAE6OF01DXWJX.49.73.G07.1.454.CMB.1.raw
  modified_base (217)..(217): a, c, t, g, unknown or other
  misc_feature (217)..(217): n is a, c, g, or t
tcagagtcgagagacacgaccggtgctcgatttagctctacgctcagggcacgaccggtgctcgtttagagagagtgtggttgggtttgggggtgggtccaggaggcagaactctgggtgtctcaccatggcctggatccctctacttcctccccctctcactctctgcacagactctgacggcctcctatgagctgacacacgcccacccgtggtntctgtctcctcgaggacaggaccgccagtactccactgctcgtggagatgactatcgaaccaaagactaatatcgtaccttacgtcggtaaccagacgaagaacgccgacggcccgacggtcccctgttcttagtactacttaaagtttaaacgtaaacgttacgtttacggaacggtaccgggtcccgtaaccggtaacccgggaccccgttagggaccggtaccgttactttccgttccggtaccggtacccttacccgacggtcctacggaacggtaacccgaaaccgaaccgtacgtacccgttaaccgttacgaaccctagttacggtaacgggtacgggtaccgggtaccgggaacggaacgggtaaccgggacggtacggtacgttaacgtaacgttaacgttacgtcgtaacgtacgtacgaacgtacggaacgtacgtacggtaggtaccgtaaccttcgttacgttacggtaccggtttcgggtaccgggtaacgggaacccggg

SEQ ID NO: 66709 - DNA, 526 bp, Homo sapiens
  misc_feature: GYAE6OF01DRMZY.49.73.G07.1.454.CMB.1.raw
  modified_base (213)..(213): a, c, t, g, unknown or other
  misc_feature (213)..(213): n is a, c, g, or t
  modified_base (474)..(474): a, c, t, g, unknown or other
  misc_feature (474)..(474): n is a, c, g, or t
  modified_base (517)..(517): a, c, t, g, unknown or other
  misc_feature (517)..(517): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctctatgagctgacacagcccaccctcggtntctgtgtcctcaggacagacggccagtatcacctgctctggagatgcattgaccaaagcaatatgtcttacgtcggtaccagcagaagccaggccagcccctgtcttgatcatttaataaagtactttagagacgggctacgacggacccctgacgcgtattcgtctggctccagctcagcgacaacagtcacgttcgacctatcaggtcggaggtccgggacaagggacggacgaggtctagacttagttctgtctagtnatacgagacgagtacgtggctacgttctagttacgtagtcggnggtaacggg

SEQ ID NO: 66710 - DNA, 651 bp, Homo sapiens
  misc_feature: GYAE6OF01CTH9Q.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggcctcctatgagctgacacagccaccctcggtgtctgtcgtcctcgaaggacaggaccggccagtactccacctgctctggagatgctattcgaccaaagcaatatgtcttacgtggtaccagacagaacgccgacggccacggcccctgtccttgatctatttaataaagtactttaggaggacggtcctcggacggtaccctgacggtcgtacttcctcgtcggcctccgagtcctacgacgaccgtaacgaacgtacggttaccaaccggtttacgaaccctacgtaccgtaagggtcgggtaacggtcccggggacgaacgggaacgggaccggacgggtacgtacggtaactttaacgttacgtacgtacgtacgtacctagttacgaacggtacgtaaggttacgtccggtaccttaacgttcgttcggttacggttacggttccgggacggggtaaacccggg

SEQ ID NO: 66711 - DNA, 563 bp, Homo sapiens
  misc_feature: GYAE6OF01D3R1O.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggcctcctatgagctgacacagcccaccctcggtgtcagtcgtccccaggacagacggccaggatcacctgctcgtggagatgcattgaccaaaaccgatatgcttattggtaccagcagaacgccgggccacggcccctgtgttggtgatgtaataaagacacgtgagacggccctacgagggactccctgacgcgtattcgtcgtggcctccgaggtcgagggacaacggtcacgagttcggaccatcgagtcggacgtccgaggcgaggaggacgaggcgtagacttattagttacgtacaactacaaacacgaacctaccgtagttaggtacttagtacgtcttacggtaactggaccgacctaaggtcctaacccggg

SEQ ID NO: 66712 - DNA, 586 bp, Homo sapiens
  misc_feature: GYAE6OF01A1FR1.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcgaggacagaccggccagtatccacctgctctggagatgctattgaccaaagcaatatgcttactcggtaccagcagacgccaggccacggcccctgtccttgatctaatttaataaagtactttgagacgggtcctcgacggaccctgacgcgtattctcgtgcctcacgctcgagcgaacacgacgtacacgttcgacctactcgaggtcggacggtccgggacgaaggtacgggacggtacggctaggtaaccttacgtttacgtcgttacgtacgtacaacgttcgaacgtacgtaggttacggtcgtaccgttaccgttgttacggttacgttacggttcgggtccgggtaaaccggg

SEQ ID NO: 66713 - DNA, 515 bp, Homo sapiens
  misc_feature: GYAE6OF01AHF4A.49.73.G07.1.454.CMB.1.raw
  modified_base (441)..(441): a, c, t, g, unknown or other
  misc_feature (441)..(441): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcaggagccaggccacggccctgtcttgatcatttataaagactttgagaggcctgacggacccctgagcgtattctcgtcggctccagctcgagcgacaacgacgtcacgttgaccatcgaggtcggagtccgggcaaggaggacgaggntagactatacgtgtcgagtcaagtcgaagacgtagtagtgactacttcgtacgtgttagttcgggcggtaacgg

SEQ ID NO: 66714 - DNA, 614 bp, Homo sapiens
  misc_feature: GYAE6OF01EYSTP.49.73.G07.1.454.CMB.1.raw
  modified_base (338)..(338): a, c, t, g, unknown or other
  misc_feature (338)..(338): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagaccggccagtatcacctgctgtggagatgcattgaccaaaagcaaatatgcttacgtggtaccagcaagacgccaggccacggcccctgtcttgattactatttaanaaagtactttggaggacgggcctacgacgggtacccctgacgtcgtattcgtcgttcggctccagcctacacggacgaaccaacgtacgtaccgtaccggtttacgaacctagtaccgtaaggtacgggtacgggtccgggacgaagggaacgggacggacgggtactacgtactttaattaccgtcgtacgagttaccaatacgaagtaacgtaggttacggcggtacctactttcggttacgttacggttacggttcggggacgggtaaccggg

SEQ ID NO: 66715 - DNA, 710 bp, Homo sapiens
  misc_feature: GYAE6OF01COUQX.49.73.G07.1.454.CMB.1.raw
tcagagtcgagagacacgaccggtgctcgatttagctctacgctcagggcacgaccggtgctcgtttagagagagtgtgttgggttgggggtggtccaggaggcagaactctgggtgtctcaccatggcctggatccctctacttcctccccctcctcactctctgcacagactctgacgcctcctatgagctgacacacgcccacccgtcggtgtctgtcgtcctcgaggacaggacggccagtactcacctgctcgtggagatcgactagttacgaccaaaagacaatactgtacctttaacgtacgtaaccacgaccgaagaacgaccgacggccgaaccggtccccgtgtcgttagtaactacttaatttaaacgtaaagttacgtttaggaacggtacggtccgtacggaaccgggtaccccgtagaacgtcggtaacttcgtcgtacggtcctacctagtccacgacgaccgaacaacgtacgtaccgtaacgttacgaacctagttacgaggttacggaccggtaccgggacgaagggacggtacggacggtacgtacgtaactttaacgtacgttacgtacgtaacgtcctaacgtacgaaacggtaccgttaagggttacgggttaccggaacccgtttaccgtttacggttacggtttaaccggtttaccgggttccggggaacgggtaaaaccccgggg

SEQ ID NO: 66716 - DNA, 163 bp, Homo sapiens
  misc_feature: GYAE6OF01BTANZ.49.73.G07.1.454.CMB.1.raw
  modified_base (163)..(163): a, c, t, g, unknown or other
  misc_feature (163)..(163): n is a, c, g, or t
tcagagtcgagagacacgaccggtgctcgatttagctctacgctcagggcacgaccggtgctcgatttagtcacgcgagaaagggaaagggggctggccctgacgtgtttctgttcccgccctcctctctctcgactctgagcgggctggcaaggcgcatagn

SEQ ID NO: 66717 - DNA, 519 bp, Homo sapiens
  misc_feature: GYAE6OF01C4GDW.49.73.G07.1.454.CMB.1.raw
  modified_base (486)..(486): a, c, t, g, unknown or other
  misc_feature (486)..(486): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctctatgagctgacacagcccaccctcggtgtctgtgtcctcaggacagacggccagtatcacctgctctggagatgcattgaccaaagcaatatgcttactggtaccagcagaacgccaggccacggcccctgtcttgatctaatttataaagtactttagagacgggcctcgacgggtacccctgagcgtattctcgtcggctccacgtctcagcgacaacagtccacgttcaccatcgagtggacggtccgggagagaggacgaggctgacttagtactgtcagtcatacagacaggtagngtctacttctgttagtacgtgggcggtaacggg

SEQ ID NO: 66718 - DNA, 208 bp, Homo sapiens
  misc_feature: GYAE6OF01CU26O.49.73.G07.1.454.CMB.1.raw
  modified_base (196)..(208): a, c, t, g, unknown or other
  misc_feature (196)..(208): n is a, c, g, or t
tcagagtcgagagacacgaccggtgctcgatttagctctacgctcagggcgacgaccggtgctcgatttagcgagacgcgcagggcacgaccggtgctcgatttagtcaacgcgagaaagggaaggggctggccctgacgtgtttctgttcccgccctctctctctcgacttctgagcggctggcaaggcgcatgnnnnnnnnnnnnn

SEQ ID NO: 66719 - DNA, 505 bp, Homo sapiens
  misc_feature: GYAE6OF01B2YGI.49.73.G07.1.454.CMB.1.raw
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (448)..(448): a, c, t, g, unknown or other
  misc_feature (448)..(448): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtactttgagtagggcctcgacgggacccctgagcgattctctggctccagctcagcgacaacagtcacgttnaccatcagtggagtccgggnaggaggacgaggctgactagttacngtcagtcatcagacaggtagtggactacgttctgtcgttagttcgggcggtaacggg

SEQ ID NO: 66720 - DNA, 651 bp, Homo sapiens
  misc_feature: GYAE6OF01EE0IP.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacacgccacccgtggtgtctgtcgtcctcgaggacaggacggccagtactcacctgctcgtggagatgctattcgaccaaagactaaatatcgtacttacgtacggtaccagacaggaacgccgacggccgacggtcccctgtcttagtacttactaatttaagtaaacgttacgtttaggacggtacgggtccctacggaccgggacccctaggacgtcgtacttctcgtcgcctccgagtcctcgacgaccgaacaacgtacgtacctacggtacaacctagtacgaggtcgggtacggtcccgggagaagggacgggacggacggtacgttacgtaacgttacgttacgtacgtacgtacgtacaacgtacgaacgtacgttaaggttacgtacggtaccgttacgtttcgtacggtttaccggttacggttccggggacgggtaaaccggg

SEQ ID NO: 66721 - DNA, 618 bp, Homo sapiens
  misc_feature: GYAE6OF01AY8JM.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtactcacctgctctggagatgctattgaccaaagcaatatgcttactggtaccagcagaacgccaggccagccctgtcttgatctatttaataaagtactttgagacgggtcctacgacgggacccctgacgcgtaattctacgtggcttccgacgctccaggaccgaaccgtaaacgacggtacctaaccgttacgaaccctacgtacgacggtacgggacggtccgggacgaacggaacggaacggacggtacgtacgtaacgttacttacgtcggtacctagtaccgtaagttacgaacgtaacgtaaggtcgtacgggtaccttacgttcgttacgttacggtttaacggttccggggtacggggtaaacccgggg

SEQ ID NO: 66722 - DNA, 654 bp, Homo sapiens
  misc_feature: GYAE6OF01BAXFA.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacggcctctagtgagctgacacacgcccacccgtggtctctgtcgtcctagaggacaggaccggcctaagtactccacctgctcgtggagtatgactagttacgaccaaagactaatatgtacttacgtacggtaaccagacaaggaacgaccgacggacccgaccggtccccgttgttcttagtacttacttatttaaataaagtacgtttaggaacggtacgggtcctacggaccggtaccccgtaggacgtcgtacttcgtacgtcggtcctccgacgcctacgacgacgaacaacgacgtaccgtacgtcgaaccagtcgtaggtacggacgtccgggacgaaggacggacggacgtacgtacggtaacttacgttacgttagtaccgtacgtacagtaccgaagtacgtaaggtcggtacgtccttacgttcgttacggttacgttacggttcggggaaccgggtaaccggg

SEQ ID NO: 66723 - DNA, 165 bp, Homo sapiens; identical to SEQ ID NO: 66616
  misc_feature: GYAE6OF01EF77M.49.73.G07.1.454.CMB.1.raw
  modified_base (162)..(165): a, c, t, g, unknown or other
  misc_feature (162)..(165): n is a, c, g, or t

SEQ ID NO: 66724 - DNA, 133 bp, Homo sapiens
  misc_feature: GYAE6OF01EPZZV.49.73.G07.1.454.CMB.1.raw
  modified_base (132)..(133): a, c, t, g, unknown or other
  misc_feature (132)..(133): n is a, c, g, or t
tcagagtcgagagacacgaccggtgctcgatttagctctacgctcagggcacgaccggtgctcgatttagctagtcactctgttcccaccctcctctctctcgactctgagcgggctggcaaggcgcatagnn

SEQ ID NO: 66725 - DNA, 649 bp, Homo sapiens
  misc_feature: GYAE6OF01C5XQG.49.73.G07.1.454.CMB.1.raw
tcagagtcgagagacacgaccggtgctcgatttagctctacgctctagggtcgacgaccggtgctcgtttagagtagagtgtgttgggtttgggggtggggttccggaggacggcacgaacgtcttcgggtgtcctctacccatcggcctggatccctctacttcctccccctcctcactctctagcacagactctggagccgtctagttcgagtctgacttaacacgcccacccgtcggtgtcgtgtcgtacctcgaaggacgaggaccgggctagttatccaccgtcgcgtctggagatcgctagttcgacctaagcctaatacgtcgtccttactacggtaaccacgtacgagaacgccgacggccgacggtcccctgtcttacgagtacgtatttaagtaagtacgtttaggacggtacgggtctacgacggtacccgtggacgtacgtattctcgtcggtctaccgtgctcgacgacgaacgaacgtacgtcgtacgtacgacctatcgagtacgtaccgacggcaaggacggacgtacgtacgtacgtattacgttacgagtaccgagtacgatacgacgtacgtaaggtcgtacgtacttacgttcgttacggttacgttacggtcgggtacgggtaacggg

SEQ ID NO: 66726 - DNA, 536 bp, Homo sapiens
  misc_feature: GYAE6OF01ETZFA.49.73.G07.1.454.CMB.1.raw
  modified_base (242)..(242): a, c, t, g, unknown or other
  misc_feature (242)..(242): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctcggtgtctgtgtcctcaggacagacggccagtancacctgctctggagatgcattgccaaagcaatatgcttactggtaccagcagaacgccaggccacggccctgtcttgatcattaataaagtactttgagagggcctacgacggacccctgacgcgattctctgctccagctcagacgacaacagtctacgttcgaacctatacgtaggtggacgtccgggacaggacggacggaggtcgtagtactattactgtcgagtcatacgacgaacgagtaggtcggctacgtttcgtagttacgttacgttccgggcggtaaacgggg

SEQ ID NO: 66727 - DNA, 620 bp, Homo sapiens
  misc_feature: GYAE6OF01DN6GY.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgtcttactcggtaccagcagaacgcgaggccaggccctgtctgatctatttaataaagtacgtttagaggacgggtcctcgacgggaccctggacgcgtatttcgtcgtcggccttccgacgtcctacgacgccgaacaactacgtacctaacgttcgaacctagtacgaggtgggacggtcccggggacgaacgggacgggaaccgggaggtacgtacggtaacgtttaacgttacgttcggtacctaagttcctaagtacgaacgaacgtaggttacggtcgggtaccttacgtttcgttacggttacggtttacggttccggggacggggtaaaccgggg

SEQ ID NO: 66728 - DNA, 738 bp, Homo sapiens
  misc_feature: GYAE6OF01EYW88.49.73.G07.1.454.CMB.1.raw
  modified_base (103)..(103): a, c, t, g, unknown or other
  misc_feature (103)..(103): n is a, c, g, or t
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (548)..(548): a, c, t, g, unknown or other
  misc_feature (548)..(548): n is a, c, g, or t
  modified_base (672)..(672): a, c, t, g, unknown or other
  misc_feature (672)..(672): n is a, c, g, or t
tcagagtcgagagacacgaccggtgctcgatttagctctacgctcagggcacgaccggtgctcgtttagagagagtgtgttgggtttgggggtgggtccaggnggcagaactctgggtgtctcaccatggcctggatccctctacttctcccctcctcactctctgcacagactctgaggcctcctatgagctgacacagccaccctcggtgtctgtgtcctcaggacagacggccagtatccnactgctcgtggagagtgctctacgaccgaacgaactaanaacncnttactactttaccgtacggtaccgtaacgaacgaccgaaacggacccgaaccgggacccccgtaccggtaccccgtttaccggttacgtttaccgtaagttttaacgttaaaacgtttaaacgtttttaaacggtaaacggttaacggggttaccggtaccgggtaccggggtacccccgcttaccgggtaaccgggtacccggtaacgtttaccgttaccgtttacggttcccgttaccccgtaaccgggtacccgcngtttccccgtaacggacccggtaacccgtaaacccgtaaccggttaacccgtaacccggtttacggttaacccgaaccgttaccgtaaccggtacgggtacggtacccggggtaccggaacggnaacgggtaaccggaacgggacggttacgtacgtacgttaacgttacgtacgtacgtcgtacgtacg

SEQ ID NO: 66729 - DNA, 685 bp, Homo sapiens
  misc_feature: GYAE6OF01BZONO.49.73.G07.1.454.CMB.1.raw
  modified_base (214)..(214): a, c, t, g, unknown or other
  misc_feature (214)..(214): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacagactctgacgcctctatgagctgacacacgcccaccgtcggtntctgtgtccctgaggacaggaccggtcctaagtctcacctgcctcgtaggaagtatcgactattacgaaccaaagctaaagttatcggtactttaccggtcggtaaccaggtaccgaaggaaccgccgaacggaccccgaccggtcccctaggttcttagacttactaatttaaacgtaaagtcgtttaggacggtacggtaccctacggaccggtaccctggacgcgttacttccgacgtcgacctcgacgtcctagacgaccaacgaacgtcgtaccgtacgttacaaccgtagtccgtagggtacggtaccgggtaccggaagtaacgggaacgggtaccggacggttcgtaacgtaacgttacgttaacgtcgtaacctagtacgtaactacggaacgtaagtaggttacgtacgtcctttacgttcgtacggttacggtaccggttacggggccgggtaaaccggg

SEQ ID NO: 66730 - DNA, 729 bp, Homo sapiens
  misc_feature: GYAE6OF01AHFAF.49.73.G07.1.454.CMB.1.raw
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
tcagagtcgagagacacgaccggtgctcgatttagctctacgctcagggcacgaccggtgctcgtttagagagagtgtgttgggttgggggtgggtccaggaggcagaactcgtgggtgtctcaccatggcctggatccctctacttctcccctcctcactctctgacacagactctgaggcctcctatganctgacacagcccacctggtntctggtcgtcctcgaggaccaggaccggaccagttacgccaccgttgactccgtaggagagttcgactaagttcggaacctaaaggctaattaactgtacttacgttaggtaacccagtaccgaagaacggaccgaccggtaccgaccggtcccctaggttaccttggaacttacttaacgttttaaactaaaacggtacttttaggaacgggtacgggaccttaccggaacggtaccccgtaggtacgtacgtacttccgttacgtcggtacctccgtaccgtcgtaccgtaacggaccgtaacctaacggtacgttaaccgaccggttacgaacctaacgtaccgtacggtacggtacgggtacccgggagaacgggaacgggaacggtacgggtacgtacggtaacttaacgttacggtagtacgtacgttaccaagttcccgaagtacgagttacggacgttcgttaccgtttacttacggttaacgtttcggtcgggtacggtaacccgggg

SEQ ID NO: 66731 - DNA, 587 bp, Homo sapiens
  misc_feature: GYAE6OF01A2FGH.49.73.G07.1.454.CMB.1.raw
  modified_base (120)..(120): a, c, t, g, unknown or other
  misc_feature (120)..(120): n is a, c, g, or t
  modified_base (144)..(144): a, c, t, g, unknown or other
  misc_feature (144)..(144): n is a, c, g, or t
  modified_base (215)..(215): a, c, t, g, unknown or other
  misc_feature (215)..(215): n is a, c, g, or t
  modified_base (475)..(475): a, c, t, g, unknown or other
  misc_feature (475)..(475): n is a, c, g, or t
tcagagtcgagagacacgaccggtgctcgatttagctctacgctcagggcacgaccggtgctcgtttagagagagtgtgttgggtttgggggtgggtccaggaggcagaactctggggtntctcaccatggcctggatcccctntacttcctccccctctcactctctgcacagactctgaggcctcctatgagctgacacagcccaccctggtntctgtcgtcctgaggacaggaccggccagtatccactgctctggagatgcattcgaccaaaagcaatatgtctttactggtacccagcaaggaacgaccacggtccacggccccttgtcttgatctatttaataaagtactttagagtacggcctacgacggacccctggacgtcgtacttctcgtcggcctcctagcctacgagccgtaacaactacgtaccgtacgttacgaaccatcgaggtggtacggtaccgggntagggacggacggaggtcgtagtactatacgtgtctagtcacgttacgacgacgtaggtcggtacgtactacgttcgttacgttacggtcgttcggggacgggtaaaccggg

SEQ ID NO: 66732 - DNA, 183 bp, Homo sapiens
  misc_feature: GYAE6OF01EPWEI.49.73.G07.1.454.CMB.1.raw
  modified_base (177)..(183): a, c, t, g, unknown or other
  misc_feature (177)..(183): n is a, c, g, or t
tcagagtcgagagacacgaccggtgctcgatttagctctacgctcagggtagctctacgctcagggcacgaccggtgctcgatttagtcacgcgagaaagggaaggggctggccctgacgtgtttctgttcccacctcctctctctcgactctgagcgggctggcaaggcgcatagnnnnnnn

SEQ ID NO: 66733 - DNA, 165 bp, Homo sapiens
  misc_feature: GYAE6OF01B3HAO.49.73.G07.1.454.CMB.1.raw
  modified_base (163)..(165): a, c, t, g, unknown or other
  misc_feature (163)..(165): n is a, c, g, or t
tcagagtcgagagacacgaccggtgctcgatttagctctacgctcagggcacgaccggtgctcgatttagtcacgcgagaaagggaaaggggctggccctgacgtgtttctgttcccaccctcctctctctcgactctgagcgggctgggcaaggcgcatagnnn

SEQ ID NO: 66734 - DNA, 537 bp, Homo sapiens
  misc_feature: GYAE6OF01BLXFC.49.73.G07.1.454.CMB.1.raw
  modified_base (529)..(529): a, c, t, g, unknown or other
  misc_feature (529)..(529): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaacgccaggccaggcccctgtcttgatctatttaataaagtactttagagtacgggcctcgacgggacccctggacgcgtacttcgtcgtcggcctccaggtcctacgacgacgacaacacgtcacgttcgaccagtcagtggacggtccgggacgacggaggacggaggcgtacgaacttagtactgtcgagtcatacgacgacagtgtgctacgttctagtcgtagttcggnggtacggg

SEQ ID NO: 66735 - DNA, 508 bp, Homo sapiens
  misc_feature: GYAE6OF01EOSKD.49.73.G07.1.454.CMB.1.raw
  modified_base (223)..(223): a, c, t, g, unknown or other
  misc_feature (223)..(223): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (497)..(497): a, c, t, g, unknown or other
  misc_feature (497)..(497): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctggtgtctgtgtccctnaggacagacggccagtatcacctgctctggagatgcattgccaaagcaatatgcttactggtaccagcagaagccaggccaggcccctgtcttgatcatttataaagtactttgagaggcctcgacgggacccctgagcgattctctgctccagctcagcgaacaacagtcacgttgaccatcgagtggagtccgggcagacggacgagggctagacttattactgtcagtcatcgaganaggtgnggcacgtttctcggttacgtagttcggngggtaaccggg

SEQ ID NO: 66736 - DNA, 596 bp, Homo sapiens
  misc_feature: GYAE6OF01D6YZC.49.73.G07.1.454.CMB.1.raw
  modified_base (212)..(212): a, c, t, g, unknown or other
  misc_feature (212)..(212): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttcctccccctctcactctctgcacagactctgagcctcctatgagctgacacagccaccctggtntctgtcgtcctcaggacaggaccggccagtatcacctgctctggagatgcattgaccaaaagcaaatatgtcttactaggtaccagacagaacgccaggccacggcccctgtcttgatctaatttaataaagtactttaggagacgggcctacgacgggtacccctaggacgtcgtaattctcgtcggcctccacgcctacacgacaacaactgtaccacgttacgaaccatacgaggtgggacggtccgggcaaggacggacggaggtcgtacggtaacttaattacgtgtacagttcaagttaccgaaggtaacaaggttacggtcggtacctacgttacgttaggttaccggtttaggttcccggggaagggtaaaccggg

SEQ ID NO: 66737 - DNA, 723 bp, Homo sapiens
  misc_feature: GYAE6OF01D8KGH.49.73.G07.1.454.CMB.1.raw
  modified_base (226)..(226): a, c, t, g, unknown or other
  misc_feature (226)..(226): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacagactctgacggcctcctatgagctgacacagcccaccctggtgtctgtgtccctnaggacagaccggccagtatccacctgctctggagatgctattgaccaaagacaatatgcttactggtaccagcagaagccgaggccacggcccctgtcttgatctatttaataaagtactttgagaggcctcgacggacccctgacgcgtattctcgtcggctccacgtcctcgaacggtaccgaaccaaacgtacgttaccgtaacggtttacgaaaccctacgttacgaacgggttcggggaaccgggttcccgggggaacgaaacggggtaacggggaaccgggaacggggttcccgttaacggtaaaccgttttaacggtttaaccgttcggttaaccgtaaggttcccgtaaacgtttaccggaaaccggtaacggtaacgggtttaaacgggttaccgggttacccgtttaaacccgttttccggtttacgggtttacccgggttttaacggggttttacccgggggccgggggttaaaaaccccgggggg

SEQ ID NO: 66738 - DNA, 162 bp, Homo sapiens
  misc_feature: GYAE6OF01BUO3G.49.73.G07.1.454.CMB.1.raw
  modified_base (156)..(156): a, c, t, g, unknown or other
  misc_feature (156)..(156): n is a, c, g, or t
  modified_base (162)..(162): a, c, t, g, unknown or other
  misc_feature (162)..(162): n is a, c, g, or t
tcagagtcgagagacacgaccggtgctcgatttagctctacgctcagggcacgaccggtgctcgatttagtcacgcgagaaagggaagggggctggccctgacgtgtttctgttcccaccctcctctctctcgactctgagcgggctggcaaggcncatagn

SEQ ID NO: 66739 - DNA, 691 bp, Homo sapiens
  misc_feature: GYAE6OF01ELVQ2.49.73.G07.1.454.CMB.1.raw
  modified_base (263)..(263): a, c, t, g, unknown or other
  misc_feature (263)..(263): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacacgcccacccgtcggtgtctgtgtccctcgaggacaggaccggccagtactcacctgctctgganatgcattcgaccaaagctaatatgtcttacgtcgggtaaccagaccaaggaacgccgacgggcccacgggccccttgttccttaggacttactaattttaaagtaaacgttactttaggaggacgggtccctacggaccgggtaccccgtggacggtacgtatttccgtacgtcgggtcctacccgagtcctacgacggacccgaaacaaccgagttaccgaacgtttacgaaccctagttaccgaggtcgggtaacgggtcccgggacgaacgggacggaacggacggtaccgttacgtaacttaagttacctggttacgtaacgttcctaagtaccgtaaaggtaccgtaggttacggtacggtaccttacgtttccgttacgggttaccggtttaacggttccggggaacggggtaaacccgggg

SEQ ID NO: 66740 - DNA, 672 bp, Homo sapiens
  misc_feature: GYAE6OF01D9BRK.49.73.G07.1.454.CMB.1.raw
  modified_base (120)..(120): a, c, t, g, unknown or other
  misc_feature (120)..(120): n is a, c, g, or t
tcagagtcgagagacacgaccggtgctcgatttagctctacgctcagggcacgaccggtgctcgtttagagagagtgtgttgggtttgggggtgggtccaggaggcagaactctggggtntctcaccatggcctggatccctctacttctcccctcctcactctctgcacagactctgacgcctctatgagctgacacacgcccacccgtcggtgtctgtgtccctcgaggaccaggaccggccagtactccacctgccttcgtggagatgactattacgaccgaaaagactaattatgtactttaacgtcggtaaccagaccgaaggaacgaccgacgggcccgtacggtccccttggttccttgtaacttacttaattttaaacgtaaacgttacgtttaggacggtaccgggtcccgtacggaccgggtaccccgtaggaccgtacgtactttcgtccgtcggtacctccgagtcctacgaacggacgaaaccaacgtacgtaccgtacgttacgacctagtcgaggtcggtacggtccgggagaacgggagggtacgacggtacgtaacggtacttagtagttcgtacagtcaagtaccgtaaggtacgtaaggttacggcggtactacggtttctacggtacggttacggtcggggagggtaaccgg

SEQ ID NO: 66741 - DNA, 523 bp, Homo sapiens
  misc_feature: GYAE6OF01BTW5W.49.73.G07.1.454.CMB.1.raw
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
  modified_base (514)..(514): a, c, t, g, unknown or other
  misc_feature (514)..(514): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctggtgtctgtgtcctcaggacagacggcagtatcacctgctctggagatgcattgccaaagcaatatgcttactggtaccagcagaagccaggccaggcccctgtcttgatctatttaataaagtactttgagagggcctcgacgggacccctgacgcgtacttctcgtggctccgagtctcacgcacaacagtcacgttcgaccatcgagtggacgtccgggcaaggacggacggacggctagacttagttactgtcagtctatcgaganaggtcggngtctacttcgtcgttacgtgttcgggnggtaacggg

SEQ ID NO: 66742 - DNA, 530 bp, Homo sapiens
  misc_feature: GYAE6OF01A0VOP.49.73.G07.1.454.CMB.1.raw
  modified_base (298)..(298): a, c, t, g, unknown or other
  misc_feature (298)..(298): n is a, c, g, or t
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgccaaagcaatatgcttactggtaccagcagaanccaggccagccctgtcttgatcatttaataaagactttgagaggcctcgagggacccctggagcgtattctctcggctccgagctcagccgaacaacagtcacgttgaccatcagtgacgtccgggnagaggacgagctgactattactgtnacgtacattcgacgtacgaaggtcgtcgggacttaaccgttcgttggttacgttacgtttccgggagggtaaacccgggg

SEQ ID NO: 66743 - DNA, 678 bp, Homo sapiens
  misc_feature: GYAE6OF01C5WFI.49.73.G07.1.454.CMB.1.raw
  modified_base (142)..(142): a, c, t, g, unknown or other
  misc_feature (142)..(142): n is a, c, g, or t
  modified_base (212)..(212): a, c, t, g, unknown or other
  misc_feature (212)..(212): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgagcctcctatgagctgacacagcccacccgtggtntctgtcgtcctcgaggacagaccggcctagtatccacctgctctggagatgcattcgaccaaagacaatatgtcttacgtcgtacgacgacaagaacgaccgacggacccgacgtccccgtgtcttagactactaatttaataaagtactttagaggtacggtccctacggacgggtacccctggacgtcgtaacgtttccgtcgtcgggacctccgacgtcctacgacggaccgaaacgaaccgtaacgttaccgtaaccgttacgaacctacgtacgtacggtacgggtacggtaccgggacgaacgggaacgggaccggtaacggtcgttacggtaacgtttaacgtttacgtacggttactacgtaccgtaacgtacgaacgtaacgtaggttacggtcggttaccttacgtttccgttacgggttacggtttacggtacggggtccgggtaaaacccgggg

SEQ ID NO: 66744 - DNA, 618 bp, Homo sapiens
  misc_feature: GYAE6OF01AMLL1.49.73.G07.1.454.CMB.1.raw
  modified_base (605)..(605): a, c, t, g, unknown or other
  misc_feature (605)..(605): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagtctctgaggcctcctatgagctgacacagccacccgtcggtgtcggtcgtccccaggacaaacggccaggactaacctgctctggagatcgcattgaaccaaaaaaattgcttgttaggtaccagaagagtcaggccacggccccggtgttcgctcatctatcgacgaacaacgaaaaccgccgtaccggactccgagagactacttcgctcggcctaccacctcggacggacctacgtcggaccgtacgttacgactacgtcgacgggcccggggaccagggtacgggaggtagtaggaggtactaactacgttaagttcgttaacctacgaaccgaacgacctaacgtaagtaacgaaacgtaccaaggaacgaaaggtaatacggttcgggaacggaggaccgaacgccgtacggaccgtacgtaggacnccggacgaaccgg

SEQ ID NO: 66745 - DNA, 613 bp, Homo sapiens
  misc_feature: GYAE6OF01D5MRE.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctctatgagctgacacagcccacccgtggtgtctgtcgtcctgaggacaggaccggccagtactcacctgctcgtggagatgctattcgaccaaagcaatatgtacttacgtcggtaccagacaggaacgccgacggccacggcccctgtcttagatactaatttaataaagtacgtttaggacggtacggtcctacggaccggaccctggacgcgtattctcgtcggcctccgacgctacgacgaccgaacaacgtacgtaccgtacgtacgacctagtacgaggtacgggacggtccgggacgaagggacggacggaggtcgttacgtacttacgttacgtcgtacgtatccgatacgaagtacgtaaggttcgtacggtaccttacgtttacgtcggttacggttacggttccgggcgggtaaaccggg

SEQ ID NO: 66746 - DNA, 655 bp, Homo sapiens
  misc_feature: GYAE6OF01E4A4Q.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgaccacacgcccacccgtcggtgtctgtgtcctcgaggacagacggccagtactcacctgctctggagatgctattcgaccaaagcaattatcgtcttacgtcggtaccagacaagaacgccgacggccgaccggtcccctgttcttagacttacttaattttaaataaacggttacgtttaggaaggtacgggtcccgtaccggaaccggggtaccccctaggacggtacgtacgtttccgtcgttcgggccttacccgacgtcctacgagacccgaaacaacgtacgtacctacggttacgaacctagttaccgacgggtcgggtacggtccgggacgagggaacggacggaggtacgttacgtacttacgttacgtcggtacctagttcacgtacgacggactagggttacgtacggcttaccgttgtacggtagttacggttcgggacgggtaacggg

SEQ ID NO: 66747 - DNA, 509 bp, Homo sapiens
  misc_feature: GYAE6OF01EUIFI.49.73.G07.1.454.CMB.1.raw
  modified_base (226)..(226): a, c, t, g, unknown or other
  misc_feature (226)..(226): n is a, c, g, or t
  modified_base (500)..(500): a, c, t, g, unknown or other
  misc_feature (500)..(500): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtccctnaggacagacggccagtatcacctgctctggagatgcattgccaaaagcaatatgcttactggtaccagcagaagccaggccagcccctgtcttgatcatttataaagtactttgagagggcctcgacggacccctgacgcgattcgtctggctccagctcgagcgaacaacagtccacgttcgaccatcaggtggacgtccgggcaggaggacgaggctagactattactgtcagtcatcgagacagtgtgctacttctgttacgtcgttcggnggtaacggg

SEQ ID NO: 66748 - DNA, 560 bp, Homo sapiens
  misc_feature: GYAE6OF01AZZAU.49.73.G07.1.454.CMB.1.raw
  modified_base (330)..(330): a, c, t, g, unknown or other
  misc_feature (330)..(330): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgagcctcctatgagctgacacacgcccacccgtggtgtctgtgtccctcaggacaggaccggccagtatcacctgctctggagatgcattgaccaaagcaatatgcttactggtaccagcagagccaggccaggccctgtctgatcatttanaaagtactttgagagggcctcgacgggacccctggagcgtacttctctggcctccagctcgacgccgaacaacgagtaccacgttcgaacctatcgaggtaggacggtcccgggacaggacggacggaggtctaggacttacgttactgtacagtcacgtacgacgtataggttagcggtacttaccgttcgttcggttaccgttacgttccggggcggggtaaaccggg

SEQ ID NO: 66749 - DNA, 163 bp, Homo sapiens; identical to SEQ ID NO: 66600
  misc_feature: GYAE6OF01A9H47.49.73.G07.1.454.CMB.1.raw
  modified_base (162)..(163): a, c, t, g, unknown or other
  misc_feature (162)..(163): n is a, c, g, or t

SEQ ID NO: 66750 - DNA, 184 bp, Homo sapiens
  misc_feature: GYAE6OF01EGT1H.49.73.G07.1.454.CMB.1.raw
  modified_base (165)..(184): a, c, t, g, unknown or other
  misc_feature (165)..(184): n is a, c, g, or t
tcagagtcgagagacacgaccggtgctcgatttagctctacgctcagggcacgaccggtgctcgatttagtcacgcgaggaaagggaaagggggctggccctgacgtgtttctgttcccgccctcctctctctcgactctgagcgggctgggcaaggcgcatagnnnnnnnnnnnnnnnnnnnn

SEQ ID NO: 66751 - DNA, 646 bp, Homo sapiens
  misc_feature: GYAE6OF01DFNCY.49.73.G07.1.454.CMB.1.raw
  modified_base (268)..(268): a, c, t, g, unknown or other
  misc_feature (268)..(268): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttcctccccctcctcactctctgcacagactctgacggcctcctatgagctgaccacacgcccacccgtcggtgtctgtcgtcctcgaaggacacgacggccagtactccacctgctcgtgganatgctattcgaccaaagcaatatgacttacgtcggtacagcaagacgccgacggccacgtccctgtctagtatactaatttaacgtaaagtcgtttaggacggtacggcctacgacgggtaccctgacgtcgtacttcgtcgtcggcctccgagtcctacgagtaccaacgaacgtacgttacgaccgttacgaaccctagtcgtaagggtcgggacggtacccggggacgaaacggacgggacggtacggtacgtaacgttacttaacgttacgcgtacgtacgtcgaagttacgaaggtaacgtaggttacgggtccgtaccttaaccgtttcgttacggtccggtttacggttcccggggtagggtaaacccggg

SEQ ID NO: 66752 - DNA, 610 bp, Homo sapiens
  misc_feature: GYAE6OF01BKJKH.49.73.G07.1.454.CMB.1.raw
  modified_base (214)..(214): a, c, t, g, unknown or other
  misc_feature (214)..(214): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtntctgtgtcctcaggacagaccggccagtatcacctgctctggagatgcattgccaaaagccaatatgtcttacgtggtaccagcagaagccaggccacggccctgtcttgatctatttataaagtactttagaggacgggcctacgacggtaccctgacgtcgtacttctcgtcggtcctccgacgtcaccgacgaccgaaccaacgtacgtcacgttacgacctatcaggtacggacggtccgggagaaggtaacgggacggagggtccgtacggtaacttaagttacgttacgtcgtaaggttacctacgtacgaacgacgtaggttacggttacggaccttacgtttcgttacgggttacggttacggttccggggacggggtaaacccgggg

SEQ ID NO: 66753 - DNA, 522 bp, Homo sapiens
  misc_feature: GYAE6OF01DOGCU.49.73.G07.1.454.CMB.1.raw
  modified_base (465)..(465): a, c, t, g, unknown or other
  misc_feature (465)..(465): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcgaggacagacggccagtatcacctgctctggagatgcattgccaaagcaatatgcttactggtaccagcagaagccaggccaggcccctgtcttgatcatttataaagtactttgagagggcctcgacgggacccctgacgcgattctctggcctccagtcctcagcgacaaacgagtaccgacgttgaccctagtcaggtggacgtccgggcgaggacggacgaggtctgtactattacngtacagtcatcgagacgagtagtgctacgttcttcgtgttacgtcggcggtaacggg

SEQ ID NO: 66754 - DNA, 625 bp, Homo sapiens
  misc_feature: GYAE6OF01EN22O.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtcccccaggacagacggccaggatcacctgctctggagatgcattagaccaaaccgatatgcttattggtaccagcagaacgccgggccacggcccctgtgttggtgatgtaataaagacacgtggacgacggccctcgacgggactcccgtgacggcgtattcctcgtcggctccgaggtcgagggacaaccggtcacgtacgttcggacctagtccgaggtacgggtacgtacccgagggacgaaggacgggaaccgagggcgtagtaaccttaagtttacgttacgtacgaaactaccaaacgtacgtaaacctaccgtaacgtttacggttaactttacgtacggttacgttaaccggaacgttcggaaccgtaacccgtaaaggttcccgtaacccggg

SEQ ID NO: 66755 - DNA, 519 bp, Homo sapiens
  misc_feature: GYAE6OF01DPSMY.49.73.G07.1.454.CMB.1.raw
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
  modified_base (507)..(507): a, c, t, g, unknown or other
  misc_feature (507)..(507): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgaggcctctatgagctgacacagcccaccctggtgtctgtgtcctacaggacagaccggtccagtatcacctgctctggagatgcattgaccaaagcaatatgcttactggtacagcagaagccaggccagccctgtccttgatctatttataaagtacgtttgagtacggcctacgacgggtacccctgagcgtattctcgtgctcngctcagcgacaacagtctacgtnaccatcagtgaggtccgggnaggaggacgaggtctagtactattacgtgtacagtcatcgagagagtagcggtctacgtttactgttacgtacgttcgggngggtaaaccggg

SEQ ID NO: 66756 - DNA, 697 bp, Homo sapiens
  misc_feature: GYAE6OF01CWZ82.49.73.G07.1.454.CMB.1.raw
  modified_base (213)..(213): a, c, t, g, unknown or other
  misc_feature (213)..(213): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtntctgtcgtcctcgaggacaggaccggccagtactccacctgctctggagatgcattgaccaaagcaaatatgtctttacgtcggtaccagacaagaacgccgaggcccacggtcccctgtcttcgatactaatttaataaagtacgtttaggagtacgggcctacgacgggtacccctggacgtaccgtatttccgtcgtcgggcctaccgtacgtccgtttaacggccgaaacctaaacgtacgttaccgtaaccggtttacgaaccctaagttaccgtaagggttcggggtaaccgggtcccggggacggtaacggggaacgggaaccgggtaacggtaccgttacggaaccgtttacgtttaacgtcgtaacgtacgtacctactacgaacggtaacgtagggttaacggtcgtaccgttacgtttccgtacgggtttaccggttagggttcccggggtaccgggtaacgggtaaacccgg

SEQ ID NO: 66757 - DNA, 642 bp, Homo sapiens
  misc_feature: GYAE6OF01EEORN.49.73.G07.1.454.CMB.1.raw
  modified_base (263)..(263): a, c, t, g, unknown or other
  misc_feature (263)..(263): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacagactctgaggcctcctatgagctgacacacgcccacccgtggtgtctgtcgtcctgaggacagaccggccagtactccacctgctcgtgganatgctattcgaaccaaaagctaaatatgtacctttacgtcggtaaccagacgaaggaaccgccgacggcccacggtccccttgtcttgacttactaatttaataaagtacgtttggagacggcctacggaccggtaccctggacgtcgtactttccgtcgtcggcctaccacgtcctacgacgaccgaacaacgtacgtaccgtacgtacgacctagtacgaggtcgggtaccggtccgggacgaagggacggacggaggtaccttacgtaacttagttacgttcgtactagttacacttacgaacggtaacgtaggtggtaccgtacttaccgtttcgtacggttaccggttagttccgggggaccgggtaaaccggg

SEQ ID NO: 66758 - DNA, 641 bp, Homo sapiens
  misc_feature: GYAE6OF01EOWPV.49.73.G07.1.454.CMB.1.raw
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacacgccaccctggtntctgtgtcctnaggacagacggccagtatcacctgctcgtggagatgctattcgaccaaagcaatatgtacttactcggtaaccagcaaggacgaccgacgggccacgggccccttgtcttgtatacttaatttaaataaacgttacgtttaggaggtacgggtcctaccggacgggaccccttaggacgtcgtactttcgtacgtcgtctacctacggctacgacggaccgaaacaacgtacgtcctaaccggttacgaacctacgtacgtaacgggtcggtaccggtccggggacaagggaacggacggacggtcttagtaacgttacttacgtcggtactaacgtctaacgtcgaaagtacgtaggttacggtacgacttaccgttcgttagttaccggttacggttcggggaggtaaacccgggg

SEQ ID NO: 66759 - DNA, 782 bp, Homo sapiens
  misc_feature: GYAE6OF01D81LF.49.73.G07.1.454.CMB.1.raw
  modified_base (251)..(251): a, c, t, g, unknown or other
  misc_feature (251)..(251): n is a, c, g, or t
tcagagtcgagagacacgaccggtgctcgatttagctctacgctcagggcacgaccggtgctcgtttagagagagtgtgttgggtttgggggtgggtccaggaggcagaactcgtgggtgtctcaccatggcctggatccctctacttcctccccctctcactctctgcacagactctgagccctcctatgagctgaccacacgcccacccgtggtgtctggtcgtccctgaggacaggaccgccagtacnccaccgtgctcgtaggatagtgactagttacgaaccaaagtcaattagtgttaccttaacgtcggtaaccaggacgaacggaaccggcccgacggaccccgtaccgggtccccttagttccgtttaagaacctttaccttaaaggttttaaacgtaaaacggtttacgttacgggaacgggtacccgggtacccgttaacgggaaccgggttacccctagggaacgtccgttacgtttcctaccggttacgtcccgttaccgaccggtactaccgaacggtaccccgaaacgtaacgtacggtaaccgtaaccgttaccgtaacccgacgttacggtaacggggttacgggtaaccgggtacccgggtaagaaccgggtaaacgggaccggtaacgggtcttaacggtaactttaacgtaccgttactaccgtagttacctaacggttacgacggtaacggtacggttacggtaccgttaccgtacgttttcgacgggttaccggttacgtacggggaccgggtaaaccgg

SEQ ID NO: 66760 - DNA, 828 bp, Homo sapiens
  misc_feature: GYAE6OF01DTOG5.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctcctcactctctgcacaggctctgacggcctcctatgagctgacacacgccaccctcggtgtcagtcgtaccccaggacacggacggccaggactccacctgctcgtggagatgacagttcgaccaaaccgtatatcgtacttagttacggtaccacgacgaacggaaccggcccgggacccgaacgggtccccgtgggttcggtttgggtaggtaagttagtaaacgtaaaacgaccgtaacgtacggaacggtacccgggtcccgtacggaacgggtaccgttaccgtaggtacgtacgtacgtttccgtcgtcgggtacctccgaacgggttccgaacggggtaaccgtaaacgggttctaaacgtacggttacggtacctaacgtacggtaacgggtacgggtaccggttacccggaagggtaccggaacgggtaacggggaaccggtaacgggtaccgtttacggtaaaccgtttaagttttaacgttttaccggtaaactaaacgttaacccaaaaggtaaccgtaaaacctaacccgtttaaagttttacccgggttaaaccttttacggttaccggtttaacccggtttaacccggggttaaacccgttacgggtaaaccccggtaaacccggttaaaccggggttccccgtttaaacccccgggg

SEQ ID NO: 66761 - DNA, 661 bp, Homo sapiens
  misc_feature: GYAE6OF01BAVFO.49.73.G07.1.454.CMB.1.raw
  modified_base (258)..(258): a, c, t, g, unknown or other
  misc_feature (258)..(258): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctcggtgtctgtcgtcctcaggacagaccggccagtatcacctgctctgganatgctattcgaccaaagacaatatgtacttacgtggtaccagcaagaacgccgaggaccacggcccctgttcttagactctaatttaataaagtactttaggacggacggtcctacgacgggtacccctggacgtcgtactttccttcgtcggtcctaccacgtcctacacggaccgaaaccaactacgtacctaacggtttacgaaccctagtaccgtagggtcgggtacggtacccggggacgaacgggaacgggtaacgggacggtcgtacggtaacgttaagttaccgttcgtacgtactactaacgttaccgaaggtaacgtagggttacggtacggtaccttaccgtttcggttacggttaccggtttacgggttccggggacggggtaacccgggg

SEQ ID NO: 66762 - DNA, 649 bp, Homo sapiens
  misc_feature: GYAE6OF01DGWBH.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctctatgagctgacacagcccacccgtcggtgtctgtcgtcctcaggacagcgccagtatcacctgctctggagatgcattcgacaaagacaatatgtcttacgtcgtaaccagacacgaacgccgacggaccgacgtccccgtgttccttagtatactaatttaagtaaaagtacgtttaggacggtacgggcctacggacggtaccccgtgtacggtacgtacgtttcctacgttcggccttacccgacgtaccgttaccgaaggacccgaaacctaaaccgtacgttaccgtaaccggtttacgaaccctaagtaccgtagggtacgggtaccggtccgggacgaaggacgggtaacggaggtcgttacgaacgtttagttacgtcgtacgtagtactagtacgtagagtacggtagtcgtacttcttcggttcttacggttacgttccgggcgggtaaaccggg

SEQ ID NO: 66763 - DNA, 630 bp, Homo sapiens
  misc_feature: GYAE6OF01A1Y9L.49.73.G07.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (503)..(503): a, c, t, g, unknown or other
  misc_feature (503)..(503): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgaggcctcctatgagctgacacagccaccctggtntctgtcgtcctnaggacaggaccggccagtatccacctgctctggagatgcattcgaccaaagctaatatgtcttacgtcggtaccagacaagaacgccgacggccgacggcccctgtcttagattactaagtttaactaaagtacgtttaggaacggtacgggtacccttacggaccgggtacccctaggacgtcgtactttccgtcgtcgggcctccgacgtcctacgacgtacgaacaactacgtacctacgttcgaaccgactacgtaggtcggtacgggtcccggganaacgggagggaaccggagggtaccttaggaactttaacgttacgtcgtacgtagtacacgttcgaagtacgtaggttacgtcggacttcgtttacgtcggtttacgtacggtcgggtagggaaccgg

SEQ ID NO: 66764 - DNA, 617 bp, Homo sapiens
  misc_feature: GYAE6OF01DS5AW.49.73.G07.1.454.CMB.1.raw
  modified_base (260)..(260): a, c, t, g, unknown or other
  misc_feature (260)..(260): n is a, c, g, or t
  modified_base (296)..(296): a, c, t, g, unknown or other
  misc_feature (296)..(296): n is a, c, g, or t
  modified_base (350)..(350): a, c, t, g, unknown or other
  misc_feature (350)..(350): n is a, c, g, or t
  modified_base (461)..(461): a, c, t, g, unknown or other
  misc_feature (461)..(461): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacagactctgaggcctctatgagctgacacacgcccacccgtggtgtctgtcgtcctagaggacagacggccagtactcacctgctctgganatgctattcgaccaaagctaatagtgtactttacgnggtaaccagacaagacgccacggccacggtccctgtccttgatactatttaaanaaagtcgttcgaaggacggtcctacgaacgggtaccctaggacgtacgtactttctacgtcggccttaccgagtcctacgacgaacgaaccaacgtacgtaccacggttanaacctagtcgtaggtcggacggtccgggactaagggaggaccggtacgctaggtaacttaacgttacgagtctaagttcaacgtcgaaagtactaggtacgttcggtaccttacgtttcggtcgttaggtttacgtcggggacgggtaaacccggg

SEQ ID NO: 66765 - DNA, 562 bp, Homo sapiens
  misc_feature: GYAE6OF01A80Q0.49.73.G07.1.454.CMB.1.raw
  modified_base (225)..(225): a, c, t, g, unknown or other
  misc_feature (225)..(225): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctnaggacagacggccagtatcacctgctctggagatgcattgccaaagcaatatgtcttactggtaccagaagaagccaggccacggccctgtcttgatctatttataaagtactttgagaggcctcgacgggaccctgagcgtacttcgtcgtcggctccgagtcctcgacgacgaacaacgagtcacgttcgaccactcaggtggacggtccgggacgaggaggacgaggactgacttattacgtcgtacgacgtctatacgagtacgtaggtacggtcggtacctacgtttcgtcgttacggttaggttccggggtacgggtacggggtaaacccg

SEQ ID NO: 66766 - DNA, 718 bp, Homo sapiens
  misc_feature: GYAE6OF01CRB3O.49.73.G07.1.454.CMB.1.raw
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
tcagagtcgagagacacgaccggtgctcgatttagctctacgctcagggcacgaccggtgctcgtttagagagagtgtgttgggttgggggtggtccaggaggcagaactctgggtgtctcaccatggcctggatccctctaccttcctccccctcctcactctctgcacagacctctgacggcctcctatgagctgaccacacgcccacccgtcggttgtctgtcgtcctacgaggacacggaccggccaagtacnccaccttgctcgtgganatgacctagttcgaacctaaagactaattactcgtacttacgtacggtaccagaccgaagaaccgccgacggccgtaccgtccccttgtacttagaactcttaagtttaactaaacgtacgtttaggacggtacggtaccctacggaaccggtaccccgtagtacgcgttactttccgtacgtacggtccctaccgacgtaccgtacgaacggaccaacgtaaacgtaacgtccggtaaccgttacgaaccttaacgtccggtaacgggtcgggtaccggtaccggggacgaaacgggaacggggacgtaacgggtacgtaacgttacgttaacgttacggtcgttacgacgttacagtaccgtaaaggaccgttaagggtcgtacccgtagtttacgtttcgttacggttaccggttacggtccggggtacgggtaaaccggg

SEQ ID NO: 66767 - DNA, 590 bp, Homo sapiens
  misc_feature: GYAE6OF01BES2N.49.73.G07.1.454.CMB.1.raw
  modified_base (214)..(214): a, c, t, g, unknown or other
  misc_feature (214)..(214): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtntctgtgtcctcaggacaggacggccagtatcacctgctctggagatgcattcgaccaaagcaatatgtcttactcggtaccagcagaagccaggccacgcccctgtcttgatctattaataaagtctttagagaggcctacgacggtaccctgacgcgtacttcgtcgtcgggtctaccgagtctacgacgccgtaaacactaggttaccaaccggtttacgacctatccggaaggtcgggaacgtccggggagacgggaacgggacggacggtcgtacgtacttattacgtcgtactagtacaattcgacgtacgtaggtacgtcggtactacgtttcctaggttaccggttaagtccggggtacgggtaacggg

SEQ ID NO: 66768 - DNA, 792 bp, Homo sapiens
  misc_feature: GYAE6OF01BR9U4.49.73.G07.1.454.CMB.1.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctcggtgtctgtgtcctnaggacaggacggccagtanccacctgcctctggagatgctattggaccaaaaggccaaagttatcgcctttaacgtcgggttaacccaggccaaggaaacgtcccgaaggggcccccaaccggggtccccccctttaggttcccgtttcggtaacttacccgttaattttttaaaacgtaaaaacggtttaaccctttttagggaacgggtacggggtacccccttacggaaccgggggtaccccccttagggaacgtccggtaactttccgttcgtcgggtacccttcccgaggtcctaccgaacggcccgaacgtaaacctcggtaccaccggtttccggaaccctacgtacccgacgggttacggggtaccggtcccgggggacaacggggtaaccgggaaccgggtaagggtcccgttaacgttaaccgtttaacgttaccgttacggttaccgtacgtttaccaacgttacgaaacggtacgttacgggttaacggtcgggtacccttacggtttaccgttcggtttaccggttaacggttcccggggaggggtaaacccggg

SEQ ID NO: 66769 - DNA, 582 bp, Homo sapiens
  misc_feature: GYAE6OF01C6YJU.49.73.G07.1.454.CMB.1.raw
  modified_base (224)..(224): a, c, t, g, unknown or other
  misc_feature (224)..(224): n is a, c, g, or t
  modified_base (523)..(523): a, c, t, g, unknown or other
  misc_feature (523)..(523): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggcctcctatgagctgacacagcccaccctggtgtctgtgtccncaaggacagacggccagtactccactgctctggagatgcattgaccaaaagcaaatatgcttaacgtggtaccagcaagaagccaggccacggcccctgtcttagactactatttaataaaagtactttaggaagacgggcctacgacgggaacccctgacgcgattctctgcctcagctacagacgaacaacgatccaacgttcgaactatcgacgtgggacggtccgggagaagggaagggtacggaagggtctaaggtacttaacttactagtaccaggttacagttacgaacganaacggttaggtacggtactaccttcgtagttacgttacgttcggggacgggtaaacggg

SEQ ID NO: 66770 - DNA, 656 bp, Homo sapiens
  misc_feature: GYAE6OF01BVAB6.49.73.G07.1.454.CMB.1.raw
  modified_base (348)..(348): a, c, t, g, unknown or other
  misc_feature (348)..(348): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggccctctatgagctgacacagcccacccgtggtgtctgtcgtcctgaggaccaggaccggccagtatccacctgctcgtggagatgcattgaccaaagcaatatgtcttacgtcggtaccagacagaacgccgacggccacggcccctgtccttgatctaatttaanaaagtactttgaggacggtcctacgacggaccctgacgcgtacttcgtcgtcggcctccgacgcctacgacgaccgaaacaacgtacgtacctaacggttccgaacctataccgtagggtacgggtacggtcccggggacgaacgggaacggggaccggagggtccgttacggtaactttaacgttacgttcgtacctaacgttacgtaacgtacgtaacggaacttaacgggttacgtacggtaccttaaccggtttccgttagggttacccggtttacggttcccgggggtacgggtaaaccgggg

SEQ ID NO: 66771 - DNA, 558 bp, Homo sapiens
  misc_feature: GYAE6OF01EYMMU.49.73.G07.1.454.CMB.1.raw
  modified_base (459)..(459): a, c, t, g, unknown or other
  misc_feature (459)..(459): n is a, c, g, or t
  modified_base (545)..(545): a, c, t, g, unknown or other
  misc_feature (545)..(545): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctggtgtctgtgtcctgaggacaggacggccagtatcacctgctctggagatgtattgaccaaagcaaatatgactttactggtaccagcagaagccaggccacggcccctgtcttgatctaatttataaagtactttgaagtaggcctcgacgggacccctgacgcgtattccgtctcgggtcctccgacgtcctacgacgaccgaacaacacgtcaaccgttacgaaccagtcgaggtggacgtaccgggnaaggaggacggaggctagtacttattactgtcagtctaagtacaagactaggtagtcggactacttcgttgtacgttagttcgggnggacgggtaaccg

SEQ ID NO: 66772 - DNA, 109 bp, Homo sapiens
  misc_feature: GYAE6OF01B6BBC.49.73.G07.1.454.CMB.1.raw
tcagagtcgagagacacgaccggtgctcgatttagctctacgctcagggcacgaccggtgctcgatttagtcacgcgagaaagggagagcgggctggcaaggcgcatag

SEQ ID NO: 66773 - DNA, 641 bp, Homo sapiens
  misc_feature: GYAE6OF01B1QKG.49.73.G07.1.454.CMB.1.raw
  modified_base (119)..(119): a, c, t, g, unknown or other
  misc_feature (119)..(119): n is a, c, g, or t
  modified_base (211)..(211): a, c, t, g, unknown or other
  misc_feature (211)..(211): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttctccccctctcactctctgcacagactctgaggcctctatgagctgacacagcccaccctggtntctgtgtcctcaggacaggaccggcagtatccacctgctctggatatgcattgaccaaaagctaaatagtcgactttacgtcggtaaccaggtaccaaggacgccgagggcccacgggcccctgtacttgattacctaatttaataaaggtactttaggacggtacggccctacgacgggacccctggacgtcgtactttcgtcgtcggtcctccgacgtcctcgaacgccgaaactaacgtagttccaacggtttacgaacctagtaccgacggttagggacggttacccggggactaacgggacgggaacggtacggtcttaggacttacttacgtagtccgagttaccagtacgaacggtacgtacggttaggtcgtacttacgtttccgtaggttaccgttcggtttcggggccgggtaaaccggg

SEQ ID NO: 66774 - DNA, 163 bp, Homo sapiens; identical to SEQ ID NO: 66716
  misc_feature: GYAE6OF01A5SQD.49.73.G07.1.454.CMB.1.raw
  modified_base (163)..(163): a, c, t, g, unknown or other
  misc_feature (163)..(163): n is a, c, g, or t

SEQ ID NO: 66775 - DNA, 624 bp, Homo sapiens
  misc_feature: GYAE6OF01BXDII.49.73.G07.1.454.CMB.1.raw
  modified_base (167)..(167): a, c, t, g, unknown or other
  misc_feature (167)..(167): n is a, c, g, or t
  modified_base (178)..(178): a, c, t, g, unknown or other
  misc_feature (178)..(178): n is a, c, g, or t
  modified_base (245)..(245): a, c, t, g, unknown or other
  misc_feature (245)..(245): n is a, c, g, or t
tcagagtcgagagacacgaccggtgctcgatttagctctacgctcagggcacgaccggtgctcgtttagagagagtgtggttgggtttgggggtgggtccaggaggcagaactctgggtgtctcaccatggcctggatccctctacttcctccccctctcactctcngcacagactcngagcctcctatgagctgacacacgcccaccgtcggtgtctgtcgtcctgaggacaggaccgcaagtnccacgtgctcgtaggagtatcgctagttcgaaccaaagactaatactcgtactttacgtcggtaaccagacgaagaacgccgaacgccgacggccccttgtactgatactaatttaacaaagtacgttgacgtacggcctacggacggtaccctggacgtcgtacttccgtgacggtcctaccgagtccgtacgacgaccgaaactaacgtagtaccgtacgttacgaactacgtaccgaggtacggacggtaccggacgaaggacgggacgacgggtactacgtaacttaagtcgtacgtacagttaccagtacgacgtaaggagtcggtacgcttacgttccgttaggttcgaacgggttcgggaacgggtaaccgg

SEQ ID NO: 66776 - DNA, 621 bp, Homo sapiens
  misc_feature: GYAE6OF01D7JX8.49.73.G07.1.454.CMB.1.raw
  modified_base (119)..(119): a, c, t, g, unknown or other
  misc_feature (119)..(119): n is a, c, g, or t
  modified_base (142)..(142): a, c, t, g, unknown or other
  misc_feature (142)..(142): n is a, c, g, or t
  modified_base (267)..(267): a, c, t, g, unknown or other
  misc_feature (267)..(267): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctntacttctccccctctcactctctgcacagactctgagtcctcctatgagctgacacacgcccacccgtggtgtcgtgtacgtcctgacggacaggaccggccagtactccaccgtgctcgtgganatcgctacttcgaccaaagctaatatcgtacttacgcggtaccagacgaagacgccgacggccacggcccttgtctgactactaattaactaagtcgttgaggacggccgtacgacggtaccctggacgtcgtattccgtcgtacggccttaccgacgtctacgacgacgaacaaacgtcgtacctacgttacactacgtacgtaggtcggtacggtccggagaacgggacggtacgacggtctacgtaacgttacttacgtcgtacgacgttacgaagttacgaagtacgttaggtacggtacgtacgttaccgttcgtacgtttaggtaccggttcgggcgggtaaaccggg

SEQ ID NO: 66777 - DNA, 743 bp, Homo sapiens
  misc_feature: GYAE6OF01AXZYO.49.73.G07.1.454.CMB.1.raw
  modified_base (144)..(144): a, c, t, g, unknown or other
  misc_feature (144)..(144): n is a, c, g, or t
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
tcagagtcgagagacacgaccggtgctcgatttagctctacgctcagggcacgaccggtgctcgtttagagagagtgtgttgggtttgggggtgggtccgaggaggcagaactcgtgggtgtctcaccatggcctggatccctntacttcctcccctctcactctctgacacagaccttctgacggcccttcctagtggactctgaaccacacgccctacccgtggtntctgtcgcctagaggaccaggccggcctagtacnccaccttgctcgtggatatcgctaagtcaaccaaagcaaattcgtgtacttacgtaggtaccacgcaagaacgcctacggaccgtacgggtccccttgtaccgttaggacttaacttaagtttaaaacgtaacggtactttacgggaaacggtacggggtaccccttagggtaaccccggggaccctttaggaaccggtaacggttctttcccgtacggttacccgggtaccttaccggacgtccgtacgacggtaacccggtacaacgttacggtaccgtaaccggttacaaccgtacgtaccggtagtaccggggtacggtcccgggtaacggaacggtaacgggaccggacggtacgtaacgtacgttaacgtcgttaccggagtacgtaacgtaacaccggtacgtaacggtaggtacggacggttacctacggttacgttacggtacggtttaacggtccgggtagggggaacccg

SEQ ID NO: 66778 - DNA, 554 bp, Homo sapiens
  misc_feature: GYAE6OF01BRWY2.49.73.G07.1.454.CMB.1.raw
  modified_base (213)..(213): a, c, t, g, unknown or other
  misc_feature (213)..(213): n is a, c, g, or t
  modified_base (282)..(282): a, c, t, g, unknown or other
  misc_feature (282)..(282): n is a, c, g, or t
  modified_base (456)..(456): a, c, t, g, unknown or other
  misc_feature (456)..(456): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
  modified_base (525)..(525): a, c, t, g, unknown or other
  misc_feature (525)..(525): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagcccaccctcggtntctgtcgtcctcgaggaccaggaccggccagtactcacctgctctggagatgcattgaccaaagcaatntgcttactggtaccagcagagccaggccaggcccctgtcttgatctactttataaagtactttggagacgggcctacgaacgggacccctggacgcgactttcgtcgtcggccttccagtctcacggccgaacacacgttcacgttcgaacccatcaggtcggacgtcccgggnaaggaggacgaggccgtagacttatactcgtacagtcatacgnggacnggttaagcggtataccgtttncggttagtacgttcggggcggtaaccggg

SEQ ID NO: 66779 - DNA, 678 bp, Homo sapiens
  misc_feature: GYAE6OF01DRRN5.49.73.G07.1.454.CMB.1.raw
  modified_base (140)..(140): a, c, t, g, unknown or other
  misc_feature (140)..(140): n is a, c, g, or t
tcagagtcgagagacacgaccggtgctcgatttagctctacgctcagggcacgaccggtgctcgtttagagagagtgtgttgggttgggggtggtccaggaggcagaactctgggtgtctcaccatggcctggatccctntacttctccccctctcactctctgcacagactctgacgcctctatgagctgacacagcccacccgtggtgtctgtcgtcctcgaggacagtaccggccagtactccactgctcgtggagagtgactagttcgaaccaaagacaattagtgtacttacgtggtaaccagacaagacgccgacggccgacggtcccctgttcttagacttactaaatttaagtaaaagttacgtttagaacggtacgggtacctacggaaccgggtacccgtaggacgtacgtactttcgtcgtacggcctaccgagtacctacgacgacgtaaccaacgtactacgtacgtacgaacctagtacgtacggtacggaccggtaccgggacgaacgggtaacgggacggtacggtacgtagtaacctttaacgttacgttgtacccgtagtaccaacgttacgtaacgtaaggttaacggtcggttaccggtaccttacggtttcgttacggttaccgggttacggttaccggggaccggggtaaaccggg

SEQ ID NO: 66780 - DNA, 181 bp, Homo sapiens
  misc_feature: GYAE6OF01CUL0X.49.73.G07.1.454.CMB.1.raw
  modified_base (175)..(175): a, c, t, g, unknown or other
  misc_feature (175)..(175): n is a, c, g, or t
  modified_base (181)..(181): a, c, t, g, unknown or other
  misc_feature (181)..(181): n is a, c, g, or t
tcagagtcgagagacacgaccggtgctcgatttagctctacgctcagggcggtgctcgatttagctctacgctcagggcacgaccggtgctcgatttagtcacgcggaaagggaaggctagcgtgttcctgttcccgccctcctctctctcgactctgagcgggctggcaaggcncatagn

SEQ ID NO: 66781 - DNA, 658 bp, Homo sapiens
  misc_feature: GYAE6OF01A2QY0.49.73.G07.1.454.CMB.1.raw
  modified_base (140)..(140): a, c, t, g, unknown or other
  misc_feature (140)..(140): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (611)..(611): a, c, t, g, unknown or other
  misc_feature (611)..(611): n is a, c, g, or t
tcagagtcgagagacacgaccggtgctcgatttagctctacgctcagggtcgacgaccggtgctcgtttagagagagtgtgttgggttggggtggtccaggagcagaactctgggtgtctcaccatggcctggatccctntacttctccccctctcactctctgcacagactctgacgcctctatgagcctagacacacgccacccgtggtntaccgtgtcgtcctnaggacnggacggcctagttanccaccgtgctctggacgatcgactagttcgaccaaagcctaaagtacgtacgtacgtttacgtcggtaaccaggacctaaggaaacgcccaagggtacccaacggtccccgttagttaccgttagtaattacctaagtttaaacgtaaacgtacgttttacgacggttaacggcccgtaacggtaacgggtacccctaggtaccgacgttacgtttacgtccgttacggcctccgacgtcacgtacgacgaactaacgacgtccgtaacgtagacccgtaatcgaaggtcgaacggaccgggtacaacggacggaacggaggtccgtacgaacttacgtacgcgtacgtacgtcaacgtcganacgtaggtacgcgtacctattcgcgttacgtagtcggacggtaacgg

SEQ ID NO: 66782 - DNA, 522 bp, Homo sapiens
  misc_feature: GYAE6OF01A6BME.49.73.G07.1.454.CMB.1.raw
  modified_base (224)..(224): a, c, t, g, unknown or other
  misc_feature (224)..(224): n is a, c, g, or t
  modified_base (459)..(459): a, c, t, g, unknown or other
  misc_feature (459)..(459): n is a, c, g, or t
  modified_base (477)..(477): a, c, t, g, unknown or other
  misc_feature (477)..(477): n is a, c, g, or t
  modified_base (512)..(512): a, c, t, g, unknown or other
  misc_feature (512)..(512): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatcacctgctctggagatgcattgccaaagcaatatgcttactggtaccagcagaagccaggccaggcccctgtcttgatctatttaataaagactttgagagggcctcgacggacccctgagcgattctctcgctccagctcagacgacaacagtcacgttcgaccatcagtggacgtccgggacaggacggacggacgggtctacgacttaattacnggtcagtcatacgacganaggtgtcggctacgttctggttagtacgttcgggnggtaaccggg

SEQ ID NO: 66783 - DNA, 693 bp, Homo sapiens
  misc_feature: GYAE6OF01AIPF2.49.73.G07.1.454.CMB.1.raw
  modified_base (212)..(212): a, c, t, g, unknown or other
  misc_feature (212)..(212): n is a, c, g, or t
tcagagtcgagagacacgaccggtgctcgatttagctctacgctcagggcacgaccggtgctcgtttagagagagtgtggttggggtttgggggtgggtccaggaggcagaactctgggtgtctcaccatggcctggatccctctacttctccccctctcactctctgcacagactctgaggcctctatgagctgacacagccaccctggtntctgtcgtcctcgaggacagaccggccagtatccaccttgcctcgtggagtatgctattcgaccaaagcaaattatgtaccttaacgtcggtaccagtacaaggaagtcccgagggcccgacggccccctggttacttgagttctaattttaagtaaagtaccgttttggaacggtacgggtcccgtacggaccggggtaccccgttaggacgtaccggtatttccgtacgttcgggtcctcccagtcctacgacggacgaacaacgtacgtacgtaccgtttagacctagtccgtagggtacggacggtacccgggacgaagggaacgggtacggaagggtcgtaggtaactacgtttacgtggttaccgagttaccacgtaccgaacggtacgtaagggttcggtaccgggtaccttaccggtttccgttacggtttacccggtttaacggttccggggtaccgggggtaaacccgggg

SEQ ID NO: 66784 - DNA, 680 bp, Homo sapiens
  misc_feature: GYAE6OF01AFOI1.49.73.G07.1.454.CMB.1.raw
  modified_base (271)..(271): a, c, t, g, unknown or other
  misc_feature (271)..(271): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgacggcctcctatgagctgacacacgcccacccgtcggtgtctgtcgtcctcgaggacaggaccggacctagtactccacctgcctcgtgganatgctattacgaccaaagactaatacgttgtaccttacggtacggtaacccagacgaacggaccggaccgacggcccgaccggtccccttgtccttagtacttacttaatttaaagtaaacgttacgtttaggaacggtacgggtccccgttacgggacccgggtacccgtaggaccgtcgttacgttcgtcgtcggcctacgacgtccgtaccgacgacccgtaaacctaacgtacggttacctaccggttcgaacctagtacggtacgggtacgggaccgggtccgggagacggacgggacgaggtccgtaagtaactttacgttacgtcgtactacgtactacgcgtaagacgttaggtcggtcgttacgttcttcggtgttacggtcggtcgggacgggaaccgg

SEQ ID NO: 66785 - DNA, 199 bp, Homo sapiens
  misc_feature: GYAE6OF01BPVC8.49.73.G07.1.454.CMB.1.raw
  modified_base (196)..(199): a, c, t, g, unknown or other
  misc_feature (196)..(199): n is a, c, g, or t
tcagagtcgagagacacgaccggtgctcgatttagctctacgctcagggcacgaccggtgctcgatttagctctacgctcagggcacgaccggtgctcgatttagtcacgcgagaaagggaaggggctggccctgacgtgtttctgttcccgccctcctctctctcgactctgagcgggctggcaaggcgcatagnnnn

SEQ ID NO: 66786 - DNA, 736 bp, Homo sapiens
  misc_feature: GYAE6OF01CUNEO.49.73.G07.1.454.CMB.1.raw
  modified_base (273)..(273): a, c, t, g, unknown or other
  misc_feature (273)..(273): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctaccttcctccccctcctcactctctgcacagactctgacggcctcctatgagctagacacacgcccaccgtcggtgtctgtcgtcctacgaaggacaggaccggcctaagtactccacgtgctcgtaggantgactagttacgaaccaaaagacaattacgtgtaccttaacggtacggtaaccagacgaacggaacgcccggacggacccgaccgggtccccttgttcttacggaacttaacttaagtttaaaacgtaaacggttacgtttacgggaacgggtaccggtaccccgtaacgggaacccggtaaccccgtagggacggtaccgttaactttccggtacgtccgtaccttaccgacgtcctacgacgaccgaaactaacgtacgtacgtaccgttacgaaccttggtacgacggggtcggaccgggtccgggacggaagggaacgggtaccggacggtacgttaacgtaactttaacgttacggtacgtacgaacgttcaagtaccgaaacgtaacgtaggtacggttcgtaccgtacgttttacggacggtttacgggtaccgggttcgggaaccgggtaacggg

SEQ ID NO: 66787 - DNA, 659 bp, Homo sapiens
  misc_feature: GYAE6OF01EZ0LB.49.73.G07.1.454.CMB.1.raw
  modified_base (280)..(280): a, c, t, g, unknown or other
  misc_feature (280)..(280): n is a, c, g, or t
  modified_base (421)..(421): a, c, t, g, unknown or other
  misc_feature (421)..(421): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctctatgagctgacacagcccaccctcggtgtctgtgtcctcaggacagaccggccagtatcacctgctctggagatgctattcgaccaaagctaaatntgtcttactggtaccagcagaacgccaggccacggtcccctgtcttgacttcaatttaataaagtactttggaaggacgggtcccttcggaaccgggtacccctagacgaccggtatttccgtagtcggtcctaccgtacncgttacgacgacccgaaactaacgtacgtaccgtacgtttacgaacccctaagttaccgaacgggttcgggaaccgggttccggggacaacggggtaacgggaaccggacgggtacctaggtaacctttaagttaccgtggtaccgtacgtactaacgttaccgaagtaacgtaggttagggtacggtccttacgttcgttacggtaccggttacgttccggggcgggtaaacccggg

SEQ ID NO: 66788 - DNA, 647 bp, Homo sapiens
  misc_feature: GYAE6OF01BNN8O.49.73.G07.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggcctcctatgagctgacacagccaccctcggtntctgtgtcctnaggacaggaccggccagtatcacctgctctggagatgcattcgaccaaagcaaatatgtcttactcggtaccagacaagaacgccaggccacggcccctgtcttgatctatttaataaacgtactttaggaagacgggtcctacgacgggacccctggacgacgtattctacgtcgggtccttccgacgtcctcgacggacccgaacgaacgacgtacctaccggttacgaaccctataccgtagggtcgggacggtccgggacgtaacgggagggaaccggacggggtaccttaggtaacctttaagttaccgtagtccgtacgtacctaacttcggaacgtaacgttaaggtacggtcggtaccttaaccgtttcgttacgggttacgtttacggttcccgggggagggtaaacccgggg

SEQ ID NO: 66789 - DNA, 703 bp, Homo sapiens
  misc_feature: GYAE6OF01BFQBC.49.73.G07.1.454.CMB.1.raw
  modified_base (217)..(217): a, c, t, g, unknown or other
  misc_feature (217)..(217): n is a, c, g, or t
  modified_base (301)..(301): a, c, t, g, unknown or other
  misc_feature (301)..(301): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacagactctgacggccctctatgagctagacacacgcccacccgtggtntctgtcgtcctgaggacagccggccagtactccacctgcctcgtaggagtagtcgactagttcgaaccgaaagtactaaagttntcggtacctttaacgtacggaaccagaccgaaggaaccgccgacggacccgaccggtcccctgttccgttagacttattaaacgtttaaagtaacgtcgtttaggaacggtaccggtccgtaaccggaccgggacccttagggacgtacgttacttccgtcgtacgtcctacgtacgcctacgacgacaacgaactcggtactacgtacaactacgtcgaggtcggacggtccggaacgtaggaacgggtacgacggtactaacggttaacgttacgttacgtagtccgtagtaccgtaagtaccggtaacgtaacggtaaggttcggtaccgttaccttaccggttttaccgtacggggtttacccggtacgggttacccggggtaacggggtaaacccgg

SEQ ID NO: 66790 - DNA, 729 bp, Homo sapiens
  misc_feature: GYAE6OF01EB3J7.49.73.G07.1.454.CMB.1.raw
  modified_base (145)..(145): a, c, t, g, unknown or other
  misc_feature (145)..(145): n is a, c, g, or t
  modified_base (225)..(225): a, c, t, g, unknown or other
  misc_feature (225)..(225): n is a, c, g, or t
tcagagtcgagagacacgaccggtgctcgatttagctctacgctcagggtcggacgaccggtgctcgtttagagagagtgtgttgggtttgggggtgggtccaggaggcagaactctgggtgtctcaccatggcctggatccctntacttctcccctctcactctctgcacagactctgaggcctcctatgagctgacacagtccacctcggtgtctgtcgtccncaggacagacggcaggatcactgtcttctggccgtagtcgacaacttcggaccaaaaacaactatacgtactttacgtaggtaaccagacgaaggacggcccgacgggccaacgggtccccctgttccgttggtgtaattttaacaaagtctttagagtacggccctcgacgggaccctgacgcgtacttcgtacgtcggccttacgacgaccgttacggaacgggacctaaacgtaagttaccctaacccgtttacggaacccctagttacgtacggtacgggaccggttaccccgggacgaaaccgggaagggaaccgtaacgggtaccggttaaggtaccgtttaacggttaaccgttacgggtacgtaaccggtccccggtacgtaaaccggaaccgaccgggtaccgtaacgggtacgggtacgtaaccgggtttaacgtcggttaccggtaccggtttccggggaccgggtaaacggggtcccttacggtaccccggg

SEQ ID NO: 66791 - DNA, 655 bp, Homo sapiens
  misc_feature: GYAE6OF01DP7CQ.49.73.G07.1.454.CMB.1.raw
  modified_base (239)..(239): a, c, t, g, unknown or other
  misc_feature (239)..(239): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttctccccctctcactctctgcacagactctgagcctctatgagctgacacagcccaccctcggtgtctgtcgtcctgaggacagccggcagtancacctgctctggagatgctattcgaccaaagcaatatgtacttactggtaccagacagaacgccgaggaccgacggtccccttgtctgacttacattttaagtaaagtacgtttagaggtacgggtccgtacgacggacccctggacgacgtactttccgtacgtcggtccttacccgacgtaccgtacgacgtacgaaccgaaacgtacgtaccgtacgtcggtaaccacgtacgaggtacggacgggtaccgggagaaacggggtacgaacggtacggtacgttacggtaacttaacgttacgtagttaccgacgttaccaagttccgaaacggtacgtaacgggtacggtaccggtacgttaacgtttcgttacggttcggtttaacggttccgggaacggggttaaccgggg

SEQ ID NO: 66792 - DNA, 655 bp, Homo sapiens
  misc_feature: GYAE6OF01EQ6PL.49.73.G07.1.454.CMB.1.raw
  modified_base (259)..(259): a, c, t, g, unknown or other
  misc_feature (259)..(259): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctggtgtctgtcgtcctcgaggacagaccggccagtatcacctgctcgtgganatgctattcgaccaaagcaatatcgtactttacgtcggtaaccaggacaaggacgccgagggccacggtccccttgtcttgacttactaattttaaataaacgttacgtttaggaacggacgggtccctacgaaccgggtacccctggaacgtccgtaatttccgtcgtcggtcctaccgtagcctacgaacgaccgaaaccaacgtacggttacctacggttacgaaccctagtacgagggttacggacgggtccgggacgaagggaaccgggacggtaggtccgttaggtaactttacgttacgttgtacgtacgtacaacgtacgaacgtaagtagtacggtcgtaccttacgttcgttacggttagttacggttcgggaccgggtaaacggg

SEQ ID NO: 66793 - DNA, 730 bp, Homo sapiens
  misc_feature: GYAE6OF01BBHDJ.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctctatgagctgacacacgcccacccgttcggtgtctgtcgtcctcgaggacaggaccgccagtactccacctgctcgtggagatgctattcgacaaagcaatatcgtcttacgtcggtaccagacaagacgccgacggccaccggcccttgtcttagatactaatttaagtaaacgttcgttagaggtacggcctacggaccggtaccctggacgtcgtacttccgtcgtcgtccgtaccgagtcctacgacgtaaccgaaccgtaaacgtacgtacccgtaacggttaccgaacctacgttacggtacgggttacggggtaaccgggtacccgggaacggtaacggggaacggggtaacccggtaaggggtacccgttaacggttaaaccgttaacgtttacgttaccgttaccgtaagttccctaaacgttaccggaaacgtaaccggttaagggttaccgttaccgggttacctttacccgggttacgttttacgggttaccgggtttaacgggtttcccgggggaacggggttaaacccgggg

SEQ ID NO: 66794 - DNA, 698 bp, Homo sapiens
  misc_feature: GYAE6OF01DJL1H.49.73.G07.1.454.CMB.1.raw
tcagagtcgagagacacgaccggtgctcgatttagctctacgctcagggcacgaccggtgttcgttagagagagtgtggttggggtttgggggtgggtccaggaggcagaactcgtgggtgtctcaccatggcctggactccctctacttcctccccctctcactctctgcacagactctgacgcctctatgagctagaccacacgccctacccgtcggtgttctgtcgtcctacgaaggaacgacgaccggccaagtactcaacctgcctgtaggagtactgactatacgaacaaagtctaatatcgtacttacgcggtaaccagacgaacgacgaccgacggaccgaccggtccctgttaccttagaacttacttaaatttaagtaaaacgttacgtttagggaacggacggtccctaacggacccgggtaccctaggacgtacgttaacttccgtacgtcggtcctaccgtacgcctacgaacggtaaccaacaacgtacgtacgtacgttacaaccgtagtacggtaggtgggaaccgggtccggaagaagggaacggacggacggtactaacgtaactttacttaggtcgtaacgtacgtacacgtacgacggtaaacgttaggtacggtcgtaaccttcggtttacgtcggttaacggttaccgggttacggggacgggaacgggtaaaccg

SEQ ID NO: 66795 - DNA, 651 bp, Homo sapiens
  misc_feature: GYAE6OF01DTMM2.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtcgtcctcgaggacagacggccagtatcactgctcgtggagatgctattgaccaaagcaatatgcttactggtaccagcaagacgccaggccacggcccctgtctgactactatttataaagtactttaggagacgggcctacgacggacccctgacgcgtacttctcgtcgctccagctcgacgacgacaacgtagtccacgtttcgaacctacgtcgtaacgggttgggtaccgggtacccgggacgtaacgggaacggggaacccgggtaaggggtcccgttacggtaaaccgttttaacgtttacgttaggttccgtaacgttaccgtaagtaccgtacggtaaccggtaagggttaccggtcggtaacgttaccgttttacggtttcgggttaccgtttacggtttccgggggcggggtaaacccgggg

SEQ ID NO: 66796 - DNA, 684 bp, Homo sapiens
  misc_feature: GYAE6OF01E1VOS.49.73.G07.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctctcactctctgcacagactctgagcctctatgagctgacacacgcccacccttggtntctgttcgtcctnaggacagaccggccagtactcacctgctctggagatgnattgacctaaaagacaaatatcgtctttacgtggttaacccaggccaaggaacgccgaacggaccgacggtcccctgttccttgactcctaattttaaataaacgtacttttaggaacgtacgggtcccgtaccggacgggtaccccgttaggacgaccgtattttccgttcgttcgggtccctacccgaacgtccttcgaacggtccgaaacaaccgtaaggtacccttaacggttaccgaacctacgttaccgtacgggtcgggtacccgggtccggggacgaagggaacggggacgaacgggtcgttacgtaacttaacgttacgttagtactaggtcagttaaccgagtaccgtaaggttaggtcgaccttaacgtttccgtaggttacgttacgttccggggacgggtaaccgggg

SEQ ID NO: 66797 - DNA, 558 bp, Homo sapiens
  misc_feature: GYAE6OF01B6QNV.49.73.G07.1.454.CMB.1.raw
  modified_base (383)..(383): a, c, t, g, unknown or other
  misc_feature (383)..(383): n is a, c, g, or t
  modified_base (513)..(513): a, c, t, g, unknown or other
  misc_feature (513)..(513): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcgaggacagaccggccagtatcacctgctctggagatgcattgaccaaaagcaatatgcttacgtggtaccagcagaacgccaggccacggcccctgtcttgatctaatttaataaagtactttgagtaggcctacgacgggaccctgagcgtattcctntcggtcctccacgctcgagaccaacaacgagttaccacgttcgaacctagtcgacggtcggtacggtccgggacgaaggacgggacgaggtacctagaacttacttactcgttacacgtcaatcgaaganaggtagcggtctacgttcttagtacgtagttcgggcggtaacggg

SEQ ID NO: 66798 - DNA, 700 bp, Homo sapiens
  misc_feature: GYAE6OF01CERNS.49.73.G07.1.454.CMB.1.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
tcagagtcgagagacacgaccggtgctcgatttagctctacgctcagggcacgaccggtgctcgtttagagagagtgtgttgggttgggggtggtccaggaggcagaactctgggtgtctcaccatggcctggatccctctaccttcctccccctctcactctctgcacagactctggacggcctcctatgagctgaacacgacgcccacccgttggtntctgtcgttccagaggacaggaccggtccaagttactccaccgtgccgtcgtggaagngtgactattcgaaccaagactaatntcgtacttacggtacggtaccagaccgaagaacgacccgacggacccgaccggtcccccgttgttaccgttagacttacgttaattaacgttaaagtaccgtttaggaacggacggtccgtaccgaaccggggtacccctaggtacgacgttacgttcctcggtcggtcctacgagtaccgtacgagaacccgaaccgaactacggttactaaccggttacgaaccctacgtcgaaggtcgggacggtcccgggagaagggtaccggacggaggtacgtagtacctttaacgtcaggttacacggtacctagtacccgtaagaccggttaaaggtcggtacgtaccgttactttaccggttcggttaccgtttacgtcccgggtaggggtaacccggg

SEQ ID NO: 66799 - DNA, 687 bp, Homo sapiens
  misc_feature: GYAE6OF01EALJP.49.73.G07.1.454.CMB.1.raw
  modified_base (252)..(252): a, c, t, g, unknown or other
  misc_feature (252)..(252): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacagactctgaggcctctatgagctgacacagcccacccgtcggtgtctgtcgtcctacaggacaggaccggccagtatcaccngctctggagatgcagttcgacaaacgcaaatatcgtacttactacggtaaccacgacaagaacgccgacggccgacggtccctgtcttagactactatttaataaagtacgtttagaggacggtacccgtcggaacgggtacccccgtgagcgtaactttcgtacgtcgggacctaccgacgtacctcgaaccggaccgaaaccgtaaacgtacgttaacccgtacggtttacgaaccctaagtacgtaagggtacgggtacgggtcccggggaacgaacgggaacgggaacggaacgggtcgttaaggttaccttaagtttacgtcggttaccgtaacgttaaccgtacgtaccgaagtaacgtacggttaggtacggtaccttacgtttcgttaccggttagttaacggtttcccggggagggtaaacccggg

SEQ ID NO: 66800 - DNA, 640 bp, Homo sapiens
  misc_feature: GYAE6OF01DRL78.49.73.G07.1.454.CMB.1.raw
  modified_base (215)..(215): a, c, t, g, unknown or other
  misc_feature (215)..(215): n is a, c, g, or t
  modified_base (248)..(248): a, c, t, g, unknown or other
  misc_feature (248)..(248): n is a, c, g, or t
  modified_base (501)..(501): a, c, t, g, unknown or other
  misc_feature (501)..(501): n is a, c, g, or t
tcagagtcgagagacacgaccggtgctcgatttagctctacgctcagggcacgaccggtgctcgtttagagagagtgtggttgggtttgggggtgggtccaggaggcagaactctgggtgtctcaccatggcctggatccctctaccttctccccctcctcactctctgcacagactctgacgcctctatgagctgacacagcccaccgtcggtntctgtcgtcctcgaggacagaccggaccagtancacctgctcgtggatagtgactagttcgaaccaaagccaaattactcgtccttacgtacggtaccgacgacgaacgaacggaccgaccggaccgaccggtacccgttcgtcgttactagtacttaatttaataaagtacgtttagaggacggtcctaccgacggtacccgcgtagcgtacttcgtccgtgcctccgacgtcgtactacgacgtaacgaacctaacgtcctacgtaccgtaccacgcgtacggnggtacggaccgggcgaacggacggacggacggtcgtacgtacgttaactacgtactacgtacgtactacgacgtacgaagtacggtagtacgtaccttacgttacgttcggttacgttacggtcgggtacggaaccggg

SEQ ID NO: 66801 - DNA, 195 bp, Homo sapiens
  misc_feature: GYAE6OF01A9SO0.49.73.G07.1.454.CMB.1.raw
  modified_base (193)..(195): a, c, t, g, unknown or other
  misc_feature (193)..(195): n is a, c, g, or t
tcagagtcgagagacacgaccggtgctcgatttagctctacgctcagggcacgaccggtgctcgatttagctctacgctcagggcacgaccggtgctcgatttagtcacgcgagaaagggaaggggctggcctgacgtgtttctgttcccaccctctctcttcgactctgagcgggctggcaaggcgcatagnnn

SEQ ID NO: 66802 - DNA, 650 bp, Homo sapiens
  misc_feature: GYAE6OF01BOFMU.49.73.G07.1.454.CMB.1.raw
  modified_base (92)..(92): a, c, t, g, unknown or other
  misc_feature (92)..(92): n is a, c, g, or t
  modified_base (117)..(117): a, c, t, g, unknown or other
  misc_feature (117)..(117): n is a, c, g, or t
  modified_base (140)..(140): a, c, t, g, unknown or other
  misc_feature (140)..(140): n is a, c, g, or t
  modified_base (155)..(155): a, c, t, g, unknown or other
  misc_feature (155)..(155): n is a, c, g, or t
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
tcagagtcgagagacacgaccggtgctcgatttagctctacgctcagggcacgaccggtgctcgtttagagagagtgtgttgggtttggggnggtccaggaggcagaactctgggtntctcaccatggcctggatccctntacttctcccctctnactctctgcacagactcgtgacgcctcctagtgacgctagacacgacgcctacccgtggtctctgcgtcctgaggacaggaccgctaagtacnccactgctcgtggagtagtgcctagttcgaccaaagctaagtntgtcttacgtaggtaccagcgagaacgcgacggccagtcccctgtctgactctattaanaacgtcttagacgcggactcggacggtcccgtgacgtacgtacttcgttacgtcgtacccgtacgacgtccgtacgtaacgacgaaccgtaacgtacgttacctacggttacgaccgtacgtacgtacggtcggacggtccgggacgtaacggtagggtaccgacggtccgttaacgtacgtttaacgttaccgtgtaacgtacggtactaacgtaccgtacgtaacgttacggtaacggtcgtaaccttacgtttacgtacggtttaccggttcgttacgggggtccgtaaacccgggg

SEQ ID NO: 66803 - DNA, 710 bp, Homo sapiens
  misc_feature: GYAE6OF01AME5U.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggctggatccctctacttcctcccctcctcactctctgcacagactctgaggcctcctatgaaagctgacacacgccacccgtcggtcgtctgtcgtcctcgacggacgacggaccggacctacgtactccacctcgctcgtaggagtagtcgactacgttacgaaccaaacgaactaagtacgttacgtaccgtttaaccgtacggtaaccgaacgaccgaacggaaccggaccggaccggacccgtaccggtcccgttacgttacgttacgtaacttaacttaactttaaacgttaaacgttacgttacggacgggtacggtaccgtaccggtaccggtacccgtacgtacgtacgtacgttcgtcgtcgtcctaccgtacgtacgtacgacgacgaacgaacgtacgtacgtacgtacgtacctacgtacgtacggtacggtacggtaccggacggaacggacggtacggtacggtacgtacgtacgttacgttacgtacgtacgtcgtacgactacggtacgtacgtaggtcgtcgtaccttcgttcgtacggttacggtacggtcgggacggtacgg

SEQ ID NO: 66804 - DNA, 757 bp, Homo sapiens
  misc_feature: GYAE6OF01B8SFC.49.73.G07.1.454.CMB.1.raw
  modified_base (255)..(255): a, c, t, g, unknown or other
  misc_feature (255)..(255): n is a, c, g, or t
tcagagtcgagagacacgaccggtgctcgatttagctctacgctcagggcacgaccggtgctcgtttagagagagtgtggttggggttgggggtgggtccaggaggcagaactctgggtgtctcaccatggcctggatccctctaccttcctccccctctcactctctgacacagactctgacgcctctatgagctagacacacgcccaccgtggtgtctgtcgtcctacgacggacacggacggaccagttacncctacgtgctcgtaggagtatgactagttcgaacctaaaagactaatagtacgtacctttaacgtacggaaccagtacaacggaaccgccggaccggacccgtacccgggtcccttaggttactgtaacttacttaaagtttaaagttaaacgtacgtttagggacggtaaccgggtacccgtaccggaaccgggtacccttagggaccgtacggttaccttaccgtacgtccggtacctaccgacgtcctacgacgacccgaaacgtaacgtacgttccgtaacgggttaccgaaccgtacgttacggacgggtacgggtacgggacccgggacgaacggggtaacggacgggaacgtccgtacgttaaactttacgtcgttaccgtacgtacgtacgtaacgacgtaacggtacggttaaggtcggttaccgtacttacccgggtttacgttaggttaacccgggtttacggggtacccggggtcgggggtaaacccggg

SEQ ID NO: 66805 - DNA, 695 bp, Homo sapiens
  misc_feature: GYAE6OF01AUWQ3.49.73.G07.1.454.CMB.1.raw
  modified_base (269)..(269): a, c, t, g, unknown or other
  misc_feature (269)..(269): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttcctccccctctcactctctgcacagactctgacggcctctatgagctgacacagcccaccctgggtgtctgtcgtccctcgagggacaggaccgggtccaagtactccaccttgcctctgganatgcattcgaccaaagctaaatatgacttacgtggtaaccagtacgagaacgccaacggcccaacgggccctgttccgtgaactactaattttaagaaaagttacgtttaggacggtacggtccctcgaacgggaccccgtgacgtacgtactttcgtaccgtggtcctaccgacgcgtaccaggtccgaaaccaacgtacgttacgtaaccgtttacgacctaacgtacgtagggttacggacggtccgggacgaacgggagggaaccggtacggtacgtaacgtacgttaattaccgttagactacggtacctaagtaccgaacggtaagtaacggttaccgggtacggtacccgtttaccgtttacgttaccgggtttaacggtttacggggttacccgggggtacggggtaaaacccggggg

SEQ ID NO: 66806 - DNA, 162 bp, Homo sapiens
  misc_feature: GYAE6OF01CNTR4.49.73.G07.1.454.CMB.1.raw
  modified_base (160)..(162): a, c, t, g, unknown or other
  misc_feature (160)..(162): n is a, c, g, or t
tcagagtcgagagacacgaccggtgctcgatttagctctacgctcagggcacgaccggtgctcgatttagtcacgcgagaaagggaaggggctggccctgacgtgtttctgttcccacctcctctctctcgactctgagcgggctggcaaggcgcatagnnn

SEQ ID NO: 66807 - DNA, 633 bp, Homo sapiens
  misc_feature: GYAE6OF01ALJMQ.49.73.G07.1.454.CMB.1.raw
  modified_base (141)..(141): a, c, t, g, unknown or other
  misc_feature (141)..(141): n is a, c, g, or t
  modified_base (191)..(191): a, c, t, g, unknown or other
  misc_feature (191)..(191): n is a, c, g, or t
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
tcagagtcgagagacacgaccggtgctcgatttagctctacgctcaggcacgaccggtgctcgtttagagagagtgtgttgggtttgggggtgggtccaggaggcagaactctgggtgtctcaccattgcctggatccctntacttctccccctcctcactctctgccacagactctgacgcctctatganctgacacagcccaccgtggtntctgtcgcctgagacaggaccgcatanccacctgcctgnganatcactatacgacaagacaatatcgtacttacgcgacagacagacgccgagccgacgccctgtctgactactattaactaagtcgttagacgacgtaccgtacgaccggaccctaggacgtaccgtacgttcgtaccgtcgtacctccgtacgtaccgtacgacgaccgtaacgaacgtacgtaccgtacgttaccgaacctacgtacgtacggtacggtacggtaccgggacgaacggtacgggacgtacggtacgtacgtacgttaacgttacgttaacgtccgtaagtaccgtaagtaccgaacgtacgtacggttacggttaccgtactttacggttaccgttacgttacggttaccggtcgggacgggtaacgg

SEQ ID NO: 66808 - DNA, 813 bp, Homo sapiens
  misc_feature: GYAE6OF01D2FPF.49.73.G07.1.454.CMB.1.raw
  modified_base (228)..(228): a, c, t, g, unknown or other
  misc_feature (228)..(228): n is a, c, g, or t
tcagagtcgagagacacgaccggtgctcgatttagctctacgctcagggcacgaccggtgctcgtttagagagagtgtgttgggtttgggggtgggtccagggaggcagaactctggggtgtctcaccatggcctggatcccctctacttcctcccctcctcactctctgcacagactctggacgcccttactagtgagtctacgaacacacgccctacccgtcggtnttcgtgtcgtccctagaaggacgacggaccggtcaagtactccacgtgcttcgtgggaagatcgactaacgttacgaaccgaaaagactaaatatcgtacttaacgtacggtaacgagacgaaggaccgaccgacgggacccgaccggtccccttaggttcttacgtaacttacctttaaagttttaaacgtaaacgtttacgtttagggaacggtacccggggtaccgtaccggacccggggtaacccctggacgtcgttacttacccgttgtccgtacctaccgaccgtacgtaccgaacggaaccgaaaccgtaaaccgtacggtaacccgtttaacgttaccggtaacctaaccggttacgggtaagggtccggggttaaccggggacccgggacgaaacggggtaacgggtaacgggtaccggttaccggttaacgtttaacgttacgtttacggtacgttacccgtaaggtaccttacgtacgtaaacggtaaggttacgggttacgggtacgtaccgtttaaccgtttcggttacgggtttacggtttaacgggtccggggaccggggtaaaaccggg

SEQ ID NO: 66809 - DNA, 750 bp, Homo sapiens
  misc_feature: GYAE6OF01ARRIZ.49.73.G07.1.454.CMB.1.raw
  modified_base (177)..(177): a, c, t, g, unknown or other
  misc_feature (177)..(177): n is a, c, g, or t
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
  modified_base (388)..(388): a, c, t, g, unknown or other
  misc_feature (388)..(388): n is a, c, g, or t
  modified_base (466)..(466): a, c, t, g, unknown or other
  misc_feature (466)..(466): n is a, c, g, or t
tcagagtcgagagacacgaccggtgctcgatttagctctacgctcagggcacgaccggtgctcgtttagagagagtgtgttgggtttggggtgggtccgaggaggcagaactctgggtgtctcaccatggcctggatccctctacttctcccctcctcacctctctcgcacagactntgacggccctcctatgagctgacacncgcccaccgtcggtgtcttcggtntccctnaggacaggaccgccagtatccgaccttgctacgtggagactggctaattgaacccaaagtcaaacgttntacggtcttaaccgtgggtacccagcgaagtaaacgccgtaagggccacgggtcccctggtaccttacgaattccgtaatttaaanaaacgtcgttgacggtacggccttacgaccgggtaccctcgtaaggcgttaacttcgtcggttaccggtcgtacccgngacgttccgaacgttaccgaacgtaaccgacggttaccgtacggttaaccgaaccgtacgttaccgtaacgggtcgggtaacggtacccgggtaccggaacgggtaaaccggacgggtaaaccggtcgtaacgggttaacctaaccggttacggttaacgtcccgtaaggttccgaaaccgttaacgtacggtaaccgtacggttaaaaccggttcgggtaaccttaccggtttacggttaccgttaacggtttaccggttaccggggtccgggtaaaccgggg

SEQ ID NO: 66810 - DNA, 654 bp, Homo sapiens
  misc_feature: GYAE6OF01D9UCU.49.73.G07.1.454.CMB.1.raw
  modified_base (264)..(264): a, c, t, g, unknown or other
  misc_feature (264)..(264): n is a, c, g, or t
  modified_base (320)..(320): a, c, t, g, unknown or other
  misc_feature (320)..(320): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgagcctcctatgacgctgacacacgcccacccgtcggtgtctgtcgtcctagaggacaggaccggccagtactccacctgctcgtgganatgctagttcgaccaaagctaaatagtcgtacttagtacggtaccagcaaggaacnccgacggccaccggtccctgttcttagactacttaagtttaaactaaagttacgttaggaacgtaccgggtaccgtaccggacggtacccctaggacgtcgtacgtttccgtcgtcggtacctacgaccgtactacgacgaccgaaaccaacgtacgtaccgtaccgttacgaacccgtagtacgtaggtacgggacggtacccgggagtaacgggacgggacgacggtacgtacgtagttaacttagttacgagtcgtacgactacgtaacgtagtaggtacgtacgtacttacgttcgtacggttacgtacggttccgggacggtaaacggg

SEQ ID NO: 66811 - DNA, 212 bp, Homo sapiens
  misc_feature: GYAE6OF01EUN0V.49.73.G07.1.454.CMB.1.raw
  modified_base (210)..(212): a, c, t, g, unknown or other
  misc_feature (210)..(212): n is a, c, g, or t
tcagagtcgagagacacgaccggtgctcgatttagctctacgctcagggcacgaccggtgctcgatttagagagagtgtgttgggtttggggggaagaggaagactgacggtccccccaggagttcaggtgctgggcacagcggccctgggctgcctggtcaaggactacttcctcgtagcactctgagcgggctggcaaggcgcatagnnn

SEQ ID NO: 66812 - DNA, 658 bp, Homo sapiens
  misc_feature: GYAE6OF01C2ZY1.49.73.G07.1.454.CMB.1.raw
  modified_base (211)..(211): a, c, t, g, unknown or other
  misc_feature (211)..(211): n is a, c, g, or t
  modified_base (245)..(245): a, c, t, g, unknown or other
  misc_feature (245)..(245): n is a, c, g, or t
tcagagtcgagagacacgaccggtgctcgatttagctctacgctcagggcacgaccggtgctcgtttagagagagtgtgttgggttgggggtggtccaggaggcagaactctgggtgtctcaccatggcctggatccctctacttcctcccctctcactctctgcacagactctgacgcctcgtatgagctgacacacgccaccgtcggtntctgtcgtcctagaggacacggaccggcagtacncgactgctcgtggagatgactattcgacaaagctaatatgtccttaacgtagtaaccagacgaagaacgccgacgccgacggccccttgtcgttacgatactaactttaactaaacgtactttacgacggtacggcccttacggaccggtaccctaggcgtcgtacttctcgtagcccttacgacgcctcgaacgaccgtaaacacgtaacgtcgtaaccgtttcgaaaccgtacgtacgtacggtacgggacgtaccgggacgaacgggaacgggaccgtaacggtacgttaccgtaacgtttaacgtacgttcggtactacgtacgtaataccgaacggtacgtacggttacggacgttcgtaaccgttcggttacgttaccggttcgggtcgggtaaacgggtaacccgg

SEQ ID NO: 66813 - DNA, 723 bp, Homo sapiens
  misc_feature: GYAE6OF01C6S7H.49.73.G07.1.454.CMB.1.raw
  modified_base (140)..(140): a, c, t, g, unknown or other
  misc_feature (140)..(140): n is a, c, g, or t
  modified_base (147)..(147): a, c, t, g, unknown or other
  misc_feature (147)..(147): n is a, c, g, or t
tcagagtcgagagacacgaccggtgctcgatttagctctacgctcagggcacgaccggtgctcgtttagagagagtgtgttgggttgggggtggtccaggaggcagaactctgggtgtctcaccatggcctggatccctntacttcnccccctctcactctctgcacagactctggagcctctatgagctgacacagcccaccgtggtgtcctggtcgtccctgaaggaccaggaccggcctaaggtactccgacctgctcgtaggagtacgtcgtactacgttacgaaccgtaaagtactaaagttacgttacggtaccgtttaaccggtacggtaaccgacgaccgaacggaaccgccggacggacccgtaccggtccccttgttacgttacgtaacttacgttaaatttaacgtaaacgttacgtttacggacggtacggtcctacggtaccggtaccctgacgtcgtacttccgtcgtcgtcctccgtacgtcctacgacgactaacgtaacgtacgtaccgtacgtacgtaaccgtacgtacgtacggtcggtacggtccgggacgaacggacggtacggtacggtacgtacgttaacttagttacgtacgttaccgtaacgtcgtaacgtacgtaacgtaggttaacggttcggtaccgtaccgttactttacggttacggttacggtttaccggtcggggtaaccgggtaaacggg

SEQ ID NO: 66814 - DNA, 631 bp, Homo sapiens
  misc_feature: GYAE6OF01B3GW0.49.73.G07.1.454.CMB.1.raw
  modified_base (419)..(419): a, c, t, g, unknown or other
  misc_feature (419)..(419): n is a, c, g, or t
  modified_base (514)..(514): a, c, t, g, unknown or other
  misc_feature (514)..(514): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgacggcctcctatgagctgacacacgcccaccctcggtgtctgtcgtcctacgaggacaggaccggcctagtactccacctgctcgtggagatgactattcgaccaaagctaaatagtcgtactttaacgtcggtaaccagaccgaagaacgccgacggccacggtcccctgtcttagactacttaatttaagtaaagtactttaggacggtacggtccctacggaccggtaccctgacgtntacgtttctcgtcgcctccagtcctacaacggaccaaccaacgtacgtacccgttacgtacgaaccacgtcgagggttcggacgggtcccggganagggaacggagacggtactagtacttagttacgtgtacgagtcagtacaggtaacgtggtaacggtcgaccttacgttacgttgttaacggtcggttccgggacgggtaaaccgggg

SEQ ID NO: 66815 - DNA, 775 bp, Homo sapiens
  misc_feature: GYAE6OF01AGGM6.49.73.G07.1.454.CMB.1.raw
  modified_base (266)..(266): a, c, t, g, unknown or other
  misc_feature (266)..(266): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgagcctctatgagctgacacacgcccaccgtcggtgttctgttcgtccctcgaagacaggaccggcctagtactccaccgtgcttcgnggagatgactagttacgaccgaaaagctaaattactcgtaccgtttaacgtccgggaaccacgtacaaacggaccgaccgacggacccgaccggtcccctagttaccgttgtaacttcgttaaagtttaacttaaacgtaccgtttaggaaccggtaccgggtaccccgtaccggaacgggtacccctagggtacgtacccgttaagtttccgtaccggtccggtacccttaccgtacgtacccgtacgaacggacccgtaaaccgtaaccggttacgtaacccgttaacggttaccgaaccgttaaccgtacggtaccgggtacgggtaccggttaccccgggtagaacggggttaacggaccgggtacggtaccgtaacgttaacgtttaaccggttagttaccggacgtaaccgtcgaattaccgacggtaacggttacggtttaccggcgttaactttccggttacgtacggttagggtttccgtaccggggacggtaaacccgg

SEQ ID NO: 66816 - DNA, 694 bp, Homo sapiens
  misc_feature: GYAE6OF01A8HY6.49.73.G07.1.454.CMB.1.raw
  modified_base (141)..(141): a, c, t, g, unknown or other
  misc_feature (141)..(141): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatggcctggatccctntacttctccccctctcactctctgcacagactctgagcctctatgagctgacacagcccaccgtcggtgtctgtcgtcctcgaggacaggaccggccagtactcaccgtgctcgtaggagtatcgactattacgaaccaaagacaaattacgtcgtacctttaaccgtacggttaacccaggaccgaacggaacgcccgacgggccctaccgggtcccccttggttaccttagtaacttaccttaagttttaaacgtaaacggttacgtttaggacggtaccgggtacccttacgggaaccggtacccctaggacgtacgtacttccgtcgtcggtcctaccgacgtccgtacgacggtacgaaccgaacgtacgtaccgtaccgttacgaacctagtacgaggtacgggaccggtccgggacgaacgggaacggacggtacggtcgttacgacgtttaagtaccttgtacgtacgtacacgtaacgacgtacgtaaggtcgtacgacttaccgttacggtcgttacggttacggtccgggaacggtaaccgg

SEQ ID NO: 66817 - DNA, 646 bp, Homo sapiens
  misc_feature: GYAE6OF01DTJ3K.49.73.G07.1.454.CMB.1.raw
  modified_base (260)..(260): a, c, t, g, unknown or other
  misc_feature (260)..(260): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttctccccctcctcactctctgcacagactctgacggcctcctatgagctgacacagcccacccgtggtgtctgtcgtcctgaggacagaccggccagtatcacctgctctggagntgctattcgaccaaagcaatatgtacttactcggtaaccagacgaagaacgccgacggccgaccggtccccttgtcttagtatactaatttaactaaagtacgtttagacggtacggtccttccggaaccgggtacccctggacgtcgtactttccgtacgttcggtccttccgacgtacctacgaacgaccgaacaacgtacgtaccctacgttacgacctagtacgaggtcggtacggtccgggacgaaggtacggaacggaggtacgttaggaacctttagttaccgtagtaccgtagtacccgtataccgaagtacgtaggttacggtacgtaccttacgtttcgtacggttacgtacgggttccgggacgggtaaccgggg

SEQ ID NO: 66818 - DNA, 643 bp, Homo sapiens
  misc_feature: GYAE6OF01D1CE8.49.73.G07.1.454.CMB.1.raw
  modified_base (261)..(261): a, c, t, g, unknown or other
  misc_feature (261)..(261): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgacggcctctatgagctgacacacgcccaccgtcggtgtctgttcgtcctgaggacaggaccgccagtactccactgctcgtgganatgactagttcgaccaaagctaatacgtgtaccttacgtcggtaacacgacgaagaacgccgacggacccaccgggtcccttgtccttagacttactaatttaataaacgttacgtttaggaggtacggtcctacggtaccggaccctgacgtcgttacttcgtcgtcgctccgacgtcctacgacgacaacctaacgtcgtactacggttacaaccgtacgtacgtacggtcgggtacgggtaccgggacgtaagggacgggaacggtacgtcgtaacgtactttaacgtacgtcgtaccagtacctagtacgaacgtaactaggttacgacgtacgttacgtttcgttacgttacgttcgggttccgggacgggtaacgg

SEQ ID NO: 66819 - DNA, 647 bp, Homo sapiens
  misc_feature: GYAE6OF01ESK4Q.49.73.G07.1.454.CMB.1.raw
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (423)..(423): a, c, t, g, unknown or other
  misc_feature (423)..(423): n is a, c, g, or t
tcagagtcgagagacacgaccggtgctcgatttagctctacgctcagggcacgaccggtgctcgtttagagagagtgtgttggggtttgggggtgggtccagggaggcagaactctggggtgtctcaccatggcctggatccctctacttcctccccctctcactctctgcacagactctggaggcctcctatgagctgacacagcccacccgtcgggtgtcctggtgtccctcgaggacaggaccggccagtactcacctgcctcgngganatgctattcgaccaaaagctaatatgtctttacgtcggtaccaaggccaaggaacgcccgagggcccacgggtccccttggtaccgttgacttactaatttaaataaagtctttaggaaggacggtcctacgacgggaccctggacgcgtnttacgtcgttacggcctccgacgtcctcgacgtaccgaacaacgtagtacctacgttacgacagtcgaggtacggacggtccgggacagggaggaccgaggtcgtacgtactactttacgtggtacctaggtccaacgttcgaaggtaccgaagggttacgtcgggtaccttaacgtttcgttacggtttaccggttacggtttccgggggcgggtaaccgggg

SEQ ID NO: 66820 - DNA, 742 bp, Homo sapiens
  misc_feature: GYAE6OF01DAO5T.49.73.G07.1.454.CMB.1.raw
  modified_base (145)..(145): a, c, t, g, unknown or other
  misc_feature (145)..(145): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
tcagagtcgagagacacgaccggtgctcgatttagctctacgctcagggcacgaccggtgctcgtttagagagagtgtgttgggtttgggggtgggtccagggaggcagaactctggggtgtctcaccatggcctggatcccctntacttctccccctctcactctctgcacagactctggacgcccttctatgagctcgacacacgccctacccgtcggtntctgtcgtcctcgaggacnggaccggccagttacnccgacctgcctgtgggaanatgactagttcgaaccgaaaagctaaattagtcgtactttacggtacggtaccagacgaaggacgccgaggacccgtacggtcccctgtaccgttagacttacttaaattttaagaaacgttcgttagggaacggtaccgggtacccttaaccgggaaccgggttaaccccgtggtaacggtcccgttaactttccgtacggtcgggtacccttacccgtaccgtaccgtacgaaccggtaacccgaacgtaaccgtaccgttaaccgtaacggtttaccgaacccgtagtaccggtagggtacggacgggttaccgggacgagggtaacggacgtacgtacgtacgtactttaacgttacgtgtcgtacgactactacggtaacgtaacgttacggttcgggaccgttcgttaaccgtttgttacggttaccggtttacgggtcccgggaacggggtaaaccggg

SEQ ID NO: 66821 - DNA, 732 bp, Homo sapiens
  misc_feature: GYAE6OF01C8EK7.49.73.G07.1.454.CMB.1.raw
  modified_base (249)..(249): a, c, t, g, unknown or other
  misc_feature (249)..(249): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttctccccctcctcactctctgcacagactctgacggcctctatgagctgacacagcccaccctcggtgtctgtcgtccctgacggacaggaccggccagttacnccacctgctcgtggagatgctagttcgacctaaagctaaatatcgtacgttacgtacggtaaccagtacgaacgaacgaccgacggacccgacggtcccccttgttccgttagacttacgtaatttaaactaaaagtacgttttagggaacggtacggggtcccgttacggaaccggtaccccgtaggtacggaccgttaacgtttccgtaccgtcggtcctaccgacgtaccgtaccgaacggtacccgaacctaaacgtacgtacccgtacggttaccgaccgtaacgtcgtaggtcgggtacggtaccgggagtaacgggacgggtacggaacgtcgtaaccgtaacgtttaacttacgttacggttaccgtaacgtacctacgtaaccgtaaagtaccggtaagggttacgttacggtaccctttaacgtttccgtacgggtttacgttaccggtccggggttagggtaaaacccgggg

SEQ ID NO: 66822 - DNA, 641 bp, Homo sapiens
  misc_feature: GYAE6OF01D7T0V.49.73.G07.1.454.CMB.1.raw
  modified_base (143)..(143): a, c, t, g, unknown or other
  misc_feature (143)..(143): n is a, c, g, or t
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (485)..(485): a, c, t, g, unknown or other
  misc_feature (485)..(485): n is a, c, g, or t
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
  modified_base (566)..(566): a, c, t, g, unknown or other
  misc_feature (566)..(566): n is a, c, g, or t
tcagagtcgagagacacgaccggtgctcgatttagctctacgctcagggcacgaccggtgctcgtttagagagagtgtggttgggtttgggggtgggtccaggaggcagaactctgggtgtctcaccatggcctggatccctntacttcctcccctctcactctctgcacagactctgacggcctcctatgacgctacgacacacgaccctacccgtggttntcgtggtctccgagaggacacggaccggcagtactcacctgtctcgtgaagtntcgctagtcgaacaaagactaatntcgtacgttacgcggtaaccagacgaacggacgccgaacggccacggtccctggttctacgtatacttaagttaacgtaacgtcgttaggacggtacgtctacggtaccgtacgtgacgtacgtacttcgtcgtagtcctacagtccacgtacgactaacgtacacgtaccgtcgtacgacgtacncggtacggtcggaccggtacggacgaagggacgacggtacgtagttaacgtacgttagttaccncggttanaccggttaanaccgtacggaacgtacgggagtttaggcgtaccttacgttcgacggttacgttacgggtcgggtacgaacccggg

SEQ ID NO: 66823 - DNA, 688 bp, Homo sapiens
  misc_feature: GYAE6OF01ESECY.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccacccgtggtgtctgtcgtcctcgaggacaggaccggccagtatccacctgctctggagatgcattcgaccaaagcaatatgtcttactggtaccagacagaacgccgacggccgacgccctgtcttgatctatttaataaagtactttgagtacgggcctacgacgggtacccctggacgtccggtatttccgtcgtacgggtccctacccgtacggtcctacgaacgaccgtaaaccgaacgtacgtaccgtacggttacgaaccctacgtcggtaaggtcgggacggttaccgggacgaacgggacgggaaccggacgggtaccgttacggttaacgttacgttaaccgttacggtaccgtacggttacctacgttaaccgtaacggtaacggtaacggtttagggtaccggttaccgttaccgtttaccggttacggttaccgggtttaaccggttccgggggacccggggtaaacccgggg

SEQ ID NO: 66824 - DNA, 246 bp, Homo sapiens
  misc_feature: GYAE6OF01A1BBY.49.73.G07.1.454.CMB.1.raw
  modified_base (209)..(246): a, c, t, g, unknown or other
  misc_feature (209)..(246): n is a, c, g, or t
tcagagtcgagagacacgaccggtgctcgatttagctctacgctcagggcacgaccggtgctcgatttagagagagtgtgttgggtttggggggaagaggaagactgacggtccccccaggagttcaggtgctgggcacagcggcctgggctgcctggtcaaggactacttcctctctcgactctgagcgggctggcaaggcgcatagnnnnnnnnnnnnnnnnnnnnnnnnnnnnnnnnnnnnnn

SEQ ID NO: 66825 - DNA, 595 bp, Homo sapiens
  misc_feature: GYAE6OF01BRZ7A.49.73.G07.1.454.CMB.1.raw
  modified_base (211)..(211): a, c, t, g, unknown or other
  misc_feature (211)..(211): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatggcctggatccctctacttctcccctctcactctctgcacagactctgagcctctatgagctgacacacgcccacccgtcggtntctgtcgtcctcgaggacagaccgcagtactcacctgctctgagatgcattgaccaaagacaattatcgtcttacgtcggtaccagacaagacgccaggccgacgtccctgtcttagactctattaagtaacgtctttagagacggtcctcgaacggtaccctggacgtcgtacttccgtacgtcgcctccgtacgcttacgacgtaccgaacaacgacgtacctacgttacgaccatacgagtacgggacgccgggacgacggtacggacggacggtactacgtaacttagtactacggtctacgtcacgtacgagtaacgtaggttacgtcggtaccttacgttcgttacggttacgttacggtggggtccgggtaaacggg

SEQ ID NO: 66826 - DNA, 630 bp, Homo sapiens
  misc_feature: GYAE6OF01ENDI2.49.73.G07.1.454.CMB.1.raw
  modified_base (288)..(288): a, c, t, g, unknown or other
  misc_feature (288)..(288): n is a, c, g, or t
  modified_base (384)..(384): a, c, t, g, unknown or other
  misc_feature (384)..(384): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgacggcctctatgagctgacacacgccacccgtcggtgtctgtcgtcctgaggacagaccggccagtactccacctgctcgtggagatgctattcgaccaaagacaaatntcgtacttacgtcggtaccagacagaacgccgacggccgacgtccctgtctagtatactaattaactaagtcttagagcggtctacggacggtccngacgtctactcgtcgtcgtcctaccgagtcctacgacgaccgaaacctaacgtacgtccgtacgttacaacctagtacgtacggtacgggaccggtaccgggagaacgggacggggaacggacggtacgttaacgtaacttaacgttacgtcgtactacggtacctaagtacgaaggtaactaggttaggtacgtccttagtttccggttacggttaccggtacggtccggggacggtaaaccggg

SEQ ID NO: 66827 - DNA, 583 bp, Homo sapiens
  misc_feature: GYAE6OF01DH4QU.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctcctatgagctgacacagccaccctcggtgtctgtgtcctcaggacagacggccagtactcacctgctcgtggagatgctattgaccaaagcaatatgcttacgtggtaccagcaggacgccgaggccacggccctgtcttagatactatttagtaaagtacgtttagaggacggtcctacgaccggtacccctgacgcgtattctcgtggcctcgagtctcgacgcgtaacaacgtacgtccacgttacacctacgtcgaggtggacggtccgggacgaagggacgggaacgtaggtaccgtagtaacctttagttacgtcgtactagtactagtcgtaacggtactaggtacgtgtacctacgttctacggttcgttacggtccggggaggtaaccggg

SEQ ID NO: 66828 - DNA, 535 bp, Homo sapiens
  misc_feature: GYAE6OF01BIPCG.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgccaaaagcaatatgcttactggtaccagcagaagccaggccaggcccctgtcttgatctatttaataaagtactttgagacgggcctcgacgggtacccctgacgcgtattcctcgtcggcctccacgctacagaccgaacaacagtcacgttcgaccatcgagtggacgtccgggacgaggaggacgaggcgtagacttattacgtgtctatcatcgagacaggtgtcgctaccgttcttcggtacgtacggttcgggcgggtaacggg

SEQ ID NO: 66829 - DNA, 712 bp, Homo sapiens
  misc_feature: GYAE6OF01DFREM.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctcggtgtctgtcgtcctcgaggacagaccggccagtatccacctgctcgtggagatgcattgaccaaagcaatatcgtcttacgtcggtaccagtacgagaacgccgaggccgacggcccctgtctgatactatttataaagtacgtttaggagtacgggtcctacgacgggtacccctggtacgacgtactttccgtacgtcgggccctccacgtccgtcgaacggtacgaaccgtaacctaacggttacctaaccggtttacgaacccgtacgtacggtaaggttacggggtacgggttacccggggacgaaacggggacggggaaccggacgggttaccgtacggtaacgttttaactttaccggttacggttacccgtaggttaccctagttaacccgtagggtaaccgttaagggttcgggtacggttaaccgttaccgttttccggttacggttccgggttttaacgggttcccgggggtaacgggggtaaacccgggg

SEQ ID NO: 66830 - DNA, 655 bp, Homo sapiens
  misc_feature: GYAE6OF01B48O5.49.73.G07.1.454.CMB.1.raw
  modified_base (215)..(215): a, c, t, g, unknown or other
  misc_feature (215)..(215): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacggcctcctatgagctgacacacgcccaccctcggtntctgtcgtcctgaggacacggaccggccagtactccaccttgcttacgtggagtatgctagttcgaaccaaagactaaattacttcgtacctttaacgtcggtaaccagacgaaggaacgccgacggccgaccggtcccctgttacctgactactaatttaagtaaacgttacttaggacggtacgggccctacggacggtacccgtaggacgacgtacttccgcgtcggtcctccgacgtctacgcgaccgaaactaacgtgtaccgtacgttacaccgtacgtcgaggtcggaccggtccgggacgaaggacggaccggagtaccgttaggtaaccttagtttacgtacgtacgtacgtacctacgtacgaagacgtaggtacgtcggtaccttacgttcggttcggtacgttacgggtccgggacgggtaacccggg

SEQ ID NO: 66831 - DNA, 714 bp, Homo sapiens
  misc_feature: GYAE6OF01EZ596.49.73.G07.1.454.CMB.1.raw
  modified_base (238)..(238): a, c, t, g, unknown or other
  misc_feature (238)..(238): n is a, c, g, or t
  modified_base (612)..(612): a, c, t, g, unknown or other
  misc_feature (612)..(612): n is a, c, g, or t
tcagagtcgagagacacgaccggtgctcgatttagctctacgctcagggcacgaccggtgctcgtttagagagagtgtgttgggtttgggggtggtccaggaggcagaactcgtgggtgtctcaccatggcctggatccctctacttcctccccctctcactctctgcacagtactctggacggcctcctagtgacgtctcgacactcgcccaccgtggtgtctgtctccagaggacncgaccggctagtctccacctgcctcgtaggacgtagtctactacgttaccgaaccaaaagtacctaaacgttatccggttactttaccggtaacggttaacccgacgaccgaaacgggaacgacccggaaccggggaccccgtaccgggtcccccgttagtttacccggttaatacgtttaacttaaacgttttaaaggtaaccgttagtttacgggaacggtaccgggtcccgtacgggtaacccgggtaccctagggacctacggtactttccgacgtcgtcctccgacgtcacgacgacgtaactacggctacgttacgtactacgcgtacggaggttcggaccgggacggagaacgggacggtaaccggngtacgtagttacttagtacgtcgtactacgtaccaacgtacgacgtagtacggtacgtacgtcgttacggttcgtacggtacggttacggaggaccggacgg

SEQ ID NO: 66832 - DNA, 619 bp, Homo sapiens
  misc_feature: GYAE6OF01EAR7T.49.73.G07.1.454.CMB.1.raw
  modified_base (266)..(266): a, c, t, g, unknown or other
  misc_feature (266)..(266): n is a, c, g, or t
  modified_base (523)..(523): a, c, t, g, unknown or other
  misc_feature (523)..(523): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacagactctgaggcctcctatgagctgaccacacgcccaccctcgggtgttctgtcgtccctcgaggacagaccggccagtatcacctgcctctgganatgctagttgaccgaaagctaatactcgtcttactcggtaccagacaagacgaccacggccacggcccttgtcttgatttacaaagtttactttaaaggactttagggacgtacggacgtacccaggggacccctggaagtcgtattcgtctcgactcctagactcgaacgacgaaccaacacgttacacgttagaccatcgagtcgggagtccgggacgaggaacggccgaggtacctagttaacttagttaccgnggttccaagttcaagtactaaggtaactaggtaacgtacggttccgtacgtttccgttagggttaccggtacgggtttccgggccggtaaacgggg

SEQ ID NO: 66833 - DNA, 665 bp, Homo sapiens
  misc_feature: GYAE6OF01AQNY7.49.73.G07.1.454.CMB.1.raw
  modified_base (188)..(188): a, c, t, g, unknown or other
  misc_feature (188)..(188): n is a, c, g, or t
  modified_base (215)..(215): a, c, t, g, unknown or other
  misc_feature (215)..(215): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgagcctcctangagctgaccacacgcccaccctcggtntcctgtcgtccctcgaggacaggaccggccagtatccacctgcctctggagatgccattgaccaaagctaatatgtacctttacgtcggtaaccacgacaagaacgccacgggccacggtccccttgtcttgactactatttaataaagtactttgacggtacgggtccctcggaacggtaccccgtagacgcgtacttctccgtgtcctccacgtcctactacgaccaacgaactacgtaccgtacgttaccgacctaagtccgtaggtcgggtacgtacccggggacacgggtaacgggaccggacgggtacgtacggaactttaacgttacgtacgtacgtacgtaccgtacgtaccaacggtaacgtacggttaacggtacggtaccttaaccgttttcgtacggttaaccgtttcgggttccccggggtagggttaaacccgggg

SEQ ID NO: 66834 - DNA, 697 bp, Homo sapiens
  misc_feature: GYAE6OF01BJEJD.49.73.G07.1.454.CMB.1.raw
  modified_base (218)..(218): a, c, t, g, unknown or other
  misc_feature (218)..(218): n is a, c, g, or t
tcagagtcgagagacacgaccggtgctcgatttagctctacgctcagggcacgaccggtgctcgtttagagagagtgtgttggggtttgggggtgggtccagggaggcagaactctggggtgtctcaccatggcctggatccctctacttctccccctcctcactctctgcacagactctgaggcctcctatgagctgacacagcccaccctcgggtntctggtcgtcctcgaggacaggaccggccagtactcacctgctctggagatgctagttcgaccaaagcaatatgtacttactcgggtaccagacagaacgccgaggcccacggtcccctgtcttgatactatttaaataaacgtactttaggaacggtgggtcccctacggaccggggtaacccctggacggtcggttactttccgttcgttcgggtccttacccggacgtccttaccgaacggaccgaaccaacgtacgtaccgtaccggttacgaacctagtacgaggtcgggtacgggtccgggacgaacggggaacggaacgggacggtacgtacggtaactttaacgttacgttggtaaccgtaggttacctagttaccggaagtaacggtacggtttacgggtcggtacgttacccgtttacgttcgggttaaccggtttacgggtttcccgggggagggggtaaacccgggg

SEQ ID NO: 66835 - DNA, 846 bp, Homo sapiens
  misc_feature: GYAE6OF01B7XMV.49.73.G07.1.454.CMB.1.raw
  modified_base (142)..(142): a, c, t, g, unknown or other
  misc_feature (142)..(142): n is a, c, g, or t
  modified_base (220)..(220): a, c, t, g, unknown or other
  misc_feature (220)..(220): n is a, c, g, or t
tcagagtcgagagacacgaccggtgctcgatttagctctacgctcagggcacgaccggtgctcgtttagagagagtgtggttgggtttgggggtggtccaggaggcagaactctgggtgtctcaccatggcctggatccctntacttcctccccctctcactctctgcacagactctgacggccctacctagtgagctagaccagacgcccaccgtggtntcgtgtacgtcctagaggacctaggaccggacctaagttcaccgtaccgttggaccttcgtggaagtattcggactacgttcgaaccgaaagactaaacgtacgttcggtacgtttaaccgtacggtaacccgagaccgtaaaggaccgaccggacggtacccgaccgggttacccctggttacctagtacttaactaacgtttaaagtaaacgttacgttaggacggtacggtaccctacgggaaccgtcccgtagtacgtacgtacttccgtccgtcgtacccgtaccgtacgtaccgtacgaaccggaacccgtaaacgtaacccggttaacgtaacccggttaacgggtttaccgaaacccgtaacggtacggtaaccggggttttaaccggggaacccgggtaccccggggttaagggaaaccggggaacggggtaaacccggtaacgggttaaccggtttaccgttaaacgttttaaccggttacgttacggttaccgttaacgggtaccctaaagttacccggaacgtttaccggaaagggtttccgttaacgtacccctttaggtttacccggttacgggttacggttttaacgggtcggggtaaccggtaaaccggg

SEQ ID NO: 66836 - DNA, 736 bp, Homo sapiens
  misc_feature: GYAE6OF01DCQLX.49.73.G07.1.454.CMB.1.raw
  modified_base (118)..(118): a, c, t, g, unknown or other
  misc_feature (118)..(118): n is a, c, g, or t
  modified_base (213)..(213): a, c, t, g, unknown or other
  misc_feature (213)..(213): n is a, c, g, or t
tcagagtcgagagacacgaccggtgctcgatttagctctacgctcagggcacgaccggtgctcgtttagagagagtgtgttgggttgggggtgggtccaggaggcagaactctgggtntctcacatggcctggatccctctacttcctcccctctcactctctgcacagtactctgacgcctctatgagctgacacacgcccacccgttggtntcgtggtgtccctacgaaggacacggacggtcctaagtatcccacctgccttcgaggagatgctaagttcgaccaaagactaaatacgtcgtacgtttacgtacggtaacccagacgaacggaacgaccgaacggtcccacggtccccgtgttccgttagacttaccttaaatttaaacgtaaaagttcgtttagaacggtacggtaccttacggacggaccccttagacgtcgtacttacctcgtacggtcctaccgacgtaccgtacgaacgacccgtaaaccaaacgtacgtaaccgtaccggttaccgaaacttacggtaccgtaaggtacgggacggtacccgggaaggtaacggacggacgtacgggacgttagtaaacctttaactacgtacgttacgtaacgttccgaaagttaccgaacggtaaacgtaggttaacgggttacggtaccctttaccggtttacggttacggtttacccggttaacgggttaccggggacccggggtaaaccggg

SEQ ID NO: 66837 - DNA, 689 bp, Homo sapiens
  misc_feature: GYAE6OF01CAR6Q.49.73.G07.1.454.CMB.1.raw
  modified_base (143)..(143): a, c, t, g, unknown or other
  misc_feature (143)..(143): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctntaccttctccccctcctcactctctgcacagactctgaggcctcctatgagctgaccacacgcccacccgtcggtgtcctgtcgtcctcgaggacaggaccggccagtactccacctgctcgtaggagatgactattcgaaccaaagctaatatcgtacttacgtcggtaccaggacaaggaacgccgacggaccgaccggtccccgttgttccttagtacttacttaaattttaagtaaaacgttcgtttaagggaacggtacgggtaccctacgggaacccgggtacccgtaggacgtacgttacttccgtacgtcgggtccctaccgtacggcctacgacgaccgaaacctaacgtacgtacctacggtaccgaacctagtacggagggtcgggacggtccgggacgaacgggaacgggacggacggtacgttaacgtaacgtttaacgttacgtcgtactacgtcaacgtaccgaacgtaggtaaggttcggcgtaccttacgtttcgtacgggttacgttacggtccgggaaggaaccggg

SEQ ID NO: 66838 - DNA, 765 bp, Homo sapiens
  misc_feature: GYAE6OF01C2GJX.49.73.G07.1.454.CMB.1.raw
  modified_base (220)..(220): a, c, t, g, unknown or other
  misc_feature (220)..(220): n is a, c, g, or t
tcagagtcgagagacacgaccggtgctcgatttagctctacgctcagggcacgaccggtgctcgtttagagagagtgtggttgggtttgggggtgggtccaggaggcagaactcgtgggtgtctcaccatggcctggatccctctacttcctccccctctcactctctgcacagactctgacggcctctatgagctagaccacacgtcccaccgtcggtntccgtgtcgtacctacgaaggacacggtaccggcctaagtactccacttgcttcgaggagagtcgactattacgaaccaaagactaatagtcgtaccgttacgtacggtaacccgagacaagaacgccgaaccggaccgaccggtccccgtgttaccgtagtacgttaacttaagttttaaacgtaaaacgttagtttaggaacggtacggtacccgtacggaaccgggtacccgtaggacgtaccgttacttccgtcggtacggtaccctaccgacggtaccgtacgaaccggtaccgtaaacccgtaacgtaaccggttaccgtaacccggttaaccggaaccttaacggtacgtacggggtacgggtaccggtacccgggacgaacgggaaccgggtacggaacgggttacctaacggttaaacttacgttaacgttcggtaacgtacgtaaccgtacgacggtaaacgtaccgtagggtacggtcgtacccttcgtttccgtagggttaccgtttacgggtccggggaacgggtaaccggg

SEQ ID NO: 66839 - DNA, 684 bp, Homo sapiens
  misc_feature: GYAE6OF01E183R.49.73.G07.1.454.CMB.1.raw
  modified_base (119)..(119): a, c, t, g, unknown or other
  misc_feature (119)..(119): n is a, c, g, or t
  modified_base (143)..(143): a, c, t, g, unknown or other
  misc_feature (143)..(143): n is a, c, g, or t
  modified_base (229)..(229): a, c, t, g, unknown or other
  misc_feature (229)..(229): n is a, c, g, or t
  modified_base (266)..(266): a, c, t, g, unknown or other
  misc_feature (266)..(266): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatcccctntacttctccccctctcactctctgcacagactctggacgcctctatgagctgacacagccctaccctcggtgtcctgtcgtccctnaggacaggaccggccagtactccactgcctcgtgganatgctattcgaccaaagacaatagtcgtcttacgtcggtaccagcgaacgaacgccgacggcccacggtcccctgtcttgactactaatttaacgtaaagttacgtttaggacggacggtacctcggaaccggtacccctaggacgtacgtacgtttccgtacgtcggtcctaccgtacgtccgtacgacggaacccgtaaacaaccggtacgttaccgtaccgtttacgaaccctagttaccggaggttcgggtaccggtacccgggagaacgggtaacgggaccggtacgggtacgttaccgtaacttaacgtttaccgtacgtacgtacggttacctaactacgacggtacgtaacggtcgtacggtaccttacgttcgttacggttacgtacggttccggggacggtaaccggg

SEQ ID NO: 66840 - DNA, 637 bp, Homo sapiens
  misc_feature: GYAE6OF01ECH7J.49.73.G07.1.454.CMB.1.raw
  modified_base (212)..(212): a, c, t, g, unknown or other
  misc_feature (212)..(212): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctggtntctgtcgtcctcaggacagaccggccagtatcacctgctctggagatgctattgaccaaaagcaatatgtacttacgtcggtaccagcaggaacgccgacggccacggtccccttgtcttgatctattaataaagtcttgagagggtcctacgacggtacccgtgacgcgtatttcctcgtacggtcctccgacgtccgtaccgaggacccgtaaacaaacgtacgtaccgtaaccggtttacgaaccctagtcgtaacgggttacgggtaccgggtcccggggacgtaacgggaaccgggacggacggtccgtagtaaccgttagttacgtcgtaactacgtacaatccgaagacgtagggtggtacggtacttaccgtttcgttacggttacggttacggttccggggacggtaaacccgggg

SEQ ID NO: 66841 - DNA, 795 bp, Homo sapiens
  misc_feature: GYAE6OF01AEGOX.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggccctctatgagctgacacagcccacccgtcggtgtctgtcgtcctcgaggacaggaccggccagtatccacctgctctggagatgcattcgacaaagacaattatgacttactggtaccagcaaggaacgaccacggcccgacgggcccctggttcggttcggtccggtcccagtcgatgacgacggtccggacccggtccctagacggggtaccttccccgtaggacggtaccggtttagttttccgtcgggtaccctacccggtaaacgttcccggtaacgggggaaaccccgaccggggtaccccctaaccccgttaccgggaacccccggtacggtaaccgggaccgggtaaccgggggtttaacggaaacccgggggcgggggtaaccggtaggggaacccgggtaccgtaacgttacgttacgttaccgttcggggtacggtacggggttagggttaacggggtagtttaagggtaaggttgggttcccgggttcccggggttttccggggtttcccgggggggtttcggttaccgggggttacggggtaaaccgggggtaccgttaaacgggtttccgggtaaccgggtttcggtttacccggggg

SEQ ID NO: 66842 - DNA, 716 bp, Homo sapiens
  misc_feature: GYAE6OF01AFHQL.49.73.G07.1.454.CMB.1.raw
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (640)..(640): a, c, t, g, unknown or other
  misc_feature (640)..(640): n is a, c, g, or t
  modified_base (672)..(672): a, c, t, g, unknown or other
  misc_feature (672)..(672): n is a, c, g, or t
tcagagtcgagagacacgaccggtgctcgatttagctctacgctcagggcacgaccggtgctcgtttagagagagtgtgttgggttggggtgggtccaggaggcagaactctgggtgtctcaccatggcctggatccctctacttcctccccctctcactctctgcacagacctctgacggtcccttacctagtgagtctagacctacagccctacccgtggtgtcctggtacgtccctagacggacacggaccggccagttacncctaccgtggcttacgnggaagtatcggactagttacggaccaaaggactaattcgtacggtacttacggtacggtaccaggacgaaggacgtccgacggaccgaccggtcccctggttacttagacttacgtaatttaacgaacgttatttcggaacgggtcggtacccttaccggtaacggaccccgttagaccgtaccgttacttcggttaccgacggtcctacccggagttacctacggtaacgaccgtaaacctaacgtacgttaccgtaaccgggttacacccgtataccggaggtacgggtcccggtacgggacgaacgggtaacggacgacgggttcaagtacgtttacgtaccgtgttaaccggtnttaccgagtagacccggtagtaggttccggtntaccgtcgttacgttggtacccgttagggtcgggccgtaacggg

SEQ ID NO: 66843 - DNA, 669 bp, Homo sapiens
  misc_feature: GYAE6OF01EJSC4.49.73.G07.1.454.CMB.1.raw
  modified_base (144)..(144): a, c, t, g, unknown or other
  misc_feature (144)..(144): n is a, c, g, or t
  modified_base (598)..(598): a, c, t, g, unknown or other
  misc_feature (598)..(598): n is a, c, g, or t
tcagagtcgagagacacgaccggtgctcgatttagctctacgctcagggcacgaccggtgctcgtttagagagagtgtgttggggtttgggggtgggtccagggaggcagaactctgggtgtctcaccatggcctggatccctntacttctccccctctcactctctgcacagactctgacggcctctatgagctagacacacgcccaccctggtgtctgtcgtcctgaggacaggaccggcctagtactcacctgctcgtggagtatgactagttcgaaccaaaagcaaattagtcgtacctttacgtcggtaaccaggacaaggacgaccgacggaccacggtcccttgtacttagtactacgtaatttaaagtaacgtacgtttaggaacggtacggtcccgtacggtaccgggtaccctaggacgtacgtacgtttcgtacggtccgtacctacgacgtacgtacgaacgtacccggaacaacgtacgtaccgtacgttacgaacctagtacgtacgggtcggtaccgggtaccggaggaacggacgggtacggacgggtactaggtaaccttagttacgtcggtactaggtanacgttacgaacgtacggtaggtcgtcgtacctagttcgacggttacgtccgggttcgggtacgggaaccgg

SEQ ID NO: 66844 - DNA, 658 bp, Homo sapiens
  misc_feature: GYAE6OF01CIY38.49.73.G07.1.454.CMB.1.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatggcctggatccctctacttctccccctctcactctctgcacagactctgacggcctcctatgacgctgacacacgccacccgtggtntctgtcgtcctcagggacaggaccggacctagtactccgacctgctcgtggaagntgactattcgaacaaacggactaatgtacgtactttacgtcggtaccagacgaacggaacgccgaacggccaccggtcccgtgtcttagacttacgtattttaaaacaaggtactttaggaacggtaccgggtccaccgaccgggtaacccgtgaacggtccgtattccgtcgcgtacctccgacgtcacgtagaccgaacaacgtacgtcgtacgttcgaacctactcgtacggtacgggaaccggtccgggacgaacgggaacggtacggaccgggtcttaacgtaaccttacgttacgttccgtaacgtacgtccaagtcgaacggtactaggtacggtcacgttaccgttagtccggttacggtagttcccgggaggtaaccggg

SEQ ID NO: 66845 - DNA, 593 bp, Homo sapiens
  misc_feature: GYAE6OF01EEF9W.49.73.G07.1.454.CMB.1.raw
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (539)..(539): a, c, t, g, unknown or other
  misc_feature (539)..(539): n is a, c, g, or t
  modified_base (558)..(558): a, c, t, g, unknown or other
  misc_feature (558)..(558): n is a, c, g, or t
  modified_base (567)..(567): a, c, t, g, unknown or other
  misc_feature (567)..(567): n is a, c, g, or t
  modified_base (583)..(583): a, c, t, g, unknown or other
  misc_feature (583)..(583): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggcctctatgagctgacacacgcccacccgtcggtgtctggtcgtcctcgaggacaggtaccggccagtactcacctgctcgtggagatcgactagttcgaccgaaagactaatagtcgtacctttacgtacggtacagacagacgccgacggccacgtccctgtctgtatctaatttaanaagtcgttagacgacggtcctacgacggtacccngacgcgtactcgtcgtcggcctcagctacgacgacaacaacgtgtaccgtaccgtcgtaaccctagtcgtaacgggtggacgtccgggacgaacggtaacggacggagtacgtagtaacttacgttactggtacacgtcgtaancgtacgagtaggtgacgtntcgtttcgngttacggtcgtcgggnggtaaccggg

SEQ ID NO: 66846 - DNA, 675 bp, Homo sapiens
  misc_feature: GYAE6OF01AVAMX.49.73.G07.1.454.CMB.1.raw
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (376)..(376): a, c, t, g, unknown or other
  misc_feature (376)..(376): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctctcactctctgcacagactctggacgcctctagnganctgaccacacgcccnccgtggtctctgtcgtcctacgagacgagaccggcagtactccactgctcgtaggagtactgctagttacgaacctaaagtactaaattacgtcgtacgtttaaccgtacggtaaccacgacgaaggaccggaccgaacggcccgtacggtccccgttgttaccgttanacttacttaattaaaacgtagtacgttacggacggtacggtccgtaacggaccgggtacccgtaggacgtccgttatccgttacgcggtctccgacgtcgtacgacgacgtacgacgtacgtacgtacgtacacgtacggacggtacggtacggtccgggtaccgggacgacgggaacggacgggtaccgtagttaccggtacttacggttccgtataccgtagtactacgacgacgtacgtaggtccgtacggttactacggttacgtgttaaccgtcgggtacgggacggtaccggg

SEQ ID NO: 66847 - DNA, 788 bp, Homo sapiens
  misc_feature: GYAE6OF01CMJQW.49.73.G07.1.454.CMB.1.raw
  modified_base (140)..(140): a, c, t, g, unknown or other
  misc_feature (140)..(140): n is a, c, g, or t
  modified_base (157)..(157): a, c, t, g, unknown or other
  misc_feature (157)..(157): n is a, c, g, or t
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (716)..(716): a, c, t, g, unknown or other
  misc_feature (716)..(716): n is a, c, g, or t
  modified_base (778)..(778): a, c, t, g, unknown or other
  misc_feature (778)..(778): n is a, c, g, or t
tcagagtcgagagacacgaccggtgctcgatttagctctacgctcagggcacgaccggtgctcgtttagagagagtgtgttggggttggggtggtccaggaggcagaactctgggtgtctcaccatggcctggatccctntacttcctccccctctnactctctgcacagtactctgacgcctctatgagctagaacncgacgtcccaccgtggtntctgtcgtacctgaggacacgacggctagtatccgaccttggaccttcgtagggatagtggactagttcggaaccaaaaggcctaaattactcgtacgtttacgtacggtaccagaccgtaaggaaccgccgttacggcccgtaaccggtccccgttgtcgttacgactttacgtaaacgttttaagtaaaacgttacgtttaggaacggtccgtcccgttaccggaaccgggttacccccgaggtacggtacgttaacgttttcccgacgttaccgggtcccttaccggaccgtaccgttaaccgacgggtaacccgttaaaccgaaacggttacgttacccggttaacccggtttaaccgaacccgtacgtttaccggaggggttaaccgggttccggggaccccgggggtaaggtaacggggtaaccgggggaaccggtaaacgggttccgttaacgggttaaaccttttacggttaacctcgttacgacggttacncgttaacgacgtaagacggtttacgccgtacgtcctttcgtaggttaccgttggtaccgggnggtaacccgg

SEQ ID NO: 66848 - DNA, 756 bp, Homo sapiens
  misc_feature: GYAE6OF01BK69O.49.73.G07.1.454.CMB.1.raw
tcagagtcgagagacacgaccggtgctcgatttagctctacgctcagggcacgaccggtgctcgtttagagagagtgtgttgggtttgggggtggtccaggaggcagaactcgtgggtgtctcaccatggcctggactccctctaccttcctccccctctcactctctgcacagactctgacgcctctagtgagctgacacacgccctaccgtggtctcgtgtcgtcctacgacggacacggaccggacctagttactccaccgtgtctacggtggaatgtcgactacgtacgaaccgtaaagacctaattagtacgtacctttaacggtacggtaaccaggaccgaaaggaccgaccgaccggacccgtacggtccccgttgttacttacgtaacttacttaaagtttaaacgtaaacgttacgtttacgggacggttacggacccgtaacgggaacccggtacccgtagtaccggtacgttactttccgtcggtaccgtacctacccgacggtacctaaccgacgtaacccaaaaccgttaaccggtacgtaacccgttacgtaaccgtaaccgtacgttaccggtacgggtaccggtaaccgggtaccggaaggtaacgggacgggtacggacggttacgtaagttaaccgttagttacgtacgtaccgttagtacctagtacggtaacgtaggtaggtaccgtacgtccgttacgttacgtacggttacggtacggtacgggacggtaaccg

SEQ ID NO: 66849 - DNA, 986 bp, Homo sapiens
  misc_feature: GYAE6OF01DQYTM.49.73.G07.1.454.CMB.1.raw
  modified_base (121)..(121): a, c, t, g, unknown or other
  misc_feature (121)..(121): n is a, c, g, or t
  modified_base (183)..(183): a, c, t, g, unknown or other
  misc_feature (183)..(183): n is a, c, g, or t
tcagagtcgagagacacgaccggtgctcgatttagctctacgctcagggcacgaccggtgctcgtttagagagagtgtggttggggttgggggtgggtccaggaggcagaactcgtgggtntctcaccagtggcctggactccctcttaccttcctccccctctcactctctgcacagactcnggacgcctctatggacgctcgaccacgtaccgccctcccgtggtgtctgttcgtccgtacgaggaccgacggaccggactaagtctcctaccgtcgtccttaggagggatagttacgacttacggtaccgaaaccaaaaggtacttaaacgttcgtaccgtttaaccgtttaacggtaccgggtaaccacgaaccggaaacggaccggacccggaaccggtcccgtaccggtccccgtttgttacgtaacgtaacttaacttaagttaaacgttaaaggttaccgttaggggacggtaacccggtcccgtaaaccggggaccggtacccgtacgggtacgttacgtttccgtttaccggtccggttaccggtcccgtaaccggtaccgttaacccgtaccgggtaaacccggaaaccgtaaacccgttaacgggtaacccggtttacccggttaaccgttaaacccggtaaccccggttaacgggtacccggggttacgggggttaaaccccggggggtacggggttaaccccggggaaacggggtaacggggggtaaacgggggtaaaccccggggtacgtttaacccggttttaaaccgggttaaccgtttttaacccgggttaacggttacgggtaaccggtttaaacccgttaaaccgtaccggttaaacgggtacgggtaaaccggtttaacggggttcccgtacggggtttaaaccctttcccggttcggggttttaaacccgggttccgggttttaaacccggggttcccggggggaaaccgggttaaacccgggg

SEQ ID NO: 66850 - DNA, 985 bp, Homo sapiens
  misc_feature: GYAE6OF01D52Y4.49.73.G07.1.454.CMB.1.raw
  modified_base (121)..(121): a, c, t, g, unknown or other
  misc_feature (121)..(121): n is a, c, g, or t
  modified_base (307)..(307): a, c, t, g, unknown or other
  misc_feature (307)..(307): n is a, c, g, or t
tcagagtcgagagacacgaccggtgctcgatttagctctacgctcagggcacgaccggtgctcgtttagagagagtgtggttggggtttgggggtggtccaggaggcagaactcgtgggtntctcaccatcggcctggactccctctaccttcctccccctctccactctcgtgcacacgtactcgtggacgtccttactatggacgtctagaaccactacgaccctacccggttcggtcgttcgttcggtaccgttcctacggacgacgacggaccgtcctaagtactccgaccttcgtcttaggnggactacgttcgacgtaagttaccgaaccgtaaaacgtctaaacgtttacgtacggtttaacccgtttaacgggtccggttaaaccggagaaccgaaacgggtaacccggccgtaacccgggtacccgtaacccggtcccgttttagttacccggtttaaacgtaccgtttttaaacgttaaaacggttttaaaaaccggtaaacggtttacgggttaacgggaaaccggggtaccccggtttacccgggtaaaccccgggttaaccggaccccggtttaaagggccgtttaaccggttttcccgttcggtttacccggttacgggtacccgtacccggttacggtaccgtaccgaaacggtaaccccgtaaaccggtaacgttaccgtaccccggttaagttaaccgtacgtaccgttcgggttaaaccgggggtaccgggtacgggttaacccggaagggtaaccggggtaccgggtacggtaccgggttaacgtttaacgtacccggttttaacgttacgttaccggtaccttaacggtaacccttacgttaaacgggtacccgggttaagttaacccggggtttgttaaacccgggttctttacccgggtttacggtttaaccgggtttaccccgggtttaagggggacccccgggttaagggtaaaccccggg

SEQ ID NO: 66851 - DNA, 552 bp, Homo sapiens
  misc_feature: GYAE6OF01BA10V.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccaggccacggcccctgtcttgatctatttataaagtactttgagaggcctcgacggacccctgacgcgtattcctcgtacggctccgacgctcgacgcgaacaacgagtaccacgttcgacctataccgaggtcggacggtccgggacgaggacgggacgaggcctagtaacttagttacgtgtacacgtcatcgagtacgaagtgtcggctacgtttcgtagttacggttacgttccggggcggtaacgggg

SEQ ID NO: 66852 - DNA, 780 bp, Homo sapiens
  misc_feature: GYAE6OF01BMI74.49.73.G07.1.454.CMB.1.raw
  modified_base (144)..(144): a, c, t, g, unknown or other
  misc_feature (144)..(144): n is a, c, g, or t
tcagagtcgagagacacgaccggtgctcgatttagctctacgctcagggcacgaccggtgctcgtttagagagagtgtggttggggtttgggggtgggtccaggaggcagaactctgggtgtctcaccatggcctggatccctntacttctccccctctcactctctgcacagactctgacggcctctatgagctgacacacgcccacccgtggtgtctgtcgtcctgaggacaggaccggccagtactccacctgctctggagatgctattcgaccaaagcaatagtcgtacttacgtacggtaccaggaccgaggaacgccgaacgggcccacgggtcccccttgttccgttacggtaacttctaacttttaaataaaacgttacgtttacggaacgggtacgggtccgtaccggaaccgggggtaccccctaggtacggtacgtactttccgttcggttcgggtccgttacccgtacggtccttacgacggtacccggaaacctaaacgtaccggtaccgtaccgggtttacgaacccctaagttaccgtacgggttcggggtacgggttaccccgggggaggaaacgggaacggggaaccggggtaacgggtaccggttagttaaacccgttaacgtttaccgttacggttaccgtacggtaacccttacgtaccgaaacggtacgtaaacggggtaggttaccgggtccgtttaaccgtttcggtttagggttacccggtttacggtttccggggggacgggttaaacccggggg

SEQ ID NO: 66853 - DNA, 842 bp, Homo sapiens
  misc_feature: GYAE6OF01DVTJC.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctcctcactctctgcacagactctgacggccttcctatgagctgacacacgcccacccgttcggtgtctggtcgtcctcgaaggacaggaccggccagtactccacctgctctggagatgctattcgaccaaagctaatgtcgtcctttacgtacggtaccaggactaacgaacggccgacggtcccgaaccggtcccccgttagttccgttacgacttacttaaactttttaaagtaaacgttacgtttagggaacggtaccggggtacccgttaaccggaaccggggttaccccctagggaacggttaccgttaacttttcccgtaccgttccgggtacccgttaccccgaggtccctaccggtaaccgaccgtaacccgaaacgttacggtaccttaaccgggttttaccgaaccctaacgttaccggtaagggttaccgggtaccggggttacccggggaacggtaacgggaacggggtaacccgggtagggttaccgttaacgttaacccgttaacgtttaccggttacgaccggttaacggttacccgaaagtttaccgaaacggtaaccggttaagggtttaacggggttcccggtaacctttaacccggttttaccggttacggtttaaccccgggttttaccggggttacccgggggaacccggggttaaaaccccgggg

SEQ ID NO: 66854 - DNA, 753 bp, Homo sapiens
  misc_feature: GYAE6OF01CJ8RX.49.73.G07.1.454.CMB.1.raw
  modified_base (142)..(142): a, c, t, g, unknown or other
  misc_feature (142)..(142): n is a, c, g, or t
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctcctcactctctgcacagactctgacggcctcctatgagctgacacncgccacccgtcggtgtctgtcgtcctcgaggacaggaccgccagtacnccaccgttgctcgtaggagatcgctattcgaaccaaacgactaatagtcgtacctttaacggtcggtaaccacgacgaaggaccggaccgtacggaccgacccggtaccccttggttaccttaggacttacttaaagttttaaagtaaaacgttacgtttacggaacgggtacggtacccgttacggaccgggtacccctggacgtcgtactttccgtacgtcggtccctaccgtacgtccgtacgacggacccaacgtaacgtacgtaccgtaccggttacaaccgttacgtacggtacgggtttacgggaccgggtacccgggtacgaacggggaacggaaccgggaacgggtaccgttacggttaaacctttagtttaccgttacggttaccgtacgttactaacgtaccgtacggtaaccggtaagggttaccggtacgtaccgttacgtttcgtaccgggtttacggtaccggggtttcgggccggggttaaacccggg

SEQ ID NO: 66855 - DNA, 652 bp, Homo sapiens
  misc_feature: GYAE6OF01CLXZX.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacggcctctatgagctgacacagcccacccgtggtgtctgtcgtcctcgaggacaggccggcctagtactccaccttgctcgtggagatgctattacgaccaaagctaatgtcgtacttacgtcggtaccagacgaagaacgccgacggccgaccggtcccctgtcttgtacttactaatttaaacgtaaacgtacgtttaggaacggtacgggtcctacggaaccggtacccctggacgtacgttacttcgtcgtcggccttccgagtcctacgacgacccgtaaacaacgtacgtaccgtaacggttacgtaacctaagtcgtagggtacgggacgggtccgggacgaacggaacggacggtacggtctacgtacttacgttacgtcgtcacgtactacgtacgacgtaacgtaggttacgtcgtaccttacgttcgtacggttacggttacggtcgggaacgggtaaccggg

SEQ ID NO: 66856 - DNA, 187 bp, Homo sapiens
  misc_feature: GYAE6OF01BYRSC.49.73.G07.1.454.CMB.1.raw
  modified_base (179)..(187): a, c, t, g, unknown or other
  misc_feature (179)..(187): n is a, c, g, or t
tcagagtcgagagacacgaccggtgctcgatttagctctacgctcagggtagctctacgctcagggcacgaccggtgctcgatttagtcacgcgagaaagggaaaggggctggccctgacgtgtttctgttcccgccctcctctctctcgactctgagcgggctggcaaggcgcatagnnnnnnnnn

SEQ ID NO: 66857 - DNA, 166 bp, Homo sapiens
  misc_feature: GYAE6OF01DDU47.49.73.G07.1.454.CMB.1.raw
  modified_base (163)..(166): a, c, t, g, unknown or other
  misc_feature (163)..(166): n is a, c, g, or t
tcagagtcgagagacacgaccggtgctcgatttagctctacgctcagggcacgaccggtgctcgatttagtcacgcgagaaagggaaagggggctggccctgacgtgtttctgttcccaccctcctctctctcgactctgagcgggctggcaaggcgcatagnnnn

SEQ ID NO: 66858 - DNA, 166 bp, Homo sapiens
  misc_feature: GYAE6OF01CYATU.49.73.G07.1.454.CMB.1.raw
  modified_base (164)..(166): a, c, t, g, unknown or other
  misc_feature (164)..(166): n is a, c, g, or t
tcagagtcgagagacacgaccggtgctcgatttagctctacgctcagggcacgaccggtgctcgatttagtcacgcgagaaagggaaagggggctggccctgacgtgtttctgttccccgccctcctctctctcgactctgagcgggctggcaaggcgcatagnnn

SEQ ID NO: 66859 - DNA, 690 bp, Homo sapiens
  misc_feature: GYAE6OF01E36HO.49.73.G07.1.454.CMB.1.raw
  modified_base (120)..(120): a, c, t, g, unknown or other
  misc_feature (120)..(120): n is a, c, g, or t
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (677)..(677): a, c, t, g, unknown or other
  misc_feature (677)..(677): n is a, c, g, or t
tcagagtcgagagacacgaccggtgctcgatttagctctacgctcagggcacgaccggtgctcgtttagagagagtgtggttgggtttgggggtgggtccaggaggcagaactctgggtntctcaccatggcctggatccctctacttctcccctctcactctctgcacagactctgacgcctctangagctgacacngcccacctcggtntctgtgtcctnaggacaggacggccagtacncaccgtgctcgtggagtagtcgactatcgaccaaaaggccaaatctacgtacttacgtacggtaccagacgaagaccgaccgacggcctacggtcccctgttctagtacttattaatttaacgtaaacgtacgtttaggaaccggtaccggtacccgtaccggaccgggtaccccttagggacggtccgttaacttccgtccgtaccgtacccttaccgacgtccgtacgaacgacccgtaaactaaccggtactacccgtaacggttcaaaccgttacaccggtaagtcggggaccgttacgggacgtaagggaacgtcggacgtcgttataacgttacgttagacgttcacggtacctaacgtcgaactacggaacggtttcgtccgggtacttaccggttcgttaccggttaccggttacggttaccggggngggtaaacccggg

SEQ ID NO: 66860 - DNA, 918 bp, Homo sapiens
  misc_feature: GYAE6OF01BR6YY.49.73.G07.1.454.CMB.1.raw
  modified_base (119)..(119): a, c, t, g, unknown or other
  misc_feature (119)..(119): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
tcagagtcgagagacacgaccggtgctcgatttagctctacgctcagggcacgaccggtgctcgtttagagagagtgtggttgggtttggggtggtccaggaggcagaactcgtgggtntctcaccatggcctggactccctctacttcctccccctctcactctctgcacagctcgtgacgcctctagtgagctagaccacacgccctaccgtggtctcgtgtcgtccctagaacggacacggtaccggctagtcaccnctgctgaggatntgatagtcgaaccaagactaatgtcgtaccgtttacggcgaacagacgaaaggacgaccggaccgacccgtaccggtcccttggtacttaagtactttaacgttaaagttttaaaaagtaacggttacgtttacggaaaggggccccgttaccccgtaaccggtaaccccggggtacttaacgggcgtttaacccgttacgttcgtaaccggtccgtacccgttacgtacccgttacgtaaccccggaaacgtaaccggtaaaccctaacgtaaccgggtttaaccgtaaccgttaaacccggaccttaaaaccggttacgggttaacggggttacccggggaacccgggttaaccgggaacgggtaacccgggggaaacggaacggggtttaaccccgggttacgaaaccgggtttttaacccgttaacccggtttacgtaacccgggttaccgttaaaccggtaacgttttaaaaccgggacccgggtttttaaaaccggaaaccgggtttaaaccggtttaaccgggtaaaccccgggtttacgttttttaaaacccgggttccggtttaaaacccggggtttttaccgggggtaacccgggtttaaaccccggggggaaccgggttaaaaacccccgggggg

SEQ ID NO: 66861 - DNA, 666 bp, Homo sapiens
  misc_feature: GYAE6OF01CTY06.49.73.G07.1.454.CMB.1.raw
  modified_base (118)..(118): a, c, t, g, unknown or other
  misc_feature (118)..(118): n is a, c, g, or t
  modified_base (176)..(176): a, c, t, g, unknown or other
  misc_feature (176)..(176): n is a, c, g, or t
  modified_base (547)..(547): a, c, t, g, unknown or other
  misc_feature (547)..(547): n is a, c, g, or t
  modified_base (594)..(594): a, c, t, g, unknown or other
  misc_feature (594)..(594): n is a, c, g, or t
tcagagtcgagagacacgaccggtgctcgatttagctctacgctcagggcacgaccggtgctcgtttagagagagtgtggttgggttgggggtggtccaggaggcagaactctgggtntctcaccagtggcctggactcccttctaccttccctccccctctacactctctgacanacgactcgagaccgtcctactagtgacgcacgaccaccgaccgtccctacccggttcgttcgtcgtcgttccgtccgtacgaacggacgacggaccgtactagtacctaccgtcgtcgtctcggagtagtcgtgacttaacgacgaaaccaagtactaagttcgtacgttacgtacggtaccgaagcgaacgaacgacgccgaccgccgtcccgtaccgttgtacgtattaacgtattaattaaagtacttaggtacgacggaccgtacgaccgtaccggtacctagcgttactgttcgacgtccgtacacgtcgctacgacgacgtacgaacgtacgtacctacgacgtactagtcgtacggacgacggnggtacgaaggacggacgagtacgtatacgtatcgtagtactacgtanagtacgacggtagtacggttcacgttcgttacgttacggtacgtgggtaaccgggtcggtaacgggtaaccg

SEQ ID NO: 66862 - DNA, 182 bp, Homo sapiens
  misc_feature: GYAE6OF01AR2Y0.49.73.G07.1.454.CMB.1.raw
  modified_base (178)..(182): a, c, t, g, unknown or other
  misc_feature (178)..(182): n is a, c, g, or t
tcagagtcgagagacacgaccggtgctcgatttagctctacgctcagggtagctctacgctcagggcacgaccggtgctcgatttagtcacgcgagaaagggaaggggctggccctgacgtgtttctgttcccaccctcctctctctcgactctgagcgggctggcaaggcgcatagnnnnn

SEQ ID NO: 66863 - DNA, 860 bp, Homo sapiens
  misc_feature: GYAE6OF01BYEDW.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctctcactctctgcacagactctgacggcctctatgagctcgaccacacgccctacccgtcggttgtcgttgttccgtccctacgaacggaccaacggaccggacctaagttacctaccgtaccgtcgtaccttcggtaggagtagtcgtactacgttaccgaaccgaaaacggtactaattacgtacgttaccgtttaacgttacgggtaaccaacgggaccgaaaggacccggaccggtaaccgggtacccgtacccgggtaccccgtttggtttaccgttagtaaacgtttaacttaaagttttaaacgttaaaacggttacggtttaaggggaaccggtaccgggtcccgtaaccgggtaacccgggtaccccggtaggtaacggttccggtttaacgtttcccgttcggtccggtcccgtaccggtaccgtacgtaccgaccggaacccgtaaacgtaaccggtacgttacccgtacgtaacgtaccgtacgtaaccgggtaggtacggggtacgggtaccggaggaacgggacgggtacggtacggtaccgtaacggttaacttacgtacggtaccgttaagtcgtaccgtaaacgtccggaaacggttaggtaaaccgggttcggaccgtttccgttaaccggttttcggttacccgggtttaaggtcccggggttacggggtaaaccggggtaaccggg

SEQ ID NO: 66864 - DNA, 762 bp, Homo sapiens
  misc_feature: GYAE6OF01AM8J6.49.73.G07.1.454.CMB.1.raw
  modified_base (119)..(119): a, c, t, g, unknown or other
  misc_feature (119)..(119): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttctccccctcctcactctctgcacagactctgacgcctctatgagctgacacacgccaccgtggtgtctgtcgtcctcgaggacagaccggcctagtactcacctgcctcgtaggagtatcgactacttacggaaccaaacgactaaattacgttacgtactttaccgtcgggtaaccacggaccgaaaggaccgacccggtacggaccccgaccgggtccccctttaggttacccttacggtaacttaccttaaattttaaacgtaaaacggttacgtttagggaacgggtacggtacccgtacgggaccgggtaccccgtaggacgtacgttcttaccgtccgtcggacctcgacgtcctcgacgtaccgaaactaaccgtagtacccgtacgttacgaccttacgtacgtacggttcgggacggtcccgggaacggagggaaccgggacgtaacgggtaccttacggttaaccttacgttacgtaccggttacgtacggttaccaacgttacggtaaccggtaagttacgggttcggtaccggtacgtttccgtttaaccgggttacggtttaccggtttacgggttacccggggaccgggttaaacccgggg

SEQ ID NO: 66865 - DNA, 586 bp, Homo sapiens
  misc_feature: GYAE6OF01BNYN0.49.73.G07.1.454.CMB.1.raw
  modified_base (211)..(211): a, c, t, g, unknown or other
  misc_feature (211)..(211): n is a, c, g, or t
  modified_base (471)..(471): a, c, t, g, unknown or other
  misc_feature (471)..(471): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctctatgagctgacacagcccaccctggtntctgtcgtcctgaggacaggaccggccagtactcacctgctctggagatgctattcgaccaaagacaatatgtcttacgtcggtaccagcaagacgccaggccacggccctgtctgactcaatttataagtacttgagcggcctacgacggaccctggacgtcgtacttcttcgtcggtcctaccgagccgtacgacgtacccgaaacaaccgtagtaccgtacgttacgaacctacgtcgaggtcgggacggtccgggngaacggacgggacgaggtctacggtacttagttactgtaccagtacagtaccgaggtacgtaggtacgtcggtactcgttacgtcggttacgttacgttccggggcgggaaccgg

SEQ ID NO: 66866 - DNA, 725 bp, Homo sapiens
  misc_feature: GYAE6OF01CZ768.49.73.G07.1.454.CMB.1.raw
  modified_base (274)..(274): a, c, t, g, unknown or other
  misc_feature (274)..(274): n is a, c, g, or t
tcagagtcgagagacacgaccggtgctcgatttagctctacgctcagggcacgaccggtgctcgtttagagagagtgtgttgggttgggggtgggtccaggaggcagaactcgtgggtgtctcaccatggcctggatccctctacttcctccccctcctcactctctgcacagactctgacggcctctatgagctgacacagtccaccctcgctgcagtcgtcccaggacaacgcagactcactgctgtgagatgctagttcgaacaaaaagtntatgtcttagtacgtacatacgagtacgtcgacggcccgtacggccctagtacgtcggacctagtactagcggtaacgaacccaaacccgaacccgtaccccggtaccgggtaacccttacccgaagtacgtctttaccgtccgttacggtcccgtacgttagggtttaacggaccgtacggtccggtacccctacccgtagtacgtacgtacggacggggtccgggaccgtagggtaggaggtaggttacgggacggttagtttacgttaaccgttaatttaccggttactaaccgtaaagtaccgttaactaacgtttaaccgttaaaccgtttccgacggtttaacggggtaggggtttcccgggttaggggacgggtaaacccgggaccgttaacggcggtttaaccccgggaaccgtttccggaacggtccgaacccggtacccgg

SEQ ID NO: 66867 - DNA, 805 bp, Homo sapiens
  misc_feature: GYAE6OF01AOPQV.49.73.G07.1.454.CMB.1.raw
  modified_base (119)..(119): a, c, t, g, unknown or other
  misc_feature (119)..(119): n is a, c, g, or t
  modified_base (215)..(215): a, c, t, g, unknown or other
  misc_feature (215)..(215): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttcctcccctctcactctctgcacagactctgacgcctctatgagctagacacacgccctaccgtcggtntctgtcgtcctagaggacacggaccggacctagtacctaccaccgtggtaccgtcgtaggagtagtacgtacttaacgttcgaaccgtaaacgtactaaagtttacgttacgtacgtttacccgttacggtaacccgacggaaccgaacggaaccggacccggaaccgggaccccgtcccggtttacccccgttacgggttttaccttaacgggttaacctttaaccgtttaaagttttaaaacgtaaaaccggtttaacgttttaacggggaaccgggtaccggggttaccccgttaaccgggtaaccccggggtaacccccgtagggaaccgttaccggttaacgtttcccggtcggtaccggtcctacggtaccgtccgttaaccgacggaacctaaccgtacgacgttaccgtaacgtaccgtacacgtacgacgggtacggtcggacccgggaggtacgacgggaggacggtctaacgtcgttactacggtctacgactacgtagtaacgacgtacggaggttacgccggtacttaccggttcgttacggttaaccggtttcggtaacggggacgggtaacccgg

SEQ ID NO: 66868 - DNA, 851 bp, Homo sapiens
  misc_feature: GYAE6OF01DY342.49.73.G07.1.454.CMB.1.raw
  modified_base (143)..(143): a, c, t, g, unknown or other
  misc_feature (143)..(143): n is a, c, g, or t
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
tcagagtcgagagacacgaccggtgctcgatttagctctacgctcagggcacgaccggtgctcgtttagagagagtgtggttgggtttgggggtgggtccaggaggcagaactctgggtgtctcaccatggcctggatccctntaccttcctccccctctcactctctcgcacagactcgtgacgcctcctagtgagctcgaacacgcnccctaccgttcggtcgtctgttcgtcctacgaacggacacggaccggacctaagtactccaccgtgacctcgtagganatcgataacgttcgaacaaagactaatgtacgttaccttacgacggtaccagacgacgaacgaccgacgaccgacgtcccttagtcgtagacttacttaagttaacgtaaacgttcgttaggacggtacggtacctacggtaacccgggtaccgtaggtaccgtacgttaccgtttccgtcggacccggtccgtacccgtacggtccgtaaccgaacggtaacccgtaaacgtaaccggtacccgttaaccggtaacccgggttactaaacccggttaacgttaccgggtaacgggggttaacggtacccgggtaacccggggaacgtaacgggggtaaaccgggtaaccggtaccgggttaacgtttaacggtttaaacccgttaaccggtttacggttaaccggttaaccgtaacgttaccgtaaacgggtaaccgttaaacgggtaacggtttaacggggttacggttacccgtttaacctttaccccgggtttaggtttacccggggtttaaccggtttaaccgggggttccccggggaaaacgggggttaaaccccggg

SEQ ID NO: 66869 - DNA, 759 bp, Homo sapiens
  misc_feature: GYAE6OF01ESZT2.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctctcactctctgacacagactcgtgacggtcctctatgacgtctacgaccacgacgccctaccgttggtcttcgttagtcgttccagacggaccgacggaccggacagtactccaccgtgctcgtaggagtactcgactacgttacgaaccaagtaactaacgttcgtacgttaccgttacgtaccggaaccgaggtaaccgaaggaaccgccggtaaccggcccgtaaccggtccccgttagtttcgtaacgtacttaactttaacgtttaaaacggtacttaccgggttaggaaacgggtcccggtaccctaaaccgggaccggttacccgtaggtaccgttagttacccgtttcggtacccggtaccggttacctacccggtaacggtacccgtaacggtaaccgaacccgtaaaccgtacgttaccgttacgtacgtaaccgtaccgtcgtacggtacggtacggtaccggaggacgtacgggaacggtacggtcgtataacggtataacgttacgtcgtctaacgtcaacggtgaccgtaagtacgtcgtaccgtacgttacgttacggttcgtacggttcgggtcggcggtaaaccggg

SEQ ID NO: 66870 - DNA, 632 bp, Homo sapiens
  misc_feature: GYAE6OF01A6ULQ.49.73.G07.1.454.CMB.1.raw
  modified_base (215)..(215): a, c, t, g, unknown or other
  misc_feature (215)..(215): n is a, c, g, or t
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
tcagagtcgagagacacgaccggtgctcgatttagctctacgctcagggcacggaccggtgctcgtttagagagagtgtgttgggtttgggggtgggtccaggaggccagaactctgggtgtctcaccatggcctggatccctctacttctccccctctcactctctgcacagactctgacgcctcctatgagctgacacacgccaccctcggtntctgtcgtcctacagggacacggaccggccaagttactcctacctgtcctctgggagattcgctagttcgaccaaagcaagtntcgtcttaagtcggtaaccagcaanacgccgacggcctacggcccctagtcctgatctatttaacaaagttccgttagacggtacgggtcctacgacgggtacccctggacgcgtactttcgtacgtcgggacctcgacgtcctaccgacgtaccgtaacgaacgtcgttaccaccgtttacgaaccgattaccggaaggtccgggaagtcccgggaagtcgggaagggtaccgaacggtcttagtaacctttaacgttcgcgtaccagttaccagtacgacacgtagtaccggtgaccttgtcgttaggtctacgggtccggtcggaaccggg

SEQ ID NO: 66871 - DNA, 718 bp, Homo sapiens
  misc_feature: GYAE6OF01D566A.49.73.G07.1.454.CMB.1.raw
  modified_base (142)..(142): a, c, t, g, unknown or other
  misc_feature (142)..(142): n is a, c, g, or t
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntaccttctccccctctcactctctgcacagactctgagcctctatgagctgacacgacgcccacccgttcggtnttctggtcgtcctgaggacnggtaccggctagtactccaccgtgccttcgaggaagtactcgactacgtttacggaaccaaaagtccaaattagtcgttaccgttacgtacggtaaccagacgaaggaccgtccgacggcccgtaccgtcccttgtccttagacttacgtaatttaacgaagttcgttaggacggtacgtcctacggacggtaccctaggctacgtacttcgtcgtacggaccctccgtacgccgttacgacgtaaccgtaactaaacggtcgtaccgtacggttacaaccgtagtaccggtagggtccggtaacgggcccgggtaagacgggtaaccgggacgtacgggttaccttaacgtaacgtttacttaccgttacggtaacctacgtcggtaactaggtaaccgaacggtttaaggttccgggacgttacctttaaccggttcgttacgggttacggtaaccgggtcgggaacccgggtaaaccgg

SEQ ID NO: 66872 - DNA, 730 bp, Homo sapiens
  misc_feature: GYAE6OF01EDWBU.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggactccctctacttcctcccctctcactctctgcacagactctgacggcctctatgacgctcgacacacgcccaccgtcggtcgttctgtcgtcctagacggaacgagaccggcctagtctccgacctgctcgtaggagtagtcgactacgttacgaaccaaagtacctaaattctcgttacgtttacggacggtaaccagaccgaacggaaccggccacggtccctacccgtcccgtggttactagtacttaacttaatttaacgtaaagtcgttaggaggtaccggtacgtaccggaccggtcccgtagaccggtacctacgttctccggtcgtacctaccgacgtccgtacgaccggacgtaaacgtaccgtacgttacctaccggtaccgtaaccgtacgtacgtaccggggtacggtaccggtcccgggaagaacggggaacggtaccggtagggttaaccgtcgtttaaacgtaccgttagtacgttaacgtcgtttaacgacgttaacgacggttaggaacggtttgacccgttcgtttacgttcggttacggttccggttaacggggtccggggaacggtaaccgggg

SEQ ID NO: 66873 - DNA, 853 bp, Homo sapiens
  misc_feature: GYAE6OF01CHIBY.49.73.G07.1.454.CMB.1.raw
  modified_base (115)..(115): a, c, t, g, unknown or other
  misc_feature (115)..(115): n is a, c, g, or t
  modified_base (785)..(785): a, c, t, g, unknown or other
  misc_feature (785)..(785): n is a, c, g, or t
tcagagtcgagagacacgaccggtgctcgatttagctctacgctcagggcacgaccggtgctcgtttagagagagtgtgttgggttggggtggtccaggagcagactcgtgggtntctcaccagtcgcctggactccctctaccttctccccctctcactctctagcacagtactctagcgtcctctatgacgtcagacaacgcgcccgtacccgtggtctctggtcgtcctagaggaccgaacggaccggtcctaagttctacctaccgtcgtcttacggtacggtaagtaccgtagaccgttacgtttaccgaaaccgtaaaccgtaagttaaacttcgtaccggttaacccttttaacggttaccggtaaaacccgcggtaaacggaaaccggttaaccggaccccggaaccgggtacccccgtaaccccggggtttccccgttaggttttacgttacgggtttaaacctaaccgttttaaacggtttaaaaccgttaaacggttttaccgttaacggggaaccgggttaaaccgttccccgggaaccgggtaaccccggttaacccggttaggaacggttaacccggtttaattcccggtagttacccgcccgttaccgacgttacgtaaccgacgaccgtaacctaacgtacgttacgtaccgttaacgaccttaacgtacggtaacgggtccgtaaccgggaccgggtaacggaacggacgggacgtaaacggtcgtaaggttacctttacgttaccgtacgtactacgtacctaacgnggtaaccgagttacggtagtccgaccgttcgtacgttaggtcccggtaacgtcggtaacgggaacccg

SEQ ID NO: 66874 - DNA, 611 bp, Homo sapiens
  misc_feature: GYAE6OF01BOKC8.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcgaggacagaccggccagtatcacctgctctggagatgcattgaccaaagcaatatgcttacgtggtaccagcagaacgccaggccacggtcccctgtcttgacttactatttaataaagtactttaggacggacgggtccctacgaacgggtaccctgacgcgtattctcgtcggctccgagcctcacgccgaaacaacagtaccgtacgttcgaaccagtacgacggtggtacggtccgggacgagggaacgggacggacgggtactagtaactttacgttacgtaggttaccgaagttccgatacgaacgtacgaagggttacgtacgggaccttacgtttacgttaggttaccggtttacggttccggggagggtaaacccggg

SEQ ID NO: 66875 - DNA, 716 bp, Homo sapiens
  misc_feature: GYAE6OF01BKGDA.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtcgtcctcgaggacaggacggccagtactcacctgctcgtaggatagtgactagttcgaccaaagactaatactcgtaccttacgtacggtaaccagaccaaggtaaccgccgacgggaccctaccgggtcccccttggttacgttagtaaccttacttaaacgttttaaacgtaaacggttacgttttaacgggaacggggtaccggtaccccgtaccgggtaacccgggtaacccccggttggacgtaccgttacgtttaccgttacggtccggtaccgtacccgtaggtccctacgacggacccgaacctaacgtacgtccgacggttacaccgtatcgtaacggtcggtaccggtaccgggagacgggaacggacggtacggtagttaaccgtactttacggtaccttagtacgtacggtacacgtacgtaacgtagtaaggtacggtcgtacttaccgtttctacggttagttccggtcgggaacgggtaccgg

SEQ ID NO: 66876 - DNA, 692 bp, Homo sapiens
  misc_feature: GYAE6OF01AFMDW.49.73.G07.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttctccccctctcactctctgcacagactctgaggcctcctatgagctgacacacgcccacccgtggtntctgtcgtcctnaggacagcgccagtacnccacctgctcgtgganagtcgacagttcgaccaaagctaattatcgtacttacgtcggtaccagacagacgcgacggccacggtcccctgttcgttagacttacgtaattttaacgtaaacgttacgttaggaacggacgggtaccctacgggtacggtaccccgtggtaaccgtcgttacgttccgttcgtacggtccctaccgacgtcctacgacgtaccgaacgtaaccgacgtacctacggttacgaacctacgtacgtacgggtacgggtacggtccgggaacgtaacgggaacgggaccggtagggttaccgtacggttactttaacgttacggtacgttaccgagttacctagaaccgtacggaacgttaggtacggttacgtccgttaccgtttcggttaacggttacggtttacgggtacggggaccggggttaaaccggg

SEQ ID NO: 66877 - DNA, 884 bp, Homo sapiens
  misc_feature: GYAE6OF01B8NNA.49.73.G07.1.454.CMB.1.raw
  modified_base (119)..(119): a, c, t, g, unknown or other
  misc_feature (119)..(119): n is a, c, g, or t
  modified_base (142)..(142): a, c, t, g, unknown or other
  misc_feature (142)..(142): n is a, c, g, or t
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctntacttcctccccctcctcactctctgcacagactctgaggcctcctatgagctgacacacgcccacccgtggtntctgtcgtcctgagacacgacggccagtacncacctgtctcgtggagagtnactacttacgaccgaaagactaatatacgtactttagttacggtaaccgtagcgtaacggaaccggtcccgggaccgtaccggtaccccgttggttcgggtttggtagtagttacgttaaagtaaacgtaacgaacgtaggtacggacggtaccccgtacggtaacgggtaccgtacccggtacggtacggtacggttacgttttaccgttaccggtttaccgggtcccgttaacccgggtaaccggggtttaccggaaacggggtaaacccggtaaccgggttaaccaaaccgtttaaccggtttacgggaaccccgttaacgttaacccggtaacgggttacgggtaaccgggttacccggtaaacggggaccggtaaacggggtaaccggggtaacgggtaacgggttaaccgggttaaccggttaaaccgttttaacgttttaacgtttaaaccggttaactaaaaccggttaacccgaaaaccgtaaaccgtaaacccgttaaacccttaagggttttaaccggtttaaaccgtttaacggtttaaccgtttaccggtttaaaccggtaaccggttaaccggtaacccgttaaacccgggttaaaccccggg

SEQ ID NO: 66878 - DNA, 690 bp, Homo sapiens
  misc_feature: GYAE6OF01A56R9.49.73.G07.1.454.CMB.1.raw
  modified_base (119)..(119): a, c, t, g, unknown or other
  misc_feature (119)..(119): n is a, c, g, or t
  modified_base (214)..(214): a, c, t, g, unknown or other
  misc_feature (214)..(214): n is a, c, g, or t
  modified_base (623)..(623): a, c, t, g, unknown or other
  misc_feature (623)..(623): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttcctccccctctcactctctgcacagactctgacggcctctatgagctgacacacgcccaccgtggtntctgtacgtcctagacggacacggaccggctagtactccaccgttgctcggtaggatagtcgctagttaccgaaccgaaagtactaagttacgtcgtacctttacggtacggtaaccaggaaccgtaacggaaccggtcccgaacgggacccctacccgggtcccctttagtccgttaagtaacttaccttaaagttttaaacgtaaaacggttcgttaaggggacggtaccggtccccgtaacggacccgggtaccctggtacgtcgtacttccgtcgtcggtcctacgacgtctacgacgtacgaacacgtacgtacctacgtcgacctagcgtacgggtcgcggtaccggagaacggcggtaacgcgtactagttacgttacgtcgtacgtcgtacgtacacgtanaccggtagtaggtcggtccgtacttacgtccggttacgttacgtacgggtcgggacggtaacccggg

SEQ ID NO: 66879 - DNA, 771 bp, Homo sapiens
  misc_feature: GYAE6OF01EJVO1.49.73.G07.1.454.CMB.1.raw
  modified_base (219)..(219): a, c, t, g, unknown or other
  misc_feature (219)..(219): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggccctcctatgagtctgaccacgacgccctacccgtggtntccttggttcgtccctcgaaggacaggaccggccagtactccaccgtgcctcgtaggagtatcgtctacgtacgaaccgaaacgtactaacgttacgtacgttaccgtttacggtaccggtaccgacggaccgaacggaaccggaccggaccggacccggtaccccggtccccgtttacgttacgttacgttaacttaacgttaaagttttaaacgttaaacggttacggttacggaacggtaccgggtacccgtaccgggtacccggtacccgtacggtacgtacgttacgttccgtcggtccgtccgtaccgtaccgtaccgtaccgacgaccgtaaccgtaacgtacgtaccgtacgtaccgtaaccgtacgtacggtacgggtacgggtacgggtaccgggacggaacggtacgggacggtacgtacgtacgttacgttaacgttacgtacgtacgtacgtacgtacgtacgtaacggtacgtaggtacgtacggtaccgttacgttacgttacggttacggttacgggtccgggaccgggtaaccgg

SEQ ID NO: 66880 - DNA, 702 bp, Homo sapiens
  misc_feature: GYAE6OF01C3MYX.49.73.G07.1.454.CMB.1.raw
  modified_base (142)..(142): a, c, t, g, unknown or other
  misc_feature (142)..(142): n is a, c, g, or t
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
tcagagtcgagagacacgaccggtgctcgatttagctctacgctcagggcacgaccggtgctcgtttagagagagtgtggttgggttgggggtgggtccaggaggcagaactctgggtgtctcaccatggcctggatccctntaccttcctccccctcctcactctctgcacagactctgacgcctcctagtgagctgacacacgcccacccgtggtctctggtccgtcctacgacggacacggaccgctagtactccacctgtctcgtggaactntgtactagtacaaccgaaagactaattancgttaaccttacgtacgtaccagacgaacggaacgccgacggccgaccggtccctgtacttgaacttctaaatttaagtaaacgttcgttagggaacgtccgggtacccacgggacccgggtaccctggtacggtaccttacgtttcccgtacgtacggtccctaacgcgttaccgacgtacccggactaaaccgtaacgtaccgtacgtaccgttacacccgtatacggtacgggttacggacccggggtacgacgggaacgggacggaacgggtcgttactagtacggtttaacttggcggtactacggactaggtaaccgaggtagttaacggcggttaccgtaagtcttttacgacgggttaccggttcgggcccggggtaacggtaaaccgg

SEQ ID NO: 66881 - DNA, 735 bp, Homo sapiens
  misc_feature: GYAE6OF01AK9S9.49.73.G07.1.454.CMB.1.raw
  modified_base (126)..(126): a, c, t, g, unknown or other
  misc_feature (126)..(126): n is a, c, g, or t
  modified_base (141)..(141): a, c, t, g, unknown or other
  misc_feature (141)..(141): n is a, c, g, or t
  modified_base (217)..(217): a, c, t, g, unknown or other
  misc_feature (217)..(217): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
  modified_base (668)..(668): a, c, t, g, unknown or other
  misc_feature (668)..(668): n is a, c, g, or t
tcagagtcgagagacacgaccggtgctcgatttagctctacgctcaggcacgaccggtgctcgtttagagagagtgtgttgggttggggtgggtccgaggaggcagaactcgtgggtgtctcacgntggcctgagtccctntacttcctccccgtcctcaccttctcgtgacacgagaccttctgacgtcccttcctaagtcgagctgaacctaccncgccctaacccgttggnttctgtcgtcctanaggaacngacccggctatacaccnctgccttgngagtatcgactatacgacaagtacaatatgtactacgtacgtacagtcgaagtacgccacggtaccnccggtacctcgtacgtnactacttacgttaataaaccgtnttacgggacggtaaccgtacgtacccggtaaccgggtaaccctagggtaaccgtacgttacgttaccgttcggtttaccggtaccttaaccggccggttaccttaccgggaaccggttaacgaaacccttacggaaccgtttaaccaacccggtttaacgaccggtaaaccctcgggtaacggtaccgggtaacgtaccggaaccggtacgggaacggacggtacgtacgtacttaacgtaacctttagccgtaacgtaggacctaaaggtacgacgtanaaggttacgggaccctaaggttaccctttaagacggttacggtttaacgtccgggaacggtaaccgg

SEQ ID NO: 66882 - DNA, 717 bp, Homo sapiens
  misc_feature: GYAE6OF01AVOQK.49.73.G07.1.454.CMB.1.raw
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccacccgtggtntctgtgtccctgaggacaggaccggcctagtancacctgcctgtggagatgctattcgaaccgaaagtacaaatgtcgtaccgttacgtacggtaccagacgaaggaacgccgacggccgacgtccccgttgttcgtagacttacttaatttaaacgtaaacgttacgtttaggaacggtacgggtacccgtaccgtaaccggggtaaccccgtaggacgtccggtactttaccgtcgttcggacccgtcccgtacgggtcctacggacggaacccgaaactaaaccgtacggttaacccgtacggttaccgaacctcgtacgggaggttacgggtaccggtaccgggacgtaacgggacggaccggacgggttaccgtacgttaacgttaacgttaccggttcgtacgtacgttacgtactacgtaacgtacggtaaggtacggttccggtatttccgttacggttcggtacggtttacgggtacggggagggtaaaccggg

SEQ ID NO: 66883 - DNA, 887 bp, Homo sapiens
  misc_feature: GYAE6OF01AZ852.49.73.G07.1.454.CMB.1.raw
  modified_base (141)..(141): a, c, t, g, unknown or other
  misc_feature (141)..(141): n is a, c, g, or t
  modified_base (209)..(209): a, c, t, g, unknown or other
  misc_feature (209)..(209): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatggcctggatccctntacttctcccctctcactctctgcacagactctgagcctctatgagctgacacagcccacccgtggtntctgtcgtcctgaggacagccggccagtactcctaccgtgccttcgtggacgtatcggtctagtttacggaacctaaaggtacctaaagttacgttacggttaccttttaaccggttaccggttaaacccgaggaccgaaacggtaaccgacccggaccgggtacccgtaaccgggtcccccgttggtttacccgtttaggtaacctttacgttaaatttttaaaacgtaaaacggtttacgttttaaggggaacgggtaccgggtacccgttaacgggacccggggttaaccccgtagggaaccggttccggtttaaccgtttccggttacggttccgggtccccttaaccggaccgttaccgtaaccggaccgtaacccggtaaactaaccggttacggttaaccgttaaccgttaccgtaaccgtaacgttacggtaccggggtaccgggttacgggtacccgggtaacggaaggggaaacccgggtccgggtaacgggttacccgtttaacggttaaacctttaccggtttacggtcgttaaccggtacgttaaccgtacggtaaccggtaacggttaaccggtacgggttaacggttcccggttactttacccgggtttacgttacggggttaaccgttacgggttaccgggggttaaccggggaaacccggg

SEQ ID NO: 66884 - DNA, 643 bp, Homo sapiens
  misc_feature: GYAE6OF01BZK48.49.73.G07.1.454.CMB.1.raw
  modified_base (142)..(142): a, c, t, g, unknown or other
  misc_feature (142)..(142): n is a, c, g, or t
  modified_base (216)..(216): a, c, t, g, unknown or other
  misc_feature (216)..(216): n is a, c, g, or t
  modified_base (291)..(291): a, c, t, g, unknown or other
  misc_feature (291)..(291): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgacggcctcctatgagctgacacacgcccacccgtcggtntctgtcgtcctcgaggacaggccggccagtactccacctgctctggagtatgctagttcgaccaaagactaattntcgcttacgtggtaccagacaagacgccaggccacggtcccctgttctcgtatacttaatttaagtaaacgtacgttttaggacggtacgggtcctacggacgggccctaggacgcgtacttcgtcgtcggctccgacgtctacgacgacgaacgaacgtacgtactacggtacaacctagtcgtacggtcggacggtaccgggacgaacggacgggtaacggcggtacgttacgtacgttaagttactacggtctaacgtcaacgtacgacggtaacgtaggttcggttacggtaccttaccgtttacggtacgtttaccggttaacggttccggggacgggtaaaccggg

SEQ ID NO: 66885 - DNA, 625 bp, Homo sapiens
  misc_feature: GYAE6OF01BDGO7.49.73.G07.1.454.CMB.1.raw
  modified_base (215)..(215): a, c, t, g, unknown or other
  misc_feature (215)..(215): n is a, c, g, or t
  modified_base (266)..(266): a, c, t, g, unknown or other
  misc_feature (266)..(266): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgacggcctcctatgagctgacacacgcccacccgtcggtntctgtcgtcctcgaggacacgaccggccaagtactcaccttgctcgtgganatgcagttcgaccaaagcaatatcgacttacgtggtaccagcaagaagccgaaggccacgccctgtctgatctaattaataaagtacttagaggacggtcctacgaaccgggaccctaggacgtacgtagttctacgtcgctaccgacgtctacacgactaacgaactacgtactacgttacgactacgtacgtacgtagggtacccgtcgggacgaacgggaacgggtacggacgggtcgtacggttaacttaacgttacgtacgtaacgtacgttagtaacctacgaacgtaacgtaggtacggtcgtacttacgtttacgtcgttacggttacggtccggggacgggtaaaccggg

SEQ ID NO: 66886 - DNA, 705 bp, Homo sapiens
  misc_feature: GYAE6OF01BXEUN.49.73.G07.1.454.CMB.1.raw
  modified_base (140)..(140): a, c, t, g, unknown or other
  misc_feature (140)..(140): n is a, c, g, or t
tcagagtcgagagacacgaccggtgctcgatttagctctacgctcagggcacgaccggtgctcgtttagagagagtgtgttgggttgggggtggtccaggaggcagaactctgggtgtctcaccatggcctggatccctntacttctcccctctcactctctgcacagactctgacgcctctatgagctgacacacgccctaccgtggtgtctgtcgtcctcaggaccagaccggctagtactccacctgctcgtggagtatcgactattacgacctaaagacaaatactacgtacttacgtacggtaacctacgcgaaacgaacggaccgacgggacccgtacggtacccctgttaccttagtacgttacttaatttaaagtaaaacgttaccgtttaggaacggtaccgggtacccgtaccggtaaccggtacccgtacggtaaccgacgttacgttccgtacgtccggtcctccgtacgtaccacggacgtaacccgaaacaaccgtaacgtaccgtaacgttaccgaaccgtacgtacgtacgggtaacgggaccgggtacccggaacggacgggaacgggacggaacgggtacgtaacgttaacttagttacgttagtcctacgtactaccgtacgacggtagtaacggtcgtacgtcttaccgttcgtagtacggttacggttcggggacggtaacggg

SEQ ID NO: 66887 - DNA, 820 bp, Homo sapiens
  misc_feature: GYAE6OF01DUUIC.49.73.G07.1.454.CMB.1.raw
  modified_base (95)..(95): a, c, t, g, unknown or other
  misc_feature (95)..(95): n is a, c, g, or t
  modified_base (123)..(123): a, c, t, g, unknown or other
  misc_feature (123)..(123): n is a, c, g, or t
  modified_base (271)..(271): a, c, t, g, unknown or other
  misc_feature (271)..(271): n is a, c, g, or t
  modified_base (407)..(407): a, c, t, g, unknown or other
  misc_feature (407)..(407): n is a, c, g, or t
  modified_base (737)..(737): a, c, t, g, unknown or other
  misc_feature (737)..(737): n is a, c, g, or t
tcagagtcgagagacacgaccggtgctcgatttagctctacgctcagggcacgaccggtgctcgtttagagagagtggtggttgggtttgggggngggtaccaggaggcagaactcgtgggtntctcaccatcggctggactccctcgttacttcctccccctctcgactcgtctgcacagtactcgtgacgtcctctagcgagtctacgacacgcgtacccgccgtggtctcgtgtcgtccagacgcacggacgcagtacctccacgttncgtcgtaggtacgagtacgtactagttacgaaccgtaaaagtcttaaacgtagttacgttaaccgttaacggttcggaaaccgacggaacggaaacgaaccggaccggtaccggaacccggtccggtcccggtttnttaccgttagtaacttacggtttaaaattaacgtaacgttacggtttacggaacggtacccggttacgaccggtaacccggttactacggtccgtacgttcgttacggttcgtaaccgtcccgtacgtaccgtaccgtacggaaaccgtaccgaaaccgttacgtacggtttacctaaccgggttactaccgtaagtacgggttaacgggccggggttaacggtaccgggaacgtaacgggtaaccgggtaacgtaccgggttaaacgttccgttaacggtttaacccgtagttacgtaaaccgggtacctacgttaaacgttaaccggngggttaaacccgaggttaaacgggttccggacttttaaccgttggtaaccggtttcgttaccgggacgggtaaggtacccggg

SEQ ID NO: 66888 - DNA, 684 bp, Homo sapiens
  misc_feature: GYAE6OF01AHC35.49.73.G07.1.454.CMB.1.raw
  modified_base (118)..(118): a, c, t, g, unknown or other
  misc_feature (118)..(118): n is a, c, g, or t
  modified_base (141)..(141): a, c, t, g, unknown or other
  misc_feature (141)..(141): n is a, c, g, or t
  modified_base (186)..(186): a, c, t, g, unknown or other
  misc_feature (186)..(186): n is a, c, g, or t
tcagagtcgagagacacgaccggtgctcgatttagctctacgctcagggcacgaccggtgctcgtttagagagagtgtgttgggtttgggggtggtccaggaggcagaactctgggtntctcaccatggcctggatccctntacttctcccctctcactctctgcacagactctgaggcctctagngagctgacacagccaccgtcggtgtcctgtcgtcctagaggacaggaccggccagtactcacctgcctctggagtatcgcattcgaccaaaagcaatatgtaccttacgtcggtaccagacaagacgaccgacggccgacggtcccctagtccttagactactaatttaactaaagtacgtttagacggtacgggtcccgtacgtaaccgggtaccccctaggaacggtccggtacgttaccggtacgtacgggtcccgttacgacgtaccttacggaacgtaacccgtaaacgaacgtaacgtaccgtaaccggttacgaaaccgtacgtaccgtagttacgggacggttaccgggaccgtaaggaacggtaacggacggtacgtacgtaacgttaacgtacgtagttccgacggttacaacgtacgaggtaacccgaggtacggtcgacgttaccgttacgttacggttccggtagttccgggtaggaaacccggg

SEQ ID NO: 66889 - DNA, 742 bp, Homo sapiens
  misc_feature: GYAE6OF01BV1FV.49.73.G07.1.454.CMB.1.raw
  modified_base (217)..(217): a, c, t, g, unknown or other
  misc_feature (217)..(217): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacagactctgaggcctcctatgagctagaccacacgcccacccgtggtntctgtcgtcctgaggacaggaccggccagtactccacctgctcgtggagatgctattcgaccaaagacaattactgtacctttacgtacggtacccaaggacaaggaacggacccgacgggcccgtaccgggtcccccttgttccgttacgtacttaccttaaattttaaacgtaaacgttacgttttaggacgggtaccgggtacccttacgggaccgggtacccccgtaggaccggttaccgttacgtttcccgttcggttccgggtacccgttaccccgacggtccccgttaccgtaaccggtacccgaaaaccgtaaccgtaacggttacccgtaaccgttagtaaaccctagtacgggtacggtacgggtacgggtacccgggaggaacgggacgggaccggaggtacctacgttaacttacgttcgtacgtacgtataccgtaataccgaagtacgtaggttcggtacgtaccttacgttcgttacggttacgttacggtcggggaccgggtaaccggg

SEQ ID NO: 66890 - DNA, 914 bp, Homo sapiens
  misc_feature: GYAE6OF01DN4IU.49.73.G07.1.454.CMB.1.raw
tcagagtcgagagacacgaccggtgctcgatttagctctacgctcagggcacgaccggtgctcgtttagagagagtgtgttgggttgggggtggtccaggaggcagaactcgtgggtgtctcaccatcggcctggatcccctctaccttcctccccctcctcactctctgcacagtacctctggacggtccctactatgacgctacgacacgacgacccctacccgtggttcgttcgtgtcgttccctacgaacggacacggaccggcctaagtctaccaccgttgccttcggaggacgtacgtcgtactacgttacgaaccgtaaaagtacctaaaagttacgtacggttactttaaccggtaaccggtaaccgaacggtaccgaaacggaaaccggacccgggaaccggtaccccggtaaccgggttcccctttaacggttcctttaacggtaacctttacttaaaagttttaacgtaaaacggtttacggttttacgggaacgggttaacccggggtccttaaccggggaacccgggtaccccgtagggtaacccgttaccggttaaccgttttccttaccgggttacggtcccgttaaccggacggttcctaaccgaaccggtacgtaaaaccgacgttaacggtaccgttaaccggttacgtaaccgtaacggttcggtaaccggggttcgggtaaccggggtacccgggagggtaaaacgggtcggggaaccgggtaccgggttaacgtaaccggtttaacgttaaccgtttaccggtacggtttaacggaaccgtttaccgtacggtaacctaacgggtaacgttaggtttaccggcgtaacccgtttaccgtttccgggttaacgttaccgggtttaaccgggtcgggggtacgggtaaaacccgg

SEQ ID NO: 66891 - DNA, 706 bp, Homo sapiens
  misc_feature: GYAE6OF01DIXDU.49.73.G07.1.454.CMB.1.raw
  modified_base (225)..(225): a, c, t, g, unknown or other
  misc_feature (225)..(225): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttctccccctcctcactctctgcacagactctgacggcctctatgagctgacacacgcccacccgtggtgtctgtcgtccncgagacagaccggtcagtctcactgctgtggagtatcgctattcgaccaagacaatatcgtactttacgtaggtaaccaggacaagtaccgccggacggccgaccggtcccctaggttcttacgtacttaacttaattttaacgtaaacgttacgtttaggaacggtacgggtaccccttaaccggaccgggtaaccccgtaggtaaccggtacgttaacgtttccttaccggtcggtaccctaccgacgtccgtaccgacgtaccgaacctaaacgtacgtacgtaccgttaacgaccgtacgtacgtacgggtcgggaaccggttcgggacgtaacgggacggaacggtgtacgtacgtaactttacgttacgtacgtactaacgtcctaacgtacgaaacggacgttaggttaccggtacggtaccttacgtttcggtacggtttacggtttacgggtccgggtagggtaaacccggg

SEQ ID NO: 66892 - DNA, 165 bp, Homo sapiens
  misc_feature: GYAE6OF01EX95P.49.73.G07.1.454.CMB.1.raw
  modified_base (163)..(165): a, c, t, g, unknown or other
  misc_feature (163)..(165): n is a, c, g, or t
tcagagtcgagagacacgaccggtgctcgatttagctctacgctcagggcacgaccggtgctcgatttagtcacgcgagaaagggaaagggggctggccctgacgtgtttctgttcccaccctcctctctctcgactctgagcgggctggcaaggcgcatagnnn

SEQ ID NO: 66893 - DNA, 866 bp, Homo sapiens
  misc_feature: GYAE6OF01BDTQG.49.73.G07.1.454.CMB.1.raw
tcagagtcgagagacacgaccggtgctcgatttagctctacgctcagggcacgaccggtgctcgtttagagagagtgtggttggggtttgggggtgggtccaggaggcagaactcgtgggtgtctcaccatggcctggactccctctaccttcctccccctctcactctctgaccacagacttcgtaggaccggtccctacctagtggacgtctacgaaccaccgaccgaccccctacccggttcgggttcgttccgttacggttccgttaccctacggaacgggaaccgaaccgggaccggtaccctaagttaccgtaccctaccgttgtccgttacggtaggaacgtacgtcgtactacgttacgaaacaaagtactaagttacgtcgttaccgttacggtacgaaccaggaacgaacggaacgccgaccggaccgtacccgtccctttgtacttagtactttaacttaagtttaaacggttaaagttacggttacgggaaccgggtacccgggtacccgtaacccgggaacccgggttcccgtaaggaccgttacgttactttcccggtacgggtcgtccccgtacgtaccggtcctacggaacgaacccggtaactaaaccgtccggttaaccgtacgtaccgtaactacggtacgggttacgggtcggggtaaccgggaccgggaacgggacggggtaccggaaggtccgggtaagttaaccgttacgtttaccgtacgtacggtaagaccttagaaccgttacggacggtaaccgggttaggttccggacgtttacccgttacggttacgggtttaccgggttaccgggttcggggtaaaccgggtacggggtaaacccg

SEQ ID NO: 66894 - DNA, 607 bp, Homo sapiens
  misc_feature: GYAE6OF01CPKVG.49.73.G07.1.454.CMB.1.raw
  modified_base (117)..(117): a, c, t, g, unknown or other
  misc_feature (117)..(117): n is a, c, g, or t
  modified_base (134)..(134): a, c, t, g, unknown or other
  misc_feature (134)..(134): n is a, c, g, or t
  modified_base (140)..(140): a, c, t, g, unknown or other
  misc_feature (140)..(140): n is a, c, g, or t
  modified_base (155)..(155): a, c, t, g, unknown or other
  misc_feature (155)..(155): n is a, c, g, or t
  modified_base (177)..(177): a, c, t, g, unknown or other
  misc_feature (177)..(177): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (405)..(405): a, c, t, g, unknown or other
  misc_feature (405)..(405): n is a, c, g, or t
  modified_base (427)..(427): a, c, t, g, unknown or other
  misc_feature (427)..(427): n is a, c, g, or t
  modified_base (466)..(466): a, c, t, g, unknown or other
  misc_feature (466)..(466): n is a, c, g, or t
  modified_base (499)..(499): a, c, t, g, unknown or other
  misc_feature (499)..(499): n is a, c, g, or t
  modified_base (543)..(543): a, c, t, g, unknown or other
  misc_feature (543)..(543): n is a, c, g, or t
tcagagtcgagagacacgaccggtgctcgatttagctctacgctcagggcacgaccggtgctcgtttagagagagtgtgttgggtttggggtggtccaggaggcagaactctgggtntctcaccatggcctggntccctntacttcctccccctnatcactctctgcacagtactcngacgtcctcctatgagctgacacacgccctacccgtggtgtctgtcgtcctagagacaggaccgcagtactcgctnctgagganatgctattcgaaccaaagtactaatacgtcgtacttaccgtaggaccagacgaagaaccgcacgggtccaaccgggtcccttggtcttagaattactaaatttaagtaaagtcgttaggaacgacggtcctaggacggtacccngacgctacttctgtacgtctcncgacgacacgacagtaacacgtacgtacttacgacctancgtacgggtagaccgggcgagaggacggtacgnggtacctgtaactaggttactacggtacataccagtaccgtaanaacggttagttaccgggtataccttacgtttacgttagttacgggtccggttggggaaaccggg

SEQ ID NO: 66895 - DNA, 776 bp, Homo sapiens
  misc_feature: GYAE6OF01BQGNE.49.73.G07.1.454.CMB.1.raw
  modified_base (119)..(119): a, c, t, g, unknown or other
  misc_feature (119)..(119): n is a, c, g, or t
tcagagtcgagagacacgaccggtgctcgatttagctctacgctcagggcacgaccggtgctcgtttagagagagtgtgttggggtttgggggtggtccaggaggcagaactctgggtntctcacatcggcctggatccctctacttcctccccctctcactctctgcacgagacttcgtgacgtcctctaagtgatctagaacacacggcccaccgtcggttcgtctgtcgtcctgaacggtacacggaccggctaagtctaccaccgttgccgttgtagggaatacgtcgacttaagttaccgaaaacctaaaaactaattcgtacgtaccctttaacgtaccggaacaaacgtcgaaacggtaccggaccgaaccgggtccgtaaccggttcccctttagggttaccgtttggtaaactttaaacgttttaaaagaaacggttctttacgggaacgtcccggtaccgtacggaacccggtacccttaggaccgttaccgttaactttcgacgtaccggtccctacggtacgtcccgtaacggaacggtaacctaacgtacgttaccgtaccgttaaccgaactacgtacgtacgggtacggacggtcccgaacggacggaaacgggagtccggtataacgggtacttaacggttacttcgtacgttaacggccgtacggaaacgaccgtaggaccgtaggtaggtactttacggtacggtacgttacggttacgggtacggaacccggggttaacgccggttacggtacccgg

SEQ ID NO: 66896 - DNA, 220 bp, Homo sapiens
  misc_feature: GYAE6OF01CXYGL.49.73.G07.1.454.CMB.1.raw
  modified_base (207)..(220): a, c, t, g, unknown or other
  misc_feature (207)..(220): n is a, c, g, or t
tcagagtcgagagacacgaccggtgctcgatttagctctacgctcagggcacgaccggtgctcgatttagagagagtgtgttgggtttgggggaagaggaagactgacggtccccccaggagttcaggtgctgggcacagcggcctgggctgcctggtcaaggactacttcctctctcgactctgagcggctggcaaggcgcatagnnnnnnnnnnnnnn

SEQ ID NO: 66897 - DNA, 807 bp, Homo sapiens
  misc_feature: GYAE6OF01BMGOA.49.73.G07.1.454.CMB.1.raw
  modified_base (216)..(216): a, c, t, g, unknown or other
  misc_feature (216)..(216): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatggcctggatccctctacttcctcccctcctcactctctgcacagactctggacggcctctagtgagctgacacacgcccacccgtggtntctgtcgtcctgacggacacggaccggaccagtactccaccgtgcctcgtaggagtatgactagtcgaaccaaacgacaaatagtacgtctttaacgtcggacctagacgaaggacggaccgacggtccgaccgtcccgtacgttcgttatacgttacttaatttaaacgtaaagtactttagggaacggtacccgggtccgtaccgggtaaccgggtaccccgtagggtacgtacgttacgtttcccggttaaccggttcgggtacccctaccgtaccggggtcctaaccggaccggaaacccgtaacctaaaccgggtaaccgttacccgtaaccgggtttaacccgaaacccgtacggtaaccggttagggtaccgggtaaccggggtcccggggaacgtaacgggggtaacgggtaaccggtacggggttaccgttacggttaaccctttaggtttaccgttcgggttaactacggtacttaccgacgtaacgggttaacgtaacgggttcgaccgggttaccttaccggttaggttaccgggttttaacgggtcccggggttaacgggtccgggggaaaacccggg

SEQ ID NO: 66898 - DNA, 754 bp, Homo sapiens
  misc_feature: GYAE6OF01EJEPD.49.73.G07.1.454.CMB.1.raw
tcagagtcgagagacacgaccggtgctcgatttagctctacgctcagggcacgaccggtgctcgtttagagagagtgtgttgggtttgggggtggtccaggaggcagaactctgggtgtctcaccatggcctggactccctctacttctccccctctcactctctgcacagactctgacgtcctcgtatgagctagacacgacgccctaccgtggtcttctcgtcgtccgtagacggtaacaacggaccggacctaagttaccgtcctaccgtgcctcggtggagtatcgactagttacgaaccgaaagctaaatgtacgtaccgtttagacggtacctaggacgaacgacgaccgcggacccgtacggccccttagttcgttacgacttaacgttaagtttaaagtaaacgttccgttaaggaaccggtaccgggtacctaccgggtaaccgggtaaccccttagggacgttaccgttagtttccctacggtacggtacccgtaccgtacgtccgtacgaaccggtactaaacgtaaccgtacgtaaccgttaaccggttaaccgaacctaacgttaccggtaaggttaccggtaaccgggtacgggaaccgaagggtaacgggacgtaacgggtacgtacgtaacgttaccgtacgttcgacgtacgttacgacgttacgaacgttaccgtaggtaccgtcgtaccgttacgttacgtaggttaccggtacggttcgggacgggtaaaccgg

SEQ ID NO: 66899 - DNA, 657 bp, Homo sapiens
  misc_feature: GYAE6OF01EBWLS.49.73.G07.1.454.CMB.1.raw
  modified_base (170)..(170): a, c, t, g, unknown or other
  misc_feature (170)..(170): n is a, c, g, or t
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (436)..(436): a, c, t, g, unknown or other
  misc_feature (436)..(436): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctctcactctctgcacngactctgaggcctcctatgagctgacactacgcccaccctcgggtntctgtcgtcctcgaggacagaccggccagttanccaccgtgctctggactagtgactagttgaccaaagtcctaatactcggtccttaacgtcgggtaccaggctaaggaacgcccgaagggtcccacgggtcccccttgggtaccttacgacgttacctaagttttaagtaaaacgttcgtttggaacggacgggtcccgtaacgccggggtaaccccnggtacgccggtaattcgtaccgtgggtaccctcgtaccgtctacgacggtacaccaacgtacgtcgaccgtttacgacctagccgaggtggtacggtcgggacgacggtacgacggagtacgtagtaccgttaatcgtcgtactagtcctagttaccgacgtaccggtagtttaggcgaacgttcttaccggttctacggtacgttcgggcgggtaaacgg

SEQ ID NO: 66900 - DNA, 726 bp, Homo sapiens
  misc_feature: GYAE6OF01EGRYG.49.73.G07.1.454.CMB.1.raw
  modified_base (119)..(119): a, c, t, g, unknown or other
  misc_feature (119)..(119): n is a, c, g, or t
  modified_base (144)..(144): a, c, t, g, unknown or other
  misc_feature (144)..(144): n is a, c, g, or t
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (488)..(488): a, c, t, g, unknown or other
  misc_feature (488)..(488): n is a, c, g, or t
  modified_base (580)..(580): a, c, t, g, unknown or other
  misc_feature (580)..(580): n is a, c, g, or t
tcagagtcgagagacacgaccggtgctcgatttagctctacgctcagggcacgaccggtgctcgtttagagagagtgtgttgggtttgggggtggtccaggaggcagaactctggggtntactcaccatcggcctggatccctntacttcctccccctctcactctcgtgcactagactctggacgcctactatgagctgaccanacgcctacctggtntctgtactcctgacggaacnggtaccggccaagtacgtcaaccgtgcttcgtaggaagtatgactagttacggaaccaaagtacgtaaattcgtacgtaccgttacgtacggtaaccgagaaccgaagaccgaccaaggccctaaccgggtccccttaggttaccttaggtaactacgttaaagtttaagtaaaacgttcgtttacgggaacgtaccgggtcctaacgggtaacccggtacctagggaacgtccgttaattcccgtacnccgggtactaccggacgtcctacgaacgtaccgaaactacgacgttacgtacgttacgaactgtacgtaagggtcgtaacggtcccgggaanaacgggaacggtacggacgtacgtagtaaccgttattacgtacgtacacggtacttaaacgcgtaacggtaacttaggtaacggtcgtaccttacgggtttaccgacgggtttacgtacgggttacgggaaccgggttaaaccggg

SEQ ID NO: 66901 - DNA, 625 bp, Homo sapiens
  misc_feature: GYAE6OF01DFUK7.49.73.G07.1.454.CMB.1.raw
  modified_base (117)..(117): a, c, t, g, unknown or other
  misc_feature (117)..(117): n is a, c, g, or t
  modified_base (141)..(141): a, c, t, g, unknown or other
  misc_feature (141)..(141): n is a, c, g, or t
  modified_base (256)..(256): a, c, t, g, unknown or other
  misc_feature (256)..(256): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagagtcgagagacacgaccggtgctcgatttagctctacgctcagggcacgaccggtgctcgtttagagagagtgtgttgggttgggggtggtccaggaggcagaactctgggtntctcaccatggcctggatcccctntaccttcctccccctcctcactctctgcacagactctgacggcctctatgagctgaccacacgcccacccgtggtagtctggtacgtcctagaggactaggaccggcctaagtcnccaccgtgcctcgtggagtatcgactagttacgaccaaagcctaaatatggtactttacggtacgtaaccagacgaagaacgccgacggccaccggtccctgtctagatactaagtttataacgtcttagaggcggctacgaccggtacccngacgacgtnttcgacgtcgaccttaccgagtcctacgaacgacaacaacgtacgtcctacgtaccaccagtcagggttacggacggtcccgagtaacgggcggaccgtagggctagtctttactacgtgtacccgagtacagtacggaagtaccgtagttacggtcggtaccctttagtccgttaggttcttaacgggtccgggaccgggtaaacgg

SEQ ID NO: 66902 - DNA, 815 bp, Homo sapiens
  misc_feature: GYAE6OF01E2T36.49.73.G07.1.454.CMB.1.raw
  modified_base (119)..(119): a, c, t, g, unknown or other
  misc_feature (119)..(119): n is a, c, g, or t
  modified_base (142)..(142): a, c, t, g, unknown or other
  misc_feature (142)..(142): n is a, c, g, or t
  modified_base (221)..(221): a, c, t, g, unknown or other
  misc_feature (221)..(221): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctntacttcctcccctctcactctctgcacagactctagacggcctcctagtgagctgacacgacgccctacccgttcggtntcgtggttcgtccctagacggaccacggaccggtcctaagtactccgaccgtgaccgtcgtggagtagtgtactagttacgaccgaaagtactaaattacttcgtacctttacgtacgggtaaccaggacgaaggaaccgccggaacgggcccgtaacccggtccccgttacgtttacgtttaacggtaacttaacgtttaaattttaaaacgtaaagtttaaccggtttagggaacggtaccgggtacccgtaccgggtaacccgggtaaccccgttaggtaaccggttaacggttaccgtttcccgtttacggtaccggggttaccctaacccgttacggtaccgttacggaacccggttaacgaaacccgttaacggtaaccgttaaccggttaaccggtacgtaacccgaagttaccgggttacgggtacggggtaaccgggacccgggaacggtaacgggaacgggaccgacggtacgttaacgtacgtttacgttaccgtgtaccgtatacgtacgtacgactaaggttagtcggtacgtactttacgtcggttacgttacggttacggtacggggccggtaaacggg

SEQ ID NO: 66903 - DNA, 914 bp, Homo sapiens
  misc_feature: GYAE6OF01B6C3P.49.73.G07.1.454.CMB.1.raw
  modified_base (117)..(117): a, c, t, g, unknown or other
  misc_feature (117)..(117): n is a, c, g, or t
  modified_base (140)..(140): a, c, t, g, unknown or other
  misc_feature (140)..(140): n is a, c, g, or t
  modified_base (197)..(197): a, c, t, g, unknown or other
  misc_feature (197)..(197): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
tcagagtcgagagacacgaccggtgctcgatttagctctacgctcagggcacgaccggtgctcgtttagagagagtgtgttgggttgggggtggtccaggaggcagaactctgggtntctcaccatggcctggatccctntaccttcctccccctctcactctctgcacagactctgacgcctctatgagctagacncacgcccaccgtcggtntctgtctcnaggacagaccgcagtacnccncgtgactcgtaggatagtacgactattcgaacctaaaagcttaatacgtacgtacgtttaccgtacgggtaaaccctagaaccgaacggaacggtccccggaaacggtaccccggaacccgggttcccccgttagttacccgtttacggtaactttaaccgtttaaatttttaaaacgtaaaaccgggtttacgtttacgggaaacggggttaccggggtaacccctttaaccggggaacccgggaaccccctttggggtaaaaccggtacccgtttacgttttaccccggtacgggtttaaccggtacccttacccggggaaacccgtttacggtaacgaaccgggtaaaccccgtaaaaccgaaacggttacccggttaaccgttaaccggggtttaacctaaaaccccgttaacggtttaacgggaaccggggtttaacgggggtaacccgggtaacccggggtaaacggaaaccggggtaacgggtaccgggtaacgggtacctttaacggtaaactttacggttaccgttacgtaaccggtaatcccggtaaaacgtcgtaaacggttaagggtaacgtacggtttacccgaaccggtttagtttaccgggtttaccggtttaacggtttaacccgggaccggggggtaaccggtaaacccgggg

SEQ ID NO: 66904 - DNA, 739 bp, Homo sapiens
  misc_feature: GYAE6OF01AZCJJ.49.73.G07.1.454.CMB.1.raw
  modified_base (116)..(116): a, c, t, g, unknown or other
  misc_feature (116)..(116): n is a, c, g, or t
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
  modified_base (528)..(528): a, c, t, g, unknown or other
  misc_feature (528)..(528): n is a, c, g, or t
  modified_base (601)..(601): a, c, t, g, unknown or other
  misc_feature (601)..(601): n is a, c, g, or t
tcagagtcgagagacacgaccggtgctcgatttagctctacgctcagggcacgaccggtgctcgtttagagagagtgtgttgggttgggggtggtccaggagcagaactctgggtntctcaccatggcctggactccctctacttcctcccctctcactctctgcanacgactctgacgcctctatgacgtctacgacacnccgtaccgacccgtggttctcgttgtaccgtcctacggaggtacgacggaccggtactaagtaccttccgaccgttcgccgtttggaacgggtaagtcttcggacttaagtaccgaaaccgaaagtactaaagttacgtccgtaaccggttaacgttacggaaccagtaccggtaaaacgacccgacccggtacggtacccgtacccggtcccgtttagtacgttacgtaacttaacgtttaaagttaaacgtaaacgttcgttagggaaccgtacggtaccacgggaccgtacccgtagacgtacgttcttcacggtctcgacgancgacgcgaaccaactacgacgttacgtaactacgtacacgtaggaaggtcgaccggtaccgaggacgggtaanacgggtctaacggtacttacggttaaccttatcggtacagttaacgagttaaaccggactaacgggtaacgttccggtaggtttaacccttcgttacggtacccgttaacggtcgggttaccgggaacgggttaacgg

SEQ ID NO: 66905 - DNA, 925 bp, Homo sapiens
  misc_feature: GYAE6OF01CKAMI.49.73.G07.1.454.CMB.1.raw
  modified_base (120)..(120): a, c, t, g, unknown or other
  misc_feature (120)..(120): n is a, c, g, or t
tcagagtcgagagacacgaccggtgctcgatttagctctacgctcagggcacgaccggtgctcgtttagagagagtgtggttggggttgggggtggtccaggaggcagaactcgtgggtntctcaccatggcctggactccctctaccttcctccccctctcactctctgcacagactcgtgacgtcctctagtgacgctacgaccaaccgaccggacccctacccggttcgggttcgtaccgttggtccgttaccgtacggaacggaaccgaacggaaccggtccctaaggttacctcccgtaaccgttcggccttacgggtaggggaattagtcggtaaccttaaggttaaccggaaaacctaaaggtaaccttaaagttcgttacggttaaccgtttaacggtacggtaaccaggaccgaaaggtaaccgcccggaacgtacccgtccgggttcccttagttacgtagtacttaacgtttaaagtttaaacggaaacgtttcggttaacgggaagggtaccccggtacccgtaaccgggtaaccgggtaccctttagggacgtttaacccgtttcgttcccggtaacgttccggacccgtttccgaaacggttcccaagaaccgtaacccgtaactaacggtacgttaaccgttaacgtcccgaacgttacggtacgggtaccgggtaccgggttaccgggtaaccgggaacggtaagggtaacccgggtaggtaaccggttaccgttaaacgttaacgttttaaccggtacgtacggttaaacccgtaagttaccggttaccaaaaccggggttcgtaaaggtacgggttaccgggttaccgtaaacccggttttacgggttccggtttaaagggtacccggggtttaaacggggttacgggggacccgggttaaacccgg

SEQ ID NO: 66906 - DNA, 773 bp, Homo sapiens
  misc_feature: GYAE6OF01DZYD6.49.73.G07.1.454.CMB.1.raw
  modified_base (144)..(144): a, c, t, g, unknown or other
  misc_feature (144)..(144): n is a, c, g, or t
  modified_base (261)..(261): a, c, t, g, unknown or other
  misc_feature (261)..(261): n is a, c, g, or t
  modified_base (652)..(652): a, c, t, g, unknown or other
  misc_feature (652)..(652): n is a, c, g, or t
  modified_base (723)..(723): a, c, t, g, unknown or other
  misc_feature (723)..(723): n is a, c, g, or t
tcagagtcgagagacacgaccggtgctcgatttagctctacgctcagggcacgaccggtgctcgtttagagagagtgtgttggggtttgggggtgggtccaggaggcagaactctgggtgtctcaccatggcctggatcccctntacttcctccccctctcacttctctgcacagactctggacggccctctatgagctgacacacgcccacccgttggtgttctgtcgtccctagaaggaccaggaccggcctagttacnccgtaccgtgccgtcgtaggacgtatacggacttacgttacggaaccaaagacaattagtacggttaccttaacgtcgtaacccgaggtacgaacggaacgacccggacgggaccccgtaccggtcccccttggttacttacgtactttaacttaagttttaaacttaaaggttaccgtttagggaacggtacgggtaccgtaccggtaacccgggtaccctaggacgtacgttactttcgtacgtccggtaccttaccgacggttaccctacgaaccgaccgtaacgtaaacgtaccggttacccgttaccggttacgtaacccgttagtaccggtaagggtacggtaaccggggtcccggaagtaaccgggacgggtacgtaacgggtntacggtaaaccttagttacgttacggtactacggtacttagtaccggtaacgtaagtaggtttcgaacgtntttaccgttaccgtggtttaccgttacgggttcggggaacgggtaccggg

SEQ ID NO: 66907 - DNA, 649 bp, Homo sapiens
  misc_feature: GYAE6OF01CHJPH.49.73.G07.1.454.CMB.1.raw
  modified_base (142)..(142): a, c, t, g, unknown or other
  misc_feature (142)..(142): n is a, c, g, or t
  modified_base (639)..(639): a, c, t, g, unknown or other
  misc_feature (639)..(639): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctctatgagctgacacagcccacccgtggtgtctgtcgtcctacgaggacaggacggcctagtactcacttgctcgtggatatgctattacggaccaaagacaattagtggtactttacgtacggtaccacgacaaggaacgacccgacgggacccgaccgggtccccttgttccttggacttacttaagttttaaagtaaacgttacgttttaggaaggtacgggtcctaccgaacgggtacccctaggacgtcgtacgttccgtcgtcggtcctacgacgtcctacgacgtaccgaacaacgtacgtacgtacgtacgtaccgagtacgaggttacggacggtaccgggacgagggtaaaccggacggacggtccgtacgtaacgttacttacgtgtactagtctatacgaggtactaggtacgtcgacttactcgttacgtcgtttacgtcgggnggtaaccggg

SEQ ID NO: 66908 - DNA, 712 bp, Homo sapiens
  misc_feature: GYAE6OF01BJQ01.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccacccgtggtgtctgtcgtcctcgaggacaggaccggccagtactcacctgctcgtggagatgactattcgaccaaagactaatatcgtacttacgtacggtaccagacgaagacgccgacggaccgaccgtcccgtgtcttagtactacttaagtttaaacgtaaacgttacgtttaggaacggtacgggtacccgtaccggtaaccgggtaccccgtggtacgtacgtactttccgtcgtcgtacctaccgtacgtcctacgacgtaccgaaccgaacgtaacgtaccgtacgttacgaacctacgtacgtagggtcgggaccgggttaccgggacgtaacgggaacgggtaccggtacgggtacgttacgttaaccgtttagttaccgttacgtacgtaacggtccgtaagtaccggaacgtaaccggtaagggttaccggttcggtaccttacgtttcgttagggtttaccggttacgggttaccggggtaccggggtaaacggg

SEQ ID NO: 66909 - DNA, 697 bp, Homo sapiens
  misc_feature: GYAE6OF01A9F1Y.49.73.G07.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctctatgagctgacacagcccaccgtggtgtctgtctcctnaggacagacggccagtanccaccgtgtctcgtgganatcgctattcgaccaaaagctaaattacgtcgtactttacgtacgggtaaccaggaccaaggaaccgccgaacggcccgtacggtccccttgttacgtagtacttaccttaaagttttaaacgtaacgttactttagggaacggtaccgggtacccttacgggaaccgggtacccctaggaccgtacgtactttccgtacgtcggtcctaccgagtaccgtacgtaacggacccgaacgtaacgttacgtacccgtaacggtttacaacccgtaagtaccgtagggtcggaccgggttccgggaacgaggacgggaacgacgtcgttacggtaacttacgtttacgacgtacgtcgtactaagacgtacgtaacgtagggtagtaccggtacttacgttccgttacggtaccgttggtaaccggggcgggtaaacccgg

SEQ ID NO: 66910 - DNA, 750 bp, Homo sapiens
  misc_feature: GYAE6OF01EOL8V.49.73.G07.1.454.CMB.1.raw
  modified_base (143)..(143): a, c, t, g, unknown or other
  misc_feature (143)..(143): n is a, c, g, or t
  modified_base (315)..(315): a, c, t, g, unknown or other
  misc_feature (315)..(315): n is a, c, g, or t
tcagagtcgagagacacgaccggtgctcgatttagctctacgctcagggcacgaccggtgctcgtttagagagagtgtggttgggtttgggggtgggtccaggaggcagaactctgggtgtctcaccatggcctggatccctntacttctcccctctcactctctgcacagctctgacgtcctactagtgagtctcgaacctacacgcccgtacccgtggtgtcacggtccgtacccgaggacgacggacggaccaggtctactaccgtgcctcgtagggatacgtgtacctacgttaccgaacctaaacgtatntacgttacttacgtttcgaacgacgacgtaacggaaccggcccggtcctaccggtccctggttcgttaggtctaagttacgtaaagtaaacgctaacggtagaccggtaccggcccttacggacggtaccttcccgagaccgtgttacttccgtacggtcgccgtaccggtacgtccgggaaagtaccgtacgggtataaccgtcgtaccgacctaagtcgtaaggtacgtaccgtaggaacggtacgaacggggacgtaacggacgtttaccgacgttaacgtttacgttaacgttccaacgttaacccttaaagaacccgttaaacgaccgtttaacgttaacggttttaccgggtaaactttcgggttaacgtttacccggtcggtaaaccgacggttaacccgaaacccgggttggtaaaccccgtcccgg

SEQ ID NO: 66911 - DNA, 727 bp, Homo sapiens
  misc_feature: GYAE6OF01AYZ2Y.49.73.G07.1.454.CMB.1.raw
  modified_base (144)..(144): a, c, t, g, unknown or other
  misc_feature (144)..(144): n is a, c, g, or t
  modified_base (231)..(231): a, c, t, g, unknown or other
  misc_feature (231)..(231): n is a, c, g, or t
tcagagtcgagagacacgaccggtgctcgatttagctctacgctcagggcacgaccggtgctcgtttagagaggagtgtgttgggtttgggggtgggtccaggaggcagaactctgggtagtctcaccatggcctggatccctntacttctccccctctcactcgtctgcacagactctggacgcctcctatgacgctgacacacgcccacccgtggtgtctgtcgtcctnaggacacgaccggccagtactccactggctcgtaggatagtgactacgttcgacctaaagtctaattagtcgtacctttaacgacggtaccagaccgaagacgcccgtaggcccgtacggtcccctgttactagtactacttaatttaacgtaagtacgtttacggaggtaccgggtacctacggaccggggtccctagggacgtacgttacttcgtcggtacggtcctccgacgtctaccgacgacgaactacgacgtacgtacgttacgacctacgtacggacggtcggtacgggtaccgggacggaacgggtaccgggaacggtacgggtaccgttacggttaacctttaacgttacgttccggtaaccgttaacgtacctaacggtaccggtaaccggtaaggttaacgggttcggtaccgttaccgttaaccgtttaccggttacgggttaccggtttaacgggttccgggggaaccgggtaaacccgggg

SEQ ID NO: 66912 - DNA, 796 bp, Homo sapiens
  misc_feature: GYAE6OF01DU0ML.49.73.G07.1.454.CMB.1.raw
  modified_base (116)..(116): a, c, t, g, unknown or other
  misc_feature (116)..(116): n is a, c, g, or t
tcagagtcgagagacacgaccggtgctcgatttagctctacgctcagggcacgaccggtgctcgtttagagagagtgtgttgggttggggtggtccaggagcagaactcgtgggtntctcaccagtcggcctggactccctcttaccttcctccccctctcactctctcgcacagtactcgtggacgccttacctagtgacgctacgaacctacgacccgcccgtacccggttcggttcgttccgtacgttccgtccctacgaacggaaccgacggaccggtcctaagttcctccacgttcgctcgtaggacagtcgaacttacgtacggaacaaacgtagttaactacgttacgttacccgtttacgacgtaacccagaacgaacggaccgaccgacggtcccgtacccgtcgttgttcgtaactacttacttaaagtttactaaaggttcgtacggaccgggtaccgacccgtccggtacccggacgtacgtacgtccgttacttccgttcgacggtccctaccggtactaccgtacgaccgtaaccgtaaccgtaacgtccggttaccgtaccgtaacgaccgtacgtacggtacgggtccggtacgggtccggacggtaagggacggtaaccggtacgtaccgtacgttaacgtttaaacgttccgcgttaacgtccgtaaacgaagttaaccggaacgttaccggttaaagggttcccgttagttaccccgtttacggttcggttaacccgttttaggggacggttaccgggggtacccggtaaaaccggg

SEQ ID NO: 66913 - DNA, 625 bp, Homo sapiens
  misc_feature: GYAE6OF01EH7UB.49.73.G07.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
  modified_base (505)..(505): a, c, t, g, unknown or other
  misc_feature (505)..(505): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctnaggacagacggccagtatcacctgctctggagntgctattcgaccaaagcaatntgtacttactcggtacagcagaacgccgacggccgacggccccttagtcttagacttactaagtttaactaaacgttacgtttaggaaggtacgggacccgttaccgaaccgggtcccctaggacgtcggtactttcgtcgtacgccttccgagtcctacgacgaccgaactaacgtagtaccacggttcgtaacctactacgtacggtacgggtacggtccgggaanacggtacggacggacggtctacggtacttaagtactggtacacgtcgtaatcgaacgtacgtaggtacgtcggaccttacgtttccggtacgttacgtcgggtttcggacgggtaacggg

SEQ ID NO: 66914 - DNA, 752 bp, Homo sapiens
  misc_feature: GYAE6OF01CY0YA.49.73.G07.1.454.CMB.1.raw
  modified_base (140)..(140): a, c, t, g, unknown or other
  misc_feature (140)..(140): n is a, c, g, or t
  modified_base (193)..(193): a, c, t, g, unknown or other
  misc_feature (193)..(193): n is a, c, g, or t
tcagagtcgagagacacgaccggtgctcgatttagctctacgctcagggcacgaccggtgctcgtttagagagagtgtgttgggtttgggggtggtccaggagcagaactctgggtgtctcaccatggcctggatccctntacttcctcccccgtctcactctctgcacagtactcgtgacgtcctcatgacnctagacctacgacgcccacccgttggttgtcgttgttaccgtcctagaacggacaacggtccggacctaggttacctacctaccgttggcgtcgtaggagtacgtcgtactacgttaccgaaccgtaaagacttaagtacgttacgttacgtttaccggtacgtacgacgacgaacgacgaccggacgacccggaccgtcccgttagtcttacgacgttattaagttaacgttaaacgtacggtttaggaaccggtacgggtacctaccgggaccggtacccgtaggtaccgtacgttacgttccctacggtccgtaccgtccgtacgtaccgtacgacggtacaaccgtacgtaccgttacgtacgttaaccgaaccgtcgtaggtaccggtacggaccgggtacgtaacgggacggtaaccggacggtacgtccggtttaactaacgttaacttggtaccgtagtaacgtaccgtagaacgtacggtaattaacgggttcaccggtttacttaggttacgtttcccggtaggtttaccgggcgggttccggaaacgg

SEQ ID NO: 66915 - DNA, 658 bp, Homo sapiens
  misc_feature: GYAE6OF01BC8VB.49.73.G07.1.454.CMB.1.raw
  modified_base (266)..(266): a, c, t, g, unknown or other
  misc_feature (266)..(266): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctcctcactctctgcacagactctgaggcctcctatgagctgacacacgccacccgtcggtgtcagtcgtcccccaggacaggaccggccaggactcctacctgctcgtgganagtgctattcgaccaaaccgattatgtcttagttggtaccagcgaagacgccgggccgacggcccgtgtcgttggtgagtagtaataaacgacacgtaggacggaccggtcccgtacgagggtactccgtagacggcgtgttctcgtggccgtacgtaggtacgacgggtaacgtacggtacacgtaacgtcggctacgtacgaggttcggacgtccggacggacggaacgggacgggtaacggaggtcgttacgtacgtttaacgtttacgttacgtaactaacttaaccgaactaacggtaacctaaccgttagtttacgttacgtttcgttacgttacgttaaccgtaacggtcggtaacccgaaccgttacggtcccgttaacccggg

SEQ ID NO: 66916 - DNA, 257 bp, Homo sapiens
  misc_feature: GYAE6OF01BTPQX.49.73.G07.1.454.CMB.1.raw
  modified_base (157)..(157): a, c, t, g, unknown or other
  misc_feature (157)..(157): n is a, c, g, or t
  modified_base (215)..(215): a, c, t, g, unknown or other
  misc_feature (215)..(215): n is a, c, g, or t
  modified_base (222)..(257): a, c, t, g, unknown or other
  misc_feature (222)..(257): n is a, c, g, or t
tcagagtcgagagacacgaccggtgctcgatttagctctacgctcagggcacgaccggtgctcgatttagtcgagctctctcgcgggcacgaccggtgctcgatttagtcgagctctctcggcgggcacggaccggtgctcgatttagcgagctctntcggcggcacgacggtgctcgtatttagtcgaactctcgcgcgggctggccaaggccntaagtgnnnnnnnnnnnnnnnnnnnnnnnnnnnnnnnnnnnn

SEQ ID NO: 66917 - DNA, 182 bp, Homo sapiens
  misc_feature: GYAE6OF01D95SC.49.73.G07.1.454.CMB.1.raw
  modified_base (155)..(155): a, c, t, g, unknown or other
  misc_feature (155)..(155): n is a, c, g, or t
  modified_base (161)..(182): a, c, t, g, unknown or other
  misc_feature (161)..(182): n is a, c, g, or t
tcagagtcgagagacacgaccggtgctcgatttagctctacgctcagggcacgaccggtgctcgatttagtcacgcgagaagggaaggggctggccctgacgtgtttctgttcccgccctcctctctctcgactctggagcgggctggcaaggcncatagnnnnnnnnnnnnnnnnnnnnnn

SEQ ID NO: 66918 - DNA, 802 bp, Homo sapiens
  misc_feature: GYAE6OF01CEZT2.49.73.G07.1.454.CMB.1.raw
  modified_base (144)..(144): a, c, t, g, unknown or other
  misc_feature (144)..(144): n is a, c, g, or t
  modified_base (225)..(225): a, c, t, g, unknown or other
  misc_feature (225)..(225): n is a, c, g, or t
tcagagtcgagagacacgaccggtgctcgatttagctctacgctcagggcacgaccggtgctcgtttagagagagtgtgttggggtttgggggtgggtccaggaggcagaactctgggtgtctcaccatggcctggatcccctntaccttcctccccctctcactctctgcacacgactctggacggccctcctatgagctgaccacacgcccacccgtcgggtntcttggtcgtccctgacggacacgtaccggacctagtactcccacgttcgctcgtggaactagtcgactaagtaccgaacctaaaggtacctaaagttaccgtcgtaaccgtttaccggtaacggtacccgaagccaaacgggaacgtcccggaaccggtccccgaacccggttccccgttgttccgttagtacttacttaaagttaaacgttaaggttacgttaggacggtacggtcctaccgggaccggtaccgtacgagttactcgttccgtacggtccgtacctacgtacgaccgtaccgaacggtaccgaaacctaaccggtagtacccggtaacgttccggaacctacggggtttaccgaaggggtacggggtaacccggggtacgggaacggaagggtaaccgggtacgggtaacggtaccgttaacgttacctttaacggttaccgtccggtaacgtacgtttacccgaaaaggtccgtaaacggttaacgggtacggttacgggtaccgttacccgttagttcgtttaccgggtaccggtttgggttacccgggggaacgggtaacgg

SEQ ID NO: 66919 - DNA, 887 bp, Homo sapiens
  misc_feature: GYAE6OF01D4LM2.49.73.G07.1.454.CMB.1.raw
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
tcagagtcgagagacacgaccggtgctcgatttagctctacgctcagggcacgaccggtgctcgtttagagagagtgtgttggggtttgggggtgggtccaggaggcagaactctgggtgtctcaccatggcctggatccctctacttcctccccctctcactctctgcacagactctgacggcctctatgagctagacacacgcccacctcggtntctgtcgtcctcgaggacaggaccggccagttacnccaccgtgctcgtaggagatcgctagttcgaccaaagactaattatcgtacttacgacggtaccagacgaaggaacgaccgacggaccctaccggtcccttgttcttagtacttaacttaaacttttaagtaaacgttacgttaggaaccgggtacgggtaccctacgggtaaccggggtacccctagggaccgttacgtacgtttcccgtacggtaccggacccgttacccgacggtcccgtaaccgaccgggtaaacccgtaaacctaaacgtaccggttaccgttaaccggttaccgtaaacccgtaacgtttaccgggaacggggtttaaccggggtaacccggggttaacccgggggaaacgggtaaaaccgggggtacccgggtaaccgggttaacccgttaaaccggtttaacggttttaaaccgtttaaccgggttacggtttaacccggtaaccgtttaaccgtaaaccgttaacccgggtaaaacggttaaccgggtttaaaggggttaaccgggttaacccgttaccccgtttaaacgggtttttccccgttagggggtttaaccccgggtttaaccggggttacccggggggaaaccggggttaaacccggggtaaaaccccgg

SEQ ID NO: 66920 - DNA, 760 bp, Homo sapiens
  misc_feature: GYAE6OF01A8N8D.49.73.G07.1.454.CMB.1.raw
tcagagtcgagagacacgaccggtgctcgatttagctctacgctcagggcacgaccggtgctcgtttagagagagtgtgttgggtttgggggtggtccaggaggcagaactctgggtgtctcaccagtggcctggatcccctctaccttctccccctctcactctctgcacagactctgacggcccttcctatgacgtctgaaccacacgccctacccgtggtgtctgtcgtccctgaggacacggaccggcctagtactccgaccgtgcctcgtaggaacgtagtcgctagttcgaaccaaagacaattatacgtaccttacgtacgggtaaccaggacgaaggacgaccgaacgggacccacgggtcccccttaggttccttagtacttaccgttaattttaaacgtaaaacggttacgtttacgggaacggtaccggggtcccgttacggaacccggggtaccccgtaggaccggtacggttacttccgtcggtcggccctaccgtacgtccgtacgacgtaccggaaacctaacgtaccgtaaccgttaccgggttacaacccgttacgtaccggtaagggtacgggtaccggggtacccgggacggaacgggaacgggtacgggaacggtcgtaacggtaacttacgttacgtacggtacgtaacggtcaacgtaacgacggtacgtagggtaagttccggtacttaccgtttcggtacggtttacggtacggttcggggaacgggtaacccggg

SEQ ID NO: 66921 - DNA, 729 bp, Homo sapiens
  misc_feature: GYAE6OF01A2A68.49.73.G07.1.454.CMB.1.raw
  modified_base (216)..(216): a, c, t, g, unknown or other
  misc_feature (216)..(216): n is a, c, g, or t
tcagagtcgagagacacgaccggtgctcgatttagctctacgctcagggcacgaccggtgctcgtttagagagagtgtgttgggtttgggggtggtccaggagcagaactctgggtgtctcaccatggcctggatccctctacttctccccctcctcactctctgcacagactctgaggcctacctagtgacgctgacacacgcccaccctcggtntcgttgtcgtacctcgaggacacggaccggcctaagtactccaccgtgccgttcgtggagtatcgactagttacgaaccgaaagtacctaaatgtacgtacctttacgtcggtaaccacggaccgaacggaaaccgcccgacggtacccgtacccgggtcccgttcgttcttaacgtacttactttaaacgtttaaagtaaacgtacgtttaggacggtaccgggtccctacgggtacccgggaccctagggacgtcgttacttccgtacgtcgtacctcgacgtcgtacgacgtaacccgaaccgtaacgtacgttaaccgtacgttacccgtaacgtaccgttacgagggtaccggacgggtaccgtacggaacgggaacggtacggacgtcgtacggtaacttacggttacgtacgtagtactacgtaagacgtacgtaaggtagttaccggtcgttaccttacggttacctcgggttaccggtttcggaccggggtacgggtaaccggg

SEQ ID NO: 66922 - DNA, 717 bp, Homo sapiens
  misc_feature: GYAE6OF01E0BKW.49.73.G07.1.454.CMB.1.raw
  modified_base (216)..(216): a, c, t, g, unknown or other
  misc_feature (216)..(216): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgacggcctcctatgagctgacacagcccaccctcggtntctgtcgtcctcgaggacaggaccggcctagtactccacctgcctctggaagatgactattcgaccaaaagctaatatcgtacttacgcggtaccagcaagaacgaccgacggaccaccggccccttgttccttagacttacttaattttaaagtaaaacgttacgtttaggaaacgggtcgggtacccctaccggaaccgggtacccctagggaccgtacgtactttccgttcgtcggtcctccgacgtcctacgacggaccgaaaccaacgtacgtaccctacggtttacgaacctacgtaccggtagggtacgggacccgggtccgggacgtaacgggaacgggaaccggtacgggtacgttacgtaaacgttaccgtttaacgtcggtagtaaccgtacgtaacttaccggaaccgtaagtaacggttcgggtacgtacccttaaccgtttccggttacgttacgggttacggttaccggggacgggtaaacccggg

SEQ ID NO: 66923 - DNA, 767 bp, Homo sapiens
  misc_feature: GYAE6OF01BJW74.49.73.G07.1.454.CMB.1.raw
  modified_base (117)..(117): a, c, t, g, unknown or other
  misc_feature (117)..(117): n is a, c, g, or t
  modified_base (176)..(176): a, c, t, g, unknown or other
  misc_feature (176)..(176): n is a, c, g, or t
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
tcagagtcgagagacacgaccggtgctcgatttagctctacgctcagggcacgaccggtgctcgtttagagagagtgtgttgggtttgggggtggtccaggaggcagactctgggtntctcacatggcctggactccctctacttcctcccctctcactctctgcacacgcttcgnggacgccctctagtgacgtctacgaccacgcgccctaccgtggttntcctggtcgtccngagacaggaccgctagtcacnccgtgactcgtggaagtgacgtcctagttaccgaaacctaaagtacctaagttctaccgttaccgtttaggtaccggacctaggacgaacggaaccgtccggacggaaccccggtcgttccccggttagtctagttaaacctttattaagttttaaaacgaaccgttaggtacccgggtaaggttacccgggccctaaccgggaacccggtccgtaacgggaccgttcttaggttccccgttccgtaaccggtccccgtaacgggtacctcccgttacgacccggtaaaccgtaacgtaccgtttacgaccgtttaccggtaccctaatccgtagggtaccgtgggacccgggtccggagacgggtaccggagggacttacggtaccgtaattaccgttcgaaccgtcgtagtaccgtaacgtggtaaccgtaggttaggacgtacccgtttccgttaggtttaacccgtcgggttttaaacctcggggtaccggggttcgggaaaccccg

SEQ ID NO: 66924 - DNA, 709 bp, Homo sapiens
  misc_feature: GYAE6OF01C3IW8.49.73.G07.1.454.CMB.1.raw
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (366)..(366): a, c, t, g, unknown or other
  misc_feature (366)..(366): n is a, c, g, or t
  modified_base (609)..(609): a, c, t, g, unknown or other
  misc_feature (609)..(609): n is a, c, g, or t
tcagagtcgagagacacgaccggtgctcgatttagctctacgctcagggcacgaccggtgctcgtttagagagagtgtgttgggttggggtggtccaggaggcagaactcgtggtgtctcacagtggcctaggatccctctacttccctcccctcactactcttcgtgacacagtactcgtggacgccttccatgacntcgacancgcctccgtgtgtctgtcgtccgtacgagtacgagaccggactagactccacgttgcgttacgtggaatgtacgtactagttacgaaccgaaagtataaagtcgtcgtacttaacggtacgtacagaccgaggaccgacgaccgaccggtaccgccgtttntacgttatacttaagtttacttaaacgtaagggtacctttagggaacggcccggtacggtaaacccgtacggggtaaccccgaggtacgttcgtttaaccgtcgtacggttaccgttcccgataccggtacgtacggaccgaaacgttaccgaacgtaccggtaacgaccgtaacgtaaccaggtaacgtacggtcggtaggacccgtaggaagtcggacgtaggtacctaagtctttaacgngtaacgtctaccgaccgtttaagacgttacgttagggacgtttcgacgttaacgtacccgttaaggtcggaccggtttaacggccgggtaacggtaacgg

SEQ ID NO: 66925 - DNA, 191 bp, Homo sapiens
  misc_feature: GYAE6OF01DRQTM.49.73.G07.1.454.CMB.1.raw
  modified_base (117)..(117): a, c, t, g, unknown or other
  misc_feature (117)..(117): n is a, c, g, or t
  modified_base (150)..(150): a, c, t, g, unknown or other
  misc_feature (150)..(150): n is a, c, g, or t
  modified_base (158)..(191): a, c, t, g, unknown or other
  misc_feature (158)..(191): n is a, c, g, or t
tcagagtcgagagacacgaccggtgctcgatttagctctacgctcagggcacgaccggtgctcgttagagagagtgtggttgggttgggggtggccaggaggcagaactctggggtntctcacagtggcctggattccctctccttcccnccctctgnnnnnnnnnnnnnnnnnnnnnnnnnnnnnnnnnn

SEQ ID NO: 66926 - DNA, 714 bp, Homo sapiens
  misc_feature: GYAE6OF01BSRYA.49.73.G07.1.454.CMB.1.raw
  modified_base (142)..(142): a, c, t, g, unknown or other
  misc_feature (142)..(142): n is a, c, g, or t
  modified_base (149)..(149): a, c, t, g, unknown or other
  misc_feature (149)..(149): n is a, c, g, or t
  modified_base (210)..(210): a, c, t, g, unknown or other
  misc_feature (210)..(210): n is a, c, g, or t
  modified_base (285)..(285): a, c, t, g, unknown or other
  misc_feature (285)..(285): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttcnccccctctcactctctgcacagactctgagcctctatgagctgacacagcccaccctggtntctgtgtcccagaggacaggacggcctaagtactccactgctcgtggacatgcctagttcgacaaagctaaagtntcgtacttacgtagggtacccagacaaggaacgtccgacggtcccgacggtcccctggttcctagactttacgtaaattttaaagtaaacggttacctttagggaaggtaccgggtacccctacgggtaaaccgggtaccccgttaggtaaccgtacggtaacttttcccgtcgttaaccgggtcccttaccggaactcccgtaacggacgtaacccgtaaaccgaacgttacggtaacccgttaacgtacgtaaaccgacgttccgaagggttcgggtacgggacccgggtagacgggacggaacgacgggtctaaggtaccttaagttacctacgttcgtaacgttcaaagttcgaacgtaacctaggtaccggtattcccgaagtttccgtaggttaccgttacgggttcgggcgggtaaaaccgg

SEQ ID NO: 66927 - DNA, 689 bp, Homo sapiens
  misc_feature: GYAE6OF01BBYR0.49.73.G07.1.454.CMB.1.raw
tcagagtcgagagacacgaccggtgctcgatttagctctacgctcaggggctcgatttagctctacgctcagggcacgaccggtgctcgatttagctctacgctcagggcacgaccggtgctcaatttagtgtagtgtgaagggggctggtggtccaggagcagaactcgtgggtgtctcaccatggcctggactccctcttacttcctccccctcctcactctctcgcacgacggctcgtcgacggtcccttcctagtgacgcgtacgaaccacgacgttacctacccgttcggttcgtcttcggtcgtcctacggacgacgacggaccggaccgtaggtactccgacgtcgtccttcgtcggacgtacgtacgtactaacgtaccgaaaaccaaaatacgttacgtaccgttaactttacggtaacgtacgtacgacgtacggacggacccgacggtcccgaccgttcccgtggtttcgttaggtagttaactttaaagtaacgttagttacggacgtaccgtccgtaacggaccggtacctaggacgtacgtacctttcgacgtaccgtaccgtaccgtacggtcgtaacggacggtaaccaacgttccgtaaccttaccgtaacgactacgttacgacggtcggtaccggtacgacgagggtacgaacggtcggtctagttaacg

SEQ ID NO: 66928 - DNA, 873 bp, Homo sapiens
  misc_feature: GYAE6OF01B9N4N.49.73.G07.1.454.CMB.1.raw
tcagagtcgagagacacgaccggtgctcgatttagctctacgctcagggcacgaccggtgctcgtttagagagagtgtgttgggtttggggtgggtccaggaggcagaactctgggtgtctcaccatggcctggatccctctacttcctccccctctcactctctgcacagactctgaggcctcctatgagctgacacacgccaccgtggtgtctcgtgtcctacgaggacacggaccggacctaagtactaccactcggctacgtaggaagtatgactagttcgaaccaaaagtaccaaattacttacgtactttaaccggtacggtaacccacggacgaaacggaaacgacccgaacgggtacccgaaccgggtcccccgttgtttaccgttacgtaacttttaccgtaaagttttttaaaacgtaaaacggttaccgtttttaagggaaccggttaaccgggggtccccgttaaacccgggaaccggggtaacccccctttagggaaaccggtttccggttaacgttttcccgttaccggtttaccgggtcccgttaccccgaagttcccgttaaccggaacgggtacccggtaaaaccaaaccggtaacggttacccttaacgggttaccgtaaccgaagttacccgggtaggttaccgggacgggttacccgggacggaacgggtaacggtaaccgggagttaaccgtaggttaaacctttaacgtaccgttaacggtactaacggtaccgtaacgtacgttaaaacggaaggtttaacgggtcggtttacgggtaccctttaccggtttaccggtccggttttaacgggttccgggttaacgggggttaacccgggtaaacccgggg

SEQ ID NO: 66929 - DNA, 767 bp, Homo sapiens
  misc_feature: GYAE6OF01BDO5S.49.73.G07.1.454.CMB.1.raw
  modified_base (143)..(143): a, c, t, g, unknown or other
  misc_feature (143)..(143): n is a, c, g, or t
  modified_base (677)..(677): a, c, t, g, unknown or other
  misc_feature (677)..(677): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatcccctntaccttcctccccctcctcacttctctgccacagacctctagacggccctcctatgagcctgaaccacacgcccacccgttgggtgtcttggtcgtccctacgaagggaaccacggtaccggcctaaggttactaccgaccgttggaccttccgtagggagagttcggtactaacgtttcggaacccaaagtacctaattagttaccgactttaccgtcggaacctagacgtaagacggacccgacggaccccgtacggtcccccgttgtttccgtacagttaccttaagtttaaacgttaaaggttccgtttaaggacggtaccgggtacccgtaccggaaccggggtaccccctaggacgtaccgtacgtttcgtacgtccgtccttaccgagtccgtacgacgaccgaaccacgtacgtcgtacgttcgaacctacgcgttaggcggtcgggtacccggacgaagggaacggtaccgacggggtacctacgggttaactaacgttttacgaggttaccgtacggttaaccngtaaccggtagtagaccgggttagtacggtcccgtttacgttcccgggtttacgttacgggttcggtaccgggggtagggtaaacccggg

SEQ ID NO: 66930 - DNA, 639 bp, Homo sapiens
  misc_feature: GYAE6OF01EJDUW.49.73.G07.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (521)..(521): a, c, t, g, unknown or other
  misc_feature (521)..(521): n is a, c, g, or t
  modified_base (535)..(535): a, c, t, g, unknown or other
  misc_feature (535)..(535): n is a, c, g, or t
  modified_base (618)..(618): a, c, t, g, unknown or other
  misc_feature (618)..(618): n is a, c, g, or t
tcagagtcgagagacacgaccggtgctcgatttagctctacgctcagggcacgaccggtgctcgtttagagagagtgtggttgggtttgggggtgggtccaggaggcagaactctggggtgtctcaccatggcctggactccctctacttctccccctctcactctctgcacagactctgacggcctcctatgagctgacactagccaccttcgggtntctgtagtccctnaggacaggcggccagttanccacctgctctgagactgactattacgaccaaagcaatagtagtacgttactcggtaccagacgaagacgaccgaacggcccaaggccccctgtaccgttcggacttagaacgttttaagtaaaactacgtttagagacgggtacctaccggaacggtaccccgttaggaacgtacggtactaccttcggtcgactcccgtaaagcttaccgacggacaacaacgtgtaccgacgttacgaccctaatacgacggttaggaccgtcggacnggaacgtacgacgngtacacgtatacctgtaccaggtccaagtacgtaacgtaacgagtttaacgcgggacttacgtttacgtacgtacccgggttnttaccggggacggtaaccggg

SEQ ID NO: 66931 - DNA, 708 bp, Homo sapiens
  misc_feature: GYAE6OF01C0H39.49.73.G07.1.454.CMB.1.raw
  modified_base (126)..(126): a, c, t, g, unknown or other
  misc_feature (126)..(126): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (464)..(464): a, c, t, g, unknown or other
  misc_feature (464)..(464): n is a, c, g, or t
  modified_base (641)..(641): a, c, t, g, unknown or other
  misc_feature (641)..(641): n is a, c, g, or t
  modified_base (650)..(650): a, c, t, g, unknown or other
  misc_feature (650)..(650): n is a, c, g, or t
tcagagtcgagagacacgaccggtgctcgatttagctctacgctcagggcacgaccggtgctcgtttagagagagtgtgttaggggtttgggggtgggtccaggaggcaggtaacctcgtggggtntctcacctatcggacctggactccctctaccttcctccccctactcaccttctcgtgcaacagactctaggacgcctctatgganctgacactcgcccaccgtggtntctagtgtcctacgaggacaaggccggctaaggttactccncgttcgacttcggtggaagtagtcgactagttacgaaaccgaaagactaaaatcgttaccgttaccgtttaacgtacggtaccacggtacgaacggaacgccgacggcccgacggtccccttgtcttagacttacgttaatttaacgtaagttacttagggacggtcggtaccgtacgaccgggtacccngacgtcgtacttcgtacgtcgaccttaccgacgtacctacggaaccgtacgaaccgtaaacgtacgtccgttaccgtacgtaaccgtagtacggtacgggttcggaccggttaccgggacgtagggaaccgacggtacgtctacgtaacttacgttacggagttccaagtccgtaancgtaaacgntaacggtcgtacgtacgttcgttcgttacggttaccggttcgtacggggcgtaacggg

SEQ ID NO: 66932 - DNA, 735 bp, Homo sapiens
  misc_feature: GYAE6OF01A2MW7.49.73.G07.1.454.CMB.1.raw
  modified_base (143)..(143): a, c, t, g, unknown or other
  misc_feature (143)..(143): n is a, c, g, or t
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatcccctntacttctccccctcctcactctctgcaacagactctgagcctctatgacgctgaccacagcccacccgtcggtntctgtcgtcctcaggcaggaccggccagtacnccgacctgctctggagatgctattcgaccaaagtacaattacgtcgtaccttacgtacggtaccagtcgaagaacgtccgaacggcccgtacggtccccgtagttccttaggtacttacgttaacttttaaacgtaaacgtaccttttaggaacggtaacgggtcccgtaccggtaccgggtaacccccgtggacggtaccgtacgtttacccgttccggttacggaccgttcccgtaaggtccctacggaccgaccgtaaaccgtaaaccggtacggttaccgtaaccggtttaccgaaccgttaacgtaccggtaacgggttacggggaaccggttcccggggaacggaaccgggaggggtaacccggtaggggtacctacggttaacttaacgttacgtacgtccgtacgtacactacgacgtagtaggtacgttacggacttacgttcgtcggttaccgtagggttccgggcgggtaacggg

SEQ ID NO: 66933 - DNA, 673 bp, Homo sapiens
  misc_feature: GYAE6OF01EY486.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgagcctcctatgagctgacacacgcccaccctcggtgtctgtgtcctcgaggacagaccggccagtatcacctgctcgtggagatgctattgaccaaaagcaaatatgcttaactcggtaccagacaagaacgccaggccacggtcccctgtcttgatactaatttaaataaagtactttggaaggacggtcctacgaccgggacccctgagacgtatttcctcgtcggcctaccgtagccttacgacgaacgaaccaacgtacgttaccaacggttacaacccgtaacttcggaagggtgggttaaccgggtcccggggaacgtaaggggaacggggaacggaagggtcttaacgggtaaacctttaagttacccggttaggtaccaggttaccgtaaacttacgaacgtaacccggtaggttacggtacgtaccgttaacgttttccggttaggttacggtttaacgggttccgggggagggtaaaacccgggg

SEQ ID NO: 66934 - DNA, 735 bp, Homo sapiens
  misc_feature: GYAE6OF01AQ0ZO.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcaagaactctgggtgtctcaccgatcggcctggactccctctaccttcctccccctccttcactcgtctgcacgagactcgtgacgcctacctatgaacgtctagaccacacgccctaccgtcggttctccgttgtcgtcctcgacggaacacggaccgtcctagttactcctaccgtcgccttacgagggaacgtcttacgacgtaacggttacaaaccgaaagtactaaagttacttcgtcctttaacgtacggaacacgagaacgaccgaccgacggaccgtaccgtccttcgttacgttagtactttacgttaaagttaaactttaacgtacggtttaacggacgggtaccggttacccgaccgggtaccggttaaccccgcggttaacgtaacggtctttccgtaccgggtcgtaccgtccgaccgtaccgtcgaaccgacgtaaacccgtaacgacttaccggtacctacgtaaccgtacgtacggtacgggagtccgggtaacgggcgaacggtacgggacggtacggtaccttacgtaactttacggagttctacgactagtacgtaagtacggagtggtcgaccttacgttacgtcgttcggtagtcgggtgacggaacgg

SEQ ID NO: 66935 - DNA, 770 bp, Homo sapiens
  misc_feature: GYAE6OF01D0AXE.49.73.G07.1.454.CMB.1.raw
  modified_base (122)..(122): a, c, t, g, unknown or other
  misc_feature (122)..(122): n is a, c, g, or t
  modified_base (211)..(211): a, c, t, g, unknown or other
  misc_feature (211)..(211): n is a, c, g, or t
  modified_base (385)..(385): a, c, t, g, unknown or other
  misc_feature (385)..(385): n is a, c, g, or t
tcagagtcgagagacacgaccggtgctcgatttagctctacgctcagggcacgaccggtgctcgtttagagagagtgtggttggggtttgggggtgggtccaggaggcagaactcgtgggtntctcaccagtcgctggactccctctacttcctcccctctcacttctctgcacagtactctgacgccttactagtgactcgtagaccacncgccccgtaccgttcggtcgtcgttcggttccgtcccgtacggaacggaaccgacggaacccggtaccgtaaggttacctacccgaccgttcgtacctcggtagaacgtactcgtacttacgtaccgaaacgtaaacgactaaagttcgtacgttacgttaacgtccggaacgngacgaacggaaccgcgaccggacccgtaccgtcccgttgttcttagtacttaacttaagttaacgtaacgttaccgtttagggaaccggttaccggtacccgtaaccgggacccggtacgtacggtaacgtccgtttacgtccgtccgggtacctcctaccgacggtaccgacaacggtaccgtaaacgaacgtcgttactaccgtaacgacgtagtacggtacggttccggggacgtacccgtaggcggtaacggccggtagtacctaacgttacttacggttcgtacgtactacgtacgtagacggtaacgtaaggttaggttcgtacccgttcttacgtttcggttacgggttaaccgttccggggccggacgggtaaaccg

SEQ ID NO: 66936 - DNA, 730 bp, Homo sapiens
  misc_feature: GYAE6OF01BSW2F.49.73.G07.1.454.CMB.1.raw
  modified_base (218)..(218): a, c, t, g, unknown or other
  misc_feature (218)..(218): n is a, c, g, or t
  modified_base (252)..(252): a, c, t, g, unknown or other
  misc_feature (252)..(252): n is a, c, g, or t
tcagagtcgagagacacgaccggtgctcgatttagctctacgctcagggcacgaccggtgctcgtttagagagagtgtgttgggtttgggggtgggtccaggaggcagaactcgtgggtgtcctcaccatggcctggatccctctaccttcctccccctcctcactctctgcacagactctgacgcctcctatgagctgacacacgcccaccgtggtntctgtactcctcgaggacacggaccgctagtacncctaccgtgctcgtaggatacgtgctagttacgaacctaaagactaagtactacgtacgttacgtacggtaccgagacgaacggaccgtccgacggacccgtccgtacccgttgttaccgttagtacgttaacttaaactttaaacgtaacggttaacgtttacgggaacggttaccgggtaccccgttaacgggacccgggtaacccgttaggaacgttaccggttaccgtttccgtcggttccgtaccgtaccgaccgtcgtacgacgtaaccgaacgtaacgtactacgggggggtactacgtaacctacgtacgtcggtacggtacggtaccgggacggaacggacggtacggacggtacgtacgtacgttaacgttacgtacgtacgtacgtacgtacgtacggaacgtagtacgtacggtacgtacgttacgttacgttacggttaggttacggtcgggtacggtaaccggg

SEQ ID NO: 66937 - DNA, 696 bp, Homo sapiens
  misc_feature: GYAE6OF01BOP9U.49.73.G07.1.454.CMB.1.raw
  modified_base (218)..(218): a, c, t, g, unknown or other
  misc_feature (218)..(218): n is a, c, g, or t
  modified_base (294)..(294): a, c, t, g, unknown or other
  misc_feature (294)..(294): n is a, c, g, or t
tcagagtcgagagacacgaccggtgctcgatttagctctacgctcagggcacgaccggtgctcgtttagagagagtgtgttggggtttgggggtgggtccaggaggcagaactctggggtgtctcaccatggcctggatccctctacttcctccccctctcactctctgcacagactctgacggcctctatgagctgacacacgccctaccctgggtntctgtctcctacgaggacaggaccggccagtctccacctgcctcgaggacgtatgactatcggaacaaagataatntcgtaccttagtcggtaccagacaggacgcccgaggcctacgggtcccttggtccttagacttacttaattttaaacgaaacgttctttaggaggtaccggtacccgtacggtaaccgggtaccccgtggaaccgtcggttacttcgttacgtccggaccttccgacgtcctacgaacggacgaaccgtaacgtacgtaccgtaccgtaacgaccttacgtaccggtgggtacgggtacggtacccgggagtaacgggacgggtaccggacggtactaggttaacttacgttaccgtcggttaccgtaagtaccgtaacgtgtaacccggtaagtagggtaacgtcgttacccgttagttacggtacggttacgttaccgggtggggcccggtaaaccgggg

SEQ ID NO: 66938 - DNA, 792 bp, Homo sapiens
  misc_feature: GYAE6OF01EAMRF.49.73.G07.1.454.CMB.1.raw
  modified_base (171)..(171): a, c, t, g, unknown or other
  misc_feature (171)..(171): n is a, c, g, or t
  modified_base (560)..(560): a, c, t, g, unknown or other
  misc_feature (560)..(560): n is a, c, g, or t
  modified_base (570)..(570): a, c, t, g, unknown or other
  misc_feature (570)..(570): n is a, c, g, or t
tcagagtcgagagacacgaccggtgctcgatttagctctacgctcagggcacgaccggtgctcgttagagagagtgtgttgggttgggggtggtccaggaggccagaacctcgtgggtctctccaccatcggcctggactcccctctaccttcctccccctctcacctctntacgccaactagaccttccgtggaacggtccccttaccgtaagtgaacgcctacgaccaccgacgtacccctaccggttcggtcgtctacgttccggtccctaaggaacggaaaccacggacccgccaagttactaccggacctcggtcctgtacgacgagtcaacgtagttaaccgaaccggtaaaatccgtaaagttaccgtacggttacctttaaccggacggttaaccgaaccgtacgaaaccgaaccggacccggtaccgggaccaacccgggttcccccttaggttacttccgtaacgtactttaaaacgtttaaacgtaaaaccgtttgttaacggaacggaccggtcccgtaaccgaccggtaccgtagacctagttaccncgttacccgngtaccgaacctcgactaccgaccggtaacacgtaaacgacgtaccgtaacgtacgtacctacgagtacggtacggtacggaccggcggaacggtacggaagaccggtacttaacgtacgttaacgttacgtagtacgacgttacacgttacgaacgtagtacggtaagtccgtacgttaccctttcgtaggttaccgtacggtttgggaaccgggtaaaccg

SEQ ID NO: 66939 - DNA, 624 bp, Homo sapiens
  misc_feature: GYAE6OF01C8XHP.49.73.G07.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (276)..(277): a, c, t, g, unknown or other
  misc_feature (276)..(277): n is a, c, g, or t
  modified_base (300)..(300): a, c, t, g, unknown or other
  misc_feature (300)..(300): n is a, c, g, or t
  modified_base (358)..(358): a, c, t, g, unknown or other
  misc_feature (358)..(358): n is a, c, g, or t
  modified_base (510)..(510): a, c, t, g, unknown or other
  misc_feature (510)..(510): n is a, c, g, or t
  modified_base (542)..(542): a, c, t, g, unknown or other
  misc_feature (542)..(542): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgacacagacctcgtagacgtccctctatgacnctgaccacacgcccacccgtggttctctgtcgtcctacgagacaggccggctagtactcncgtgctacgtggaagtannacagttcgaacctaagactaatntcgtacttaacgtcgaaccgagcgaagaacgcgacgccgacgttcccgtagttcgtanactacgttaatttaataaacggttacttaggacgggtaggtaccctacggacccggtcccaggtaccggcttacgtttcgcgtcgtactccgcgtactagacgaacacaagtacgcttcgtaacacctagctagggtcgacggtaccggganagggaacggagcgtcgtataactttacgtgtntaacgcttacgaactccgagtagttaggtacgtcgactttgttaaccggtcttaaggttccgggtaggacccggtaaacggg

SEQ ID NO: 66940 - DNA, 766 bp, Homo sapiens
  misc_feature: GYAE6OF01EQMJI.49.73.G07.1.454.CMB.1.raw
  modified_base (195)..(195): a, c, t, g, unknown or other
  misc_feature (195)..(195): n is a, c, g, or t
  modified_base (584)..(584): a, c, t, g, unknown or other
  misc_feature (584)..(584): n is a, c, g, or t
tcagagtcgagagacacgaccggtgctcgatttagctctacgctcagggcacgaccggtgctcgtttagagagagtgtggttgggtttgggggtgggtccaggaggcagaactctgggtgtctcaccatggcctggatcctctacttctcccctctcactctctgcacagactctggacggcctccgtatcgganctagacacacgacccacccgttggtgtctagtcgtacctacgaaggtacacggtaccggacctaaggtactcaaccgttagcctcgtaggaacgtatcggactacgttacgaaccgtaaaaacggctaaagtaacgtcgtacctttaaaccggtacgggtaaacccaacggacgtaacgaaacggacccgaaccgggcccgtaaacccgggtcccccgttagggtaccctttaggtaacttaccgtttaaaagttttaaacggttaaaaacggttaccggttttaaggaacgggtacggggtaccccgtaacgggtaaccggggtacccctaggacggtacggttactttcgaccgttggtacctccgagcctacgaggaccaacgtanacggtaccagttcgaacgatacgagggtcgtacgtggactaacggaggtacgagggttacctagtacttaacggttactacgtacgtaccgtacaataccgggaaactacggtaaggttaccggacggttacctacggtttacgttaggttaccggttacggtacgggccgggtaaaccggg

SEQ ID NO: 66941 - DNA, 670 bp, Homo sapiens
  misc_feature: GYAE6OF01BCL3U.49.73.G07.1.454.CMB.1.raw
  modified_base (223)..(223): a, c, t, g, unknown or other
  misc_feature (223)..(223): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (489)..(489): a, c, t, g, unknown or other
  misc_feature (489)..(489): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatggcctggatcccctctaccttcctccccctcctcacctctctgcacaggctctgacggccctcctatgagtctgacacacgccctacccgtcggtntccaggttcgtcccccaaggacagaccggccagggactccacccgtgcgtcgtggagagtcgactacgttacgacccaaaccgtatactagtctattggaccagacgaggacgccggacacgcccgtgtcgttggngatagtaagtaaacgactacgnggaacggacggtccctggaccgggtacctccgtaggacgtaccgtagttccgtacgtacgttccgaccggtacggtccgaacgggtaacgtaaccgtacgtaaccgtntaaccggtcctacgtacgtaagggcgtagacccgtagggaccaagggacggtacggagtccgtagtaacttagtttatacggttacaaactccaaaagcctaaaacgtaacgtacgttacgttaaactttgtacgttcgttaaacgacgtacgtaaccgaacgttacggtcccgaacccgg

SEQ ID NO: 66942 - DNA, 756 bp, Homo sapiens
  misc_feature: GYAE6OF01CQM40.49.73.G07.1.454.CMB.1.raw
  modified_base (265)..(265): a, c, t, g, unknown or other
  misc_feature (265)..(265): n is a, c, g, or t
tcagagtcgagagacacgaccggtgctcgatttagctctacgctcagggcacgaccggtgctcgtttagagagagtgtggttgggttgggggtgggtccaggaggcagaactcgtgggtgtctcacctagtcggcctggactccctctacctcctccccctcctcactctctcgactacacgtactcgtcgacgcctctagtgacgcgtcgacacaccgccaccgtcgtgtcgtagtctcagacggacgagtccgtctactcacncgtcgtcgtaggagactcgactactaccgtagaacgaactaatacgttcgtacggtacctacggtaacgacagacggtaaacgaccggcgaaccggccgtaaccgtcgtagttaccagtactagttaaacttacgtaacgtttcggaggacgcgtacccgtaacgggaccggttcacggtacgtccgtttacgtccgtaaccggtcgtaccgtaccgtacgtaccgaaccgacggaacctaaagtaccggttaaccgtcgttaacgaacggtaaccttcgggacggtaacggtacgggaacccgggtacgggaacgggaacggttacgggaacccggttagtaaccgttaacgtaacgtttaacgtcttaaccgggtctaacgtacgtacggtaacgtaaacgttaccggagggtttaacgccggtttacgttacggttaccggttaaacggttcggttaacccgggggtaacggaccgggtaaacccggg

SEQ ID NO: 66943 - DNA, 733 bp, Homo sapiens
  misc_feature: GYAE6OF01CYLXG.49.73.G07.1.454.CMB.1.raw
  modified_base (114)..(114): a, c, t, g, unknown or other
  misc_feature (114)..(114): n is a, c, g, or t
  modified_base (138)..(138): a, c, t, g, unknown or other
  misc_feature (138)..(138): n is a, c, g, or t
  modified_base (198)..(198): a, c, t, g, unknown or other
  misc_feature (198)..(198): n is a, c, g, or t
  modified_base (532)..(532): a, c, t, g, unknown or other
  misc_feature (532)..(532): n is a, c, g, or t
tcagagtcgagagacacgaccggtgctcgatttagctctacgctcagggcacgaccggtgctcgtttagagagagtgtgttgggttggggtggtccaggagcagaactctggtntctcaccatcggcctggatccctntacttcctcccctctcactctctgcacagactctgacggtcctctagtgagctgaccacncgcccaccgtggtgtctgtacgtccgtacgaggacgacgtaccggacctaagtactcctaccgtgtactcgttaggagtagtcgtacgtacttacgaaccgtaaaaggacctaaagttacgtgttaacccgtttacgtaccggtaacaaccgacgaaaccggaaccggtcccggaacggtaccccgtaacccggttccccgttaggtttacccttaaggtactttaaccgtttaaagtttaagtaaacgttaccggttaggacggtccgggtacccgttagggacccgtacccgttaggaccgtcgttacttccgcgtcgtcctacgcgtaccncgtacgacgtacaacgtacgtaccgtacgttacgacctacgtacgtacggtacggtaacggtccgggacgtaacggacggaacggtacggtacctaggtaacttacgttcgacgtatacggtactaagaccgtcgtactaaggtccggacgttccttaacgttcggtttcggaccgttacgggttcgggacggtaaccggg

SEQ ID NO: 66944 - DNA, 685 bp, Homo sapiens
  misc_feature: GYAE6OF01EBS55.49.73.G07.1.454.CMB.1.raw
  modified_base (118)..(118): a, c, t, g, unknown or other
  misc_feature (118)..(118): n is a, c, g, or t
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (378)..(378): a, c, t, g, unknown or other
  misc_feature (378)..(378): n is a, c, g, or t
tcagagtcgagagacacgaccggtgctcgatttagctctacgctcagggcacgaccggtgctcgtttagagagagtgtgttgggtttgggggtggtccaggaggcagaactctgggtntctcaccatggcctggactccctctacttcctcccctcctcactctctgcacagactcgtggacgtcctcctagtgacgtctcgacaccncgcccaccctgggtntctggtctcctgaggacaggccggccagtactccgacctgtccgtcgtaggagtatcgactagttacgaacgaaactactaatacgttcgtacttacggtacgtaccgtaacggacgaagaccgtacgacggccgtaccggtccctgttctagtntacgtaattaagtaacgtcgttagagaccggtcgtaccgacggtacccgagacgtacgtcttactccggtcgtacctaccgcgtacctacgtacgaacctaaccgaacgtagtaacctacgttacgactacgtgacggtacggtacgggtacggacgacggacgggaccggtcggtacgtacgtaactttacttacggtacgtacgtacgtacaacggtacctacggtagtacggtttcgcggttaacccgttcgtttccggttaacggttacggttaccgggtcggggaacccgggttaacccggg

SEQ ID NO: 66945 - DNA, 690 bp, Homo sapiens
  misc_feature: GYAE6OF01EYWNF.49.73.G07.1.454.CMB.1.raw
  modified_base (117)..(117): a, c, t, g, unknown or other
  misc_feature (117)..(117): n is a, c, g, or t
  modified_base (139)..(139): a, c, t, g, unknown or other
  misc_feature (139)..(139): n is a, c, g, or t
  modified_base (262)..(262): a, c, t, g, unknown or other
  misc_feature (262)..(262): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
tcagagtcgagagacacgaccggtgctcgatttagctctacgctcagggcacgaccggtgctcgtttagagagagtgtgttgggtttggggtggtccaggaggcagaactctgggtntcctcaccatggctgatccctntacttcctccccctctcactctctgcacagacctctggacgtcctcctagtcgaacgctacgaaccacaccggtcccaccgttcggtgttctgtactcctagacgtacgagaccgtcagtacncctaccgtgtcctcgaggtacgtagtcacttagtaccgaacgaaagacttaagttccgttagttacccgtttacgcggtaacccgagaacgtagaacccggtcgaaccggcccgtaccggtcccttagtcttacgacttactagttaaanacgtntacggaagcgtacgcgacgcgtagatcgtnttccgngtaccgctacgtanccgtacacgtacgaactacgtacgtaccgagtaccgactacgttggaggtcggtaccggaccgtaggaacggttaacggcccgtaggtacgttaacgttaacgtccgttacgtcggtaacgcttacgaggacccgttaataccgggttaaggttcggtaccgtactttaccgggtttacttacgggttaccggtaacggttccccggggaagggtaaccccgg

SEQ ID NO: 66946 - DNA, 774 bp, Homo sapiens
  misc_feature: GYAE6OF01ARHCX.49.73.G07.1.454.CMB.1.raw
  modified_base (157)..(157): a, c, t, g, unknown or other
  misc_feature (157)..(157): n is a, c, g, or t
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (286)..(286): a, c, t, g, unknown or other
  misc_feature (286)..(286): n is a, c, g, or t
  modified_base (519)..(519): a, c, t, g, unknown or other
  misc_feature (519)..(519): n is a, c, g, or t
tcagagtcgagagacacgaccggtgctcgatttagctctacgctcagggcgacgaccggtgctcgtttagacgagagtggtggttcgggtttggggggtcgggtccagggaaggcctaggaaactcgtgggtgtcgtcaccatggcctggatccctntacttccaccccctcgtcactctactcgaccactagactctagacggtcccttactatggagctagacaacncgcccaccgttggtctctgtcgtcccnggaacggacaggccggtaccaagttcaccnccgtggtcctacggtggactagtcgactacgttaccgacgtaaacgtactaagttaacgtcgtacgtttaacggtaccggtaacacgacgaaacggttaccgaaccggtacggacccgtaccgggtcccccttaggttaccttacggtaactaccttaagtttaaacgtaaacgttccttaacggaacggtacggtccctacggaacccggtaccctaggacgtaaccggttnttccggtacctcggtactaccgacgtccgaccggaacgtaccgtaaactacgtacgttaccgacgttaccaacgtcgttaacgacgggttcggaaccgggtcccgaagtaccgggaacggtacggtaccgttacaccggtaactttagtacccgtgggtaactaccgtacgaactacggtccgtacgaaggtttccggacccgtcgttaaccttcggtacgttaccgttacccgggaacgggtcggtaaacccgg

SEQ ID NO: 66947 - DNA, 157 bp, Homo sapiens
  misc_feature: GYAE6OF02GQ9WY.49.73.G07.1.454.CMB.1.raw
  modified_base (157)..(157): a, c, t, g, unknown or other
  misc_feature (157)..(157): n is a, c, g, or t
tcagagtcgagagacacgaccggtgctcgatttagctctacgctcagggcacgaccggtgctcgatttagtcacgcgagaaggaagggctggccctgacgtgttctgttcccaccctcctctctctcgactctgagcgggctggcaaggcgcatagn

SEQ ID NO: 66948 - DNA, 215 bp, Homo sapiens
  misc_feature: GYAE6OF02GI6P7.49.73.G07.1.454.CMB.1.raw
  modified_base (208)..(215): a, c, t, g, unknown or other
  misc_feature (208)..(215): n is a, c, g, or t
tcagagtcgagagacacgaccggtgctcgatttagctctacgctcagggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnn

SEQ ID NO: 66949 - DNA, 208 bp, Homo sapiens
  misc_feature: GYAE6OF02JIDH3.49.73.G07.1.454.CMB.1.raw
  modified_base (207)..(208): a, c, t, g, unknown or other
  misc_feature (207)..(208): n is a, c, g, or t
tcagagtcgagagacacgaccggtgctcgatttagctctacgctcagggcacgaccggtgctcgatttagagagagtgtgttgggtttgggggaagaggaagactgacggtccccaggagttcaggtgctgggcacagcggccctgggctgcctggtcaaggactacttcctctctcgactctgagcgggctggcaaggcgcatagnn

SEQ ID NO: 66950 - DNA, 159 bp, Homo sapiens
  misc_feature: GYAE6OF02JCTFT.49.73.G07.1.454.CMB.1.raw
  modified_base (156)..(159): a, c, t, g, unknown or other
  misc_feature (156)..(159): n is a, c, g, or t
tcagagtcgagagacacgaccggtgctcgatttagctctacgctcagggcacgaccggtgctcgatttagtcacgcgagaaggaagggctggccctgacgtgttctgttcccgcctcctctctctcgactctgagcgggctggcaaggcgcatagnnnn

SEQ ID NO: 66951 - DNA, 157 bp, Homo sapiens
  misc_feature: GYAE6OF02G9ZTN.49.73.G07.1.454.CMB.1.raw
  modified_base (156)..(157): a, c, t, g, unknown or other
  misc_feature (156)..(157): n is a, c, g, or t
tcagagtcgagagacacgaccggtgctcgatttagctctacgctcagggcacgaccggtgctcgatttagtcacgcgagaaggaagggctggccctgacgtgttctgttcccgcctcctctctctcgactctgagcgggctggcaaggcgcatagnn

SEQ ID NO: 66952 - DNA, 161 bp, Homo sapiens
  misc_feature: GYAE6OF02GX25E.49.73.G07.1.454.CMB.1.raw
  modified_base (160)..(161): a, c, t, g, unknown or other
  misc_feature (160)..(161): n is a, c, g, or t
tcagagtcgagagacacgaccggtgctcgatttagctctacgctcagggcacgaccggtgctcgatttagtcacgcgagaaagggaaggggctggccctgacgtgttctgttcccaccctcctctctctcgactctgagcgggctggcaaggcgcatagnn

SEQ ID NO: 66953 - DNA, 160 bp, Homo sapiens; identical to SEQ ID NO: 66594
  misc_feature: GYAE6OF02IVRXH.49.73.G07.1.454.CMB.1.raw
  modified_base (160)..(160): a, c, t, g, unknown or other
  misc_feature (160)..(160): n is a, c, g, or t

SEQ ID NO: 66954 - DNA, 178 bp, Homo sapiens
  misc_feature: GYAE6OF02G3H7T.49.73.G07.1.454.CMB.1.raw
  modified_base (177)..(178): a, c, t, g, unknown or other
  misc_feature (177)..(178): n is a, c, g, or t
tcagagtcgagagacacgaccggtgctcgatttagctctacgctcagggtagctctacgctcagggcacgaccggtgctcgatttagtcacgcgagaaagggaaggggctggccctgacgtgtttctgttccaccctcctctctctcgactctgagcgggctggcaaggcgcatagnn

SEQ ID NO: 66955 - DNA, 165 bp, Homo sapiens
  misc_feature: GYAE6OF02H0VI0.49.73.G07.1.454.CMB.1.raw
  modified_base (158)..(165): a, c, t, g, unknown or other
  misc_feature (158)..(165): n is a, c, g, or t
tcagagtcgagagacacgaccggtgctcgatttagctctacgctcagggcacgaccggtgctcgatttagtcacgcgagaaaggaaggggctggccctgacgtgttctgttcccacctcctctctctcgactctgagcgggctggcaaggcgcatagnnnnnnnn

SEQ ID NO: 66956 - DNA, 208 bp, Homo sapiens
  misc_feature: GYAE6OF02IHP7S.49.73.G07.1.454.CMB.1.raw
  modified_base (206)..(208): a, c, t, g, unknown or other
  misc_feature (206)..(208): n is a, c, g, or t
tcagagtcgagagacacgaccggtgctcgatttagctctacgctcaggacacgaccggtgctcgatttagagagagtgtgttgggtttggggaagaggaagactgacggtccccaggagttcaggtgctgggcacagcggccctgggctgcctggtcaaggactacttcctctctcgactctgagcgggctggcaaggcgcatagnnn

SEQ ID NO: 66957 - DNA, 156 bp, Homo sapiens
  misc_feature: GYAE6OF02G6VZR.49.73.G07.1.454.CMB.1.raw
  modified_base (156)..(156): a, c, t, g, unknown or other
  misc_feature (156)..(156): n is a, c, g, or t
tcagagtcgagagacacgaccggtgctcgatttagctctacgctcagggcacgaccggtgctcgatttagtcacgcgagaagggaaaggtggccctgacgtgttctgttcccgccctcctctctctcgactctgagcggctggcaaggcgcatagn

SEQ ID NO: 66958 - DNA, 208 bp, Homo sapiens; identical to SEQ ID NO: 66604
  misc_feature: GYAE6OF02GC767.49.73.G07.1.454.CMB.1.raw
  modified_base (208)..(208): a, c, t, g, unknown or other
  misc_feature (208)..(208): n is a, c, g, or t

SEQ ID NO: 66959 - DNA, 161 bp, Homo sapiens; identical to SEQ ID NO: 66655
  misc_feature: GYAE6OF02HVLTR.49.73.G07.1.454.CMB.1.raw
  modified_base (160)..(161): a, c, t, g, unknown or other
  misc_feature (160)..(161): n is a, c, g, or t

SEQ ID NO: 66960 - DNA, 177 bp, Homo sapiens
  misc_feature: GYAE6OF02IB38M.49.73.G07.1.454.CMB.1.raw
  modified_base (177)..(177): a, c, t, g, unknown or other
  misc_feature (177)..(177): n is a, c, g, or t
tcagagtcgagagacacgaccggtgctcgatttagctctacgctcagggtagctctacgctcagggcacgaccggtgctcgatttagtcacgcgagaaagggaaggggctggccctgacgtgttctgttcccaccctcctctctctcgactctgagcgggctggcaaggcgcatagn

SEQ ID NO: 66961 - DNA, 207 bp, Homo sapiens
  misc_feature: GYAE6OF02H9EHW.49.73.G07.1.454.CMB.1.raw
  modified_base (206)..(207): a, c, t, g, unknown or other
  misc_feature (206)..(207): n is a, c, g, or t
tcagagtcgagagacacgaccggtgctcgatttagctctacgctcagggcacgaccggtgctcgatttagagagagtgtgttgggtttggggaagaggaagactgacggtccccaggagttcaggtgctgggcacagcggccctgggctgcctggtcaaggactacttcctcgtagcactctgagcgggctggcaaggcgcatagnn

SEQ ID NO: 66962 - DNA, 163 bp, Homo sapiens; identical to SEQ ID NO: 66600
  misc_feature: GYAE6OF02FTO0J.49.73.G07.1.454.CMB.1.raw
  modified_base (162)..(163): a, c, t, g, unknown or other
  misc_feature (162)..(163): n is a, c, g, or t

SEQ ID NO: 66963 - DNA, 210 bp, Homo sapiens
  misc_feature: GYAE6OF02HQMVQ.49.73.G07.1.454.CMB.1.raw
  modified_base (208)..(210): a, c, t, g, unknown or other
  misc_feature (208)..(210): n is a, c, g, or t
tcagagtcgagagacacgaccggtgctcgatttagctctacgctcagggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnn

SEQ ID NO: 66964 - DNA, 293 bp, Homo sapiens
  misc_feature: GYAE6OF02G1A9D.49.73.G07.1.454.CMB.1.raw
  modified_base (203)..(203): a, c, t, g, unknown or other
  misc_feature (203)..(203): n is a, c, g, or t
  modified_base (229)..(239): a, c, t, g, unknown or other
  misc_feature (229)..(239): n is a, c, g, or t
  modified_base (241)..(293): a, c, t, g, unknown or other
  misc_feature (241)..(293): n is a, c, g, or t
tcagagtcgagagacacgaccggtgctcgatttagctctacgctcaggggccacggacccggtgctcgatttagagagagtgtcgttcgggtttgggggaagaggaagacgtcgacgggtcccccaggagttcaggtgctcgggcacagcgggccctgggctgccctaggtcaagggactacttcctctcttcgactctgacncgggctggctaaggcgacatacgacnnnnnnnnnnngnnnnnnnnnnnnnnnnnnnnnnnnnnnnnnnnnnnnnnnnnnnnnnnnnnnnn

SEQ ID NO: 66965 - DNA, 512 bp, Homo sapiens
  misc_feature: GYAE6OF02G6CRZ.49.73.G07.1.454.CMB.1.raw
  modified_base (504)..(504): a, c, t, g, unknown or other
  misc_feature (504)..(504): n is a, c, g, or t
tcagagtcgagagacacgaccggtgctcgatttagctctacgctcagggcacgaccggtgctcgtttagagagagtgtgttgggtttgggggtgggttccaggaggcagaactctgggtgtctcaccatgggcctggatccctctacttctccccctcctcactctctgcacagactctgaggcctcctatgagctgacacagccaccctggtgtctgtgtcctcaggacagacggccagtatcacctgctctggagatgcattgccaaaagcaatatgtcttacgtggtaccagcgagaacgccaggccaggcccctgtctgatcatttataaagactttgagagggcctcgacgggaccctgacgcgattctcgtggctccgagctcgagcgacaacagtcacgttgaccatcagtcgacgtccgggcaggacggacgaggctagtactattactgtacagtcatcgagacagtagtcgactacttctcgtcgtagttcggnggtaacgg

SEQ ID NO: 66966 - DNA, 210 bp, Homo sapiens; identical to SEQ ID NO: 66963
  misc_feature: GYAE6OF02HICXL.49.73.G07.1.454.CMB.1.raw
  modified_base (208)..(210): a, c, t, g, unknown or other
  misc_feature (208)..(210): n is a, c, g, or t

SEQ ID NO: 66967 - DNA, 179 bp, Homo sapiens
  misc_feature: GYAE6OF02IQ5VC.49.73.G07.1.454.CMB.1.raw
  modified_base (178)..(179): a, c, t, g, unknown or other
  misc_feature (178)..(179): n is a, c, g, or t
tcagagtcgagagacacgaccggtgctcgatttagctctacgctcagggtagctctacgctcagggcacgaccggtgctcgatttagtcacgcgagaaagggaaaggggctggccctgacgtgtttctgttcccacctcctctctctcgactctgagcgggctggcaaggcgcatagnn

SEQ ID NO: 66968 - DNA, 165 bp, Homo sapiens
  misc_feature: GYAE6OF02G5WYW.49.73.G07.1.454.CMB.1.raw
  modified_base (129)..(165): a, c, t, g, unknown or other
  misc_feature (129)..(165): n is a, c, g, or t
tcagagtcgagagacacgaccggtgctcgatttagctctacgctcagggcacgaccggtgctcgatttagatagctctcgttgggtttggtcctatccccgtgagcgggctaggcaaggcgccaatagnnnnnnnnnnnnnnnnnnnnnnnnnnnnnnnnnnnnn

SEQ ID NO: 66969 - DNA, 293 bp, Homo sapiens
  misc_feature: GYAE6OF02FT79N.49.73.G07.1.454.CMB.1.raw
  modified_base (287)..(293): a, c, t, g, unknown or other
  misc_feature (287)..(293): n is a, c, g, or t
tcagagtcgagagacacgaccggtgctcgatttagctctacgctcagggcacgaccggtgctcgatttagctctacgctcagggcgacgaccggtgctcgatttacgctctacgctcagggtcgacgaccggtgctcgagtttacgagagagtgtgttgggtttgggggaacgaggaagactgacggtcccccaggagttcaggtgcgtgggcacagcggccctgggctgcctggtcaaggactacgttcctctctcgactctgagcgggctggcaaggcgcatagnnnnnnn

SEQ ID NO: 66970 - DNA, 161 bp, Homo sapiens; identical to SEQ ID NO: 66591
  misc_feature: GYAE6OF02FGMDZ.49.73.G07.1.454.CMB.1.raw
  modified_base (161)..(161): a, c, t, g, unknown or other
  misc_feature (161)..(161): n is a, c, g, or t

SEQ ID NO: 66971 - DNA, 163 bp, Homo sapiens
  misc_feature: GYAE6OF02FWQZD.49.73.G07.1.454.CMB.1.raw
  modified_base (161)..(163): a, c, t, g, unknown or other
  misc_feature (161)..(163): n is a, c, g, or t
tcagagtcgagagacacgaccggtgctcgatttagctctacgctcagggcacgaccggtgctcgatttagtcacgcgagaaagggaaaggggctggccctgacgtgttctgttcccgccctcctctctctcgactctgagcgggctggcaaggcgcatagnnn

SEQ ID NO: 66972 - DNA, 491 bp, Homo sapiens
  misc_feature: GYAE6OF02IT5PK.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggtacggg

SEQ ID NO: 66973 - DNA, 298 bp, Homo sapiens
  misc_feature: GYAE6OF02G6CZE.49.73.G07.1.454.CMB.1.raw
  modified_base (290)..(298): a, c, t, g, unknown or other
  misc_feature (290)..(298): n is a, c, g, or t
tcagagtcgagagacacgaccggtgctcgatttagctctacgctcagggcacgaccggtgctcgatttagctctacgctcagggcgacgaccggtgctcgatttacgctctacgctcagggtcgacgaccggtgctcgagtttacgagacgagtgtgttgggtttgggggaacgaggaagacgtcgacggtcccccaggacgttcaggtgcgtgggcacagcggcctgggctgcctggtcaaggactacgttcctctctcgactctgagcgggctggcaaggcgcatagnnnnnnnnn

SEQ ID NO: 66974 - DNA, 205 bp, Homo sapiens
  misc_feature: GYAE6OF02F0GML.49.73.G07.1.454.CMB.1.raw
  modified_base (194)..(205): a, c, t, g, unknown or other
  misc_feature (194)..(205): n is a, c, g, or t
tcagagtcgagagacacgaccggtgctcgatttagctctacgctcagggcacgaccggtgctcgatttagctctacgctcagggcacgaccggtgctcgatttagtcacgcgagaagggaaggggctggccctgacgtgtttctgttcccacctcctctctctcgactctgagcgggctggcaaggcgcatagnnnnnnnnnnnn

SEQ ID NO: 66975 - DNA, 488 bp, Homo sapiens
  misc_feature: GYAE6OF02I3Y11.49.73.G07.1.454.CMB.1.raw
  modified_base (452)..(452): a, c, t, g, unknown or other
  misc_feature (452)..(452): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggccccctgtgttggtgatgtataaagacactgagaggccctcagggatccctgagcgattctctggctccaggtcagggacaacggtcacattggccatcagtggagtccaggcagaggacgaggctgactattatgtcatcaacngacacattgtacttatgtcttcggactgcgtaaccg

SEQ ID NO: 66976 - DNA, 131 bp, Homo sapiens
  misc_feature: GYAE6OF02HUP6W.49.73.G07.1.454.CMB.1.raw
  modified_base (131)..(131): a, c, t, g, unknown or other
  misc_feature (131)..(131): n is a, c, g, or t
tcagagtcgagagacacgaccggtgctcgatttagctctacgctcagggcacgaccggtgctcgatttagctagtcactctgttcccgcctcctctctctcgactctgagcgggctggcaaggcgcatagn

SEQ ID NO: 66977 - DNA, 210 bp, Homo sapiens; identical to SEQ ID NO: 66963
  misc_feature: GYAE6OF02FH09S.49.73.G07.1.454.CMB.1.raw
  modified_base (208)..(210): a, c, t, g, unknown or other
  misc_feature (208)..(210): n is a, c, g, or t

SEQ ID NO: 66978 - DNA, 208 bp, Homo sapiens; identical to SEQ ID NO: 66604
  misc_feature: GYAE6OF02JB7F3.49.73.G07.1.454.CMB.1.raw
  modified_base (208)..(208): a, c, t, g, unknown or other
  misc_feature (208)..(208): n is a, c, g, or t

SEQ ID NO: 66979 - DNA, 164 bp, Homo sapiens; identical to SEQ ID NO: 66630
  misc_feature: GYAE6OF02IS509.49.73.G07.1.454.CMB.1.raw
  modified_base (163)..(164): a, c, t, g, unknown or other
  misc_feature (163)..(164): n is a, c, g, or t

SEQ ID NO: 66980 - DNA, 491 bp, Homo sapiens
  misc_feature: GYAE6OF02INIYR.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggtcagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggtacggg

SEQ ID NO: 66981 - DNA, 209 bp, Homo sapiens; identical to SEQ ID NO: 66605
  misc_feature: GYAE6OF02HBSLM.49.73.G07.1.454.CMB.1.raw
  modified_base (208)..(209): a, c, t, g, unknown or other
  misc_feature (208)..(209): n is a, c, g, or t

SEQ ID NO: 66982 - DNA, 179 bp, Homo sapiens
  misc_feature: GYAE6OF02ILBWU.49.73.G07.1.454.CMB.1.raw
  modified_base (179)..(179): a, c, t, g, unknown or other
  misc_feature (179)..(179): n is a, c, g, or t
tcagagtcgagagacacgaccggtgctcgatttagctctacgctcagggtagctctacgctcagggcacgaccggtgctcgatttagtcacgcgagaaagggaaaggggctggccctgacgtgtttctgttcccgccctcctctctctcgactctgagcgggctggcaaggcgcatagn

SEQ ID NO: 66983 - DNA, 168 bp, Homo sapiens
  misc_feature: GYAE6OF02G1O68.49.73.G07.1.454.CMB.1.raw
  modified_base (161)..(168): a, c, t, g, unknown or other
  misc_feature (161)..(168): n is a, c, g, or t
tcagagtcgagagacacgaccggtgctcgatttagctctacgctcagggcacgaccggtgctcgatttagtcacgcgagaaagggaaagggctggccctgacgtgtttctgttcccaccctcctctctctcgactctgagcgggctggcaaggcgcatagnnnnnnnn

SEQ ID NO: 66984 - DNA, 162 bp, Homo sapiens; identical to SEQ ID NO: 66590
  misc_feature: GYAE6OF02HQLEC.49.73.G07.1.454.CMB.1.raw
  modified_base (162)..(162): a, c, t, g, unknown or other
  misc_feature (162)..(162): n is a, c, g, or t

SEQ ID NO: 66985 - DNA, 180 bp, Homo sapiens
  misc_feature: GYAE6OF02HFZS0.49.73.G07.1.454.CMB.1.raw
  modified_base (178)..(180): a, c, t, g, unknown or other
  misc_feature (178)..(180): n is a, c, g, or t
tcagagtcgagagacacgaccggtgctcgatttagctctacgctcagggtagctctacgctcagggcacgaccggtgctcgatttagtcacgcgagaaagggaaaggggctggccctgacgtgtttctgttcccgccctctctctctcgactctgagcgggctggcaaggcgcatagnnn

SEQ ID NO: 66986 - DNA, 208 bp, Homo sapiens; identical to SEQ ID NO: 66604
  misc_feature: GYAE6OF02GI9LD.49.73.G07.1.454.CMB.1.raw
  modified_base (208)..(208): a, c, t, g, unknown or other
  misc_feature (208)..(208): n is a, c, g, or t

SEQ ID NO: 66987 - DNA, 499 bp, Homo sapiens
  misc_feature: GYAE6OF02JM48B.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgagggacccctgagcgattctctggctcagctcagcgacaacagtcacgttgaccatcagtggagtccgggcaggaggacgaggctagactagttactgtcagtcatcaagacaggtagtgcacttcgtgttcgtagttcggcggtaacggg

SEQ ID NO: 66988 - DNA, 181 bp, Homo sapiens
  misc_feature: GYAE6OF02GBEMO.49.73.G07.1.454.CMB.1.raw
  modified_base (179)..(181): a, c, t, g, unknown or other
  misc_feature (179)..(181): n is a, c, g, or t
tcagagtcgagagacacgaccggtgctcgatttagctctacgctcagggtagctctacgctcagggcacgaccggtgctcgatttagtcacgcgagaaagggaaaggggctggccctgacgtgtttctgttcccgccctcctctctctcgactctgagcgggctggcaaggcgcatagnnn

SEQ ID NO: 66989 - DNA, 179 bp, Homo sapiens; identical to SEQ ID NO: 66982
  misc_feature: GYAE6OF02HF5O6.49.73.G07.1.454.CMB.1.raw
  modified_base (179)..(179): a, c, t, g, unknown or other
  misc_feature (179)..(179): n is a, c, g, or t

SEQ ID NO: 66990 - DNA, 254 bp, Homo sapiens
  misc_feature: GYAE6OF02GIZ8K.49.73.G07.1.454.CMB.1.raw
  modified_base (247)..(254): a, c, t, g, unknown or other
  misc_feature (247)..(254): n is a, c, g, or t
tcagagtcgagagacacgaccggtgctcgatttagctctacgctcagggcacgaccggtgctcgatttagtagtgtagattccgcgggcacgaccggtgctcgatttagctctacgctcgaggcacgaccggtgctcgatttagctctacgctcgagggcacgaccggtgctcgatttagtacacacacttagggattgggcaccctcctctctctcgactctgagcgggctggcaaggcgcatagnnnnnnnn

SEQ ID NO: 66991 - DNA, 161 bp, Homo sapiens; identical to SEQ ID NO: 66591
  misc_feature: GYAE6OF02HN11V.49.73.G07.1.454.CMB.1.raw
  modified_base (161)..(161): a, c, t, g, unknown or other
  misc_feature (161)..(161): n is a, c, g, or t

SEQ ID NO: 66992 - DNA, 164 bp, Homo sapiens
  misc_feature: GYAE6OF02GDRAI.49.73.G07.1.454.CMB.1.raw
  modified_base (163)..(164): a, c, t, g, unknown or other
  misc_feature (163)..(164): n is a, c, g, or t
tcagagtcgagagacacgaccggtgctcgatttagctctacgctcagggcacgaccggtgctcgatttagtctgacgtcaaagggaaagggggctggccctgacgtgtttctgttcccaccctcctctctctcgactctgagcgggctggcaaggcgcatagnn

SEQ ID NO: 66993 - DNA, 133 bp, Homo sapiens; identical to SEQ ID NO: 66724
  misc_feature: GYAE6OF02HLFWG.49.73.G07.1.454.CMB.1.raw
  modified_base (132)..(133): a, c, t, g, unknown or other
  misc_feature (132)..(133): n is a, c, g, or t

SEQ ID NO: 66994 - DNA, 491 bp, Homo sapiens
  misc_feature: GYAE6OF02H8GV3.49.73.G07.1.454.CMB.1.raw
  modified_base (468)..(468): a, c, t, g, unknown or other
  misc_feature (468)..(468): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgctactggtaccagcagaagccaggccaggccctgtcttgatcatttataaagactttgagagggctcgaggacccctgagcgattctctggctccagctcagcgacaacagtcacgttgaccatcagtgagtccgggcagaggacgaggctgactatactgtcagtcatcagacagtagtggcacttcgngttcgtattcgggaggtaacggg

SEQ ID NO: 66995 - DNA, 163 bp, Homo sapiens; identical to SEQ ID NO: 66618
  misc_feature: GYAE6OF02FXDXK.49.73.G07.1.454.CMB.1.raw
  modified_base (163)..(163): a, c, t, g, unknown or other
  misc_feature (163)..(163): n is a, c, g, or t

SEQ ID NO: 66996 - DNA, 210 bp, Homo sapiens
  misc_feature: GYAE6OF02I8TC9.49.73.G07.1.454.CMB.1.raw
  modified_base (209)..(210): a, c, t, g, unknown or other
  misc_feature (209)..(210): n is a, c, g, or t
tcagagtcgagagacacgaccggtgctcgatttagctctacgctcagggcacgaccggtgctcgatttagagagagtgtgttgggtttgggggaagaggaagactgacggtcccccaggagttcaggtgctgggcacagcggccctgggctgcctggtcaaggactacttcctctctccgactctgagcgggctggcaaggcgcatagnn

SEQ ID NO: 66997 - DNA, 563 bp, Homo sapiens
  misc_feature: GYAE6OF02JGKCC.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcgaggacaggacggccagtactcacctgctctggagatgcattgaccaaagcaaatatgcttactggtaccagcagaagccaggccacggcccctgtcttgatctattaataaagtactttagagacggcctcgacggaccctgagcgtatctctcggctccgagctcacgcgaacaacgagtctaccgttgaacccatacgaggtacggacgtccgggacaacggaacggtacgaggccgtagtacttaagttacgtcgtcgtagtcagtacgaaggaactaggtacgtcggtactaccgtttacgttgttacgttaacgttcgggaccggtaacggg

SEQ ID NO: 66998 - DNA, 208 bp, Homo sapiens; identical to SEQ ID NO: 66604
  misc_feature: GYAE6OF02HTCF4.49.73.G07.1.454.CMB.1.raw
  modified_base (208)..(208): a, c, t, g, unknown or other
  misc_feature (208)..(208): n is a, c, g, or t

SEQ ID NO: 66999 - DNA, 209 bp, Homo sapiens
  misc_feature: GYAE6OF02HYLKJ.49.73.G07.1.454.CMB.1.raw
  modified_base (208)..(209): a, c, t, g, unknown or other
  misc_feature (208)..(209): n is a, c, g, or t
tcagagtcgagagacacgaccggtgctcgatttagctctacgctcagggcacgaccggtgctcgatttagagagagtgtgttgggtttgggggaagaggaagactgacggtccccccaggagttcaggtgctgggcacagcggccctgggctgcctggtcaaggactacttcctctctcgacctgagcgggctggcaaggcgcatagnn

SEQ ID NO: 67000 - DNA, 194 bp, Homo sapiens
  misc_feature: GYAE6OF02FJUSN.49.73.G07.1.454.CMB.1.raw
  modified_base (168)..(194): a, c, t, g, unknown or other
  misc_feature (168)..(194): n is a, c, g, or t
tcagagtcgagagacacgaccggtgctcgatttagctctacgctcaggggcacgaccggtgctcgatttagtcacgcgagaaagggaaagggggctggccctggacgtgtttctgttcccgccctcctctctctcgactctgagcggggctgggccaaggcgcatagnnnnnnnnnnnnnnnnnnnnnnnnnnn

SEQ ID NO: 67001 - DNA, 491 bp, Homo sapiens
  misc_feature: GYAE6OF02HG8A9.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcgtaacggg

SEQ ID NO: 67002 - DNA, 164 bp, Homo sapiens
  misc_feature: GYAE6OF02FT972.49.73.G07.1.454.CMB.1.raw
  modified_base (161)..(164): a, c, t, g, unknown or other
  misc_feature (161)..(164): n is a, c, g, or t
tcagagtcgagagacacgaccggtgctcgatttagctctacgctcagggcacgaccggtgctcgatttagtcacgcgagaaagggaaggggctggccctgacgtgtttctgttcccgccctcctctctctcgactctgagcgggctggcaaggcgcatagnnnn

SEQ ID NO: 67003 - DNA, 178 bp, Homo sapiens
  misc_feature: GYAE6OF02GI71K.49.73.G07.1.454.CMB.1.raw
  modified_base (178)..(178): a, c, t, g, unknown or other
  misc_feature (178)..(178): n is a, c, g, or t
tcagagtcgagagacacgaccggtgctcgatttagctctacgctcagggtagctctacgctcagggcacgaccggtgctcgatttagtcacgcgagaaagggaaaggggctggccctgacgtgtttctgttcccaccctctctctctcgactctgagcgggctggcaaggcgcatagn

SEQ ID NO: 67004 - DNA, 498 bp, Homo sapiens
  misc_feature: GYAE6OF02IQQ3R.49.73.G07.1.454.CMB.1.raw
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggcccctgtccttgatcatttataaagactttgagtagggcctcgagggacccctgacgcgattctctgctccagctcagcacaacagtcacgttnaccatcagtgagtccggnaggaggacgaggctagactattactgtacagtcatcaagacagtagtggacacttctgtcgtattcggcggtaacggg

SEQ ID NO: 67005 - DNA, 505 bp, Homo sapiens
  misc_feature: GYAE6OF02IGCXI.49.73.G07.1.454.CMB.1.raw
  modified_base (425)..(425): a, c, t, g, unknown or other
  misc_feature (425)..(425): n is a, c, g, or t
  modified_base (496)..(496): a, c, t, g, unknown or other
  misc_feature (496)..(496): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctggtgtctgtgtcctcaggacagaccggccagtatcacctgctctggagatgcattgaccaaagcaatatgcttactggtaccagcagaagccaggccaggcccctgtcttgatcatttataaagtactttgagagggcctcgacgggacccctgagcgtattctctggctccagctcagcgaacaacagtcacgttgaccatcagtggagtccgggnaggaggacgaggctagacttattacgtgtcagtcatcaagacagtagtgctacttcgtgtcgtattcgggnggtaacggg

SEQ ID NO: 67006 - DNA, 213 bp, Homo sapiens
  misc_feature: GYAE6OF02GPLD3.49.73.G07.1.454.CMB.1.raw
  modified_base (183)..(213): a, c, t, g, unknown or other
  misc_feature (183)..(213): n is a, c, g, or t
tcagagtcgagagacacgaccggtgctcgatttagctctacgctcagggtagcgtctacgctcgagggcacgaccggtgctcgatttagtcacgcgagaaagggaaaggggctggccctgaccgtgtttctggttcccgccctcctctctctcgactctgagcgggctggcaaggcgcatagnnnnnnnnnnnnnnnnnnnnnnnnnnnnnnn

SEQ ID NO: 67007 - DNA, 494 bp, Homo sapiens
  misc_feature: GYAE6OF02FXHUX.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgttcgtagttcggcggtaacggg

SEQ ID NO: 67008 - DNA, 197 bp, Homo sapiens
  misc_feature: GYAE6OF02FIUOE.49.73.G07.1.454.CMB.1.raw
  modified_base (196)..(197): a, c, t, g, unknown or other
  misc_feature (196)..(197): n is a, c, g, or t
tcagagtcgagagacacgaccggtgctcgattagctctacgctcaggcacgaccgtgctcgattagagagagtgtgttgggtttgggtaagaggaagactgacggtcccccaggagttcaggtgctggcacagcgcctggctgcctggtcaaggactactcctcgtagcactctgagcggctggcaaggcgcatgnn

SEQ ID NO: 67009 - DNA, 162 bp, Homo sapiens; identical to SEQ ID NO: 66619
  misc_feature: GYAE6OF02FF33V.49.73.G07.1.454.CMB.1.raw
  modified_base (161)..(162): a, c, t, g, unknown or other
  misc_feature (161)..(162): n is a, c, g, or t

SEQ ID NO: 67010 - DNA, 210 bp, Homo sapiens
  misc_feature: GYAE6OF02FHTAB.49.73.G07.1.454.CMB.1.raw
  modified_base (209)..(210): a, c, t, g, unknown or other
  misc_feature (209)..(210): n is a, c, g, or t
tcagagtcgagagacacgaccggtgctcgatttagctctacgctcagggcacgaccggtgctcgatttagagagagtgtgttgggtttgggggaagaggaagactgacggtccccacaggagttcaggtgctgggcacagcggccctgggctgcctggtcaaggactacttcctctctcgactctgagcgggctggcaaggcgcatagnn

SEQ ID NO: 67011 - DNA, 569 bp, Homo sapiens
  misc_feature: GYAE6OF02JBOSC.49.73.G07.1.454.CMB.1.raw
  modified_base (415)..(415): a, c, t, g, unknown or other
  misc_feature (415)..(415): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatccacctgctctggagatgcattgaccaaagcaaatatgcttacgtggtaccagcagaagccgaggttccacggccctgtcttgatctaatttaataaagtactttgagacgggcctacgacggaccctgagcgtattctctgctccagctacagcgacaacacgtacacgttnaccatcgagtggacggtccgggacgaggacggacggaggcgtacgtacttaacgttacgtgtacgacgtccgacgacggaacacggacgtaggtcggtacgttaaggtttacgttacggttacggttacggtttaccggggacgggtaacgggg

SEQ ID NO: 67012 - DNA, 178 bp, Homo sapiens
  misc_feature: GYAE6OF02HHFPA.49.73.G07.1.454.CMB.1.raw
  modified_base (162)..(178): a, c, t, g, unknown or other
  misc_feature (162)..(178): n is a, c, g, or t
tcagagtcgagagacacgaccggtgctcgatttagctctacgctcagggccacgaccggtgctcgatttagtcacgcgagaaagggaaagggggctggccctgacgtgttctgttcccgcctcctctctctcgactctgagcgggctggcaaggcgcatagnnnnnnnnnnnnnnnnn

SEQ ID NO: 67013 - DNA, 524 bp, Homo sapiens
  misc_feature: GYAE6OF02JX4AB.49.73.G07.1.454.CMB.1.raw
  modified_base (380)..(380): a, c, t, g, unknown or other
  misc_feature (380)..(380): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcaagaagccaggccaggcccctgtccttgatcatttataagtactttgagagggcctcgacgggacccctgagcgattctctggctcacnctcagcgacaacagtcacgttgaccatcagtgagtccgggcaggaggacgaggccgtagtaccgttattaccgtgtctagtacacgtacgagacaggtacgtcggtactacgttcgtagttcggtacgtttcggcgggtaacgg

SEQ ID NO: 67014 - DNA, 230 bp, Homo sapiens
  misc_feature: GYAE6OF02JNX4Y.49.73.G07.1.454.CMB.1.raw
  modified_base (221)..(230): a, c, t, g, unknown or other
  misc_feature (221)..(230): n is a, c, g, or t
tcagagtcgagagacacgaccggtgctcgatttagctctacgctcagggctctacgctcagggcacgaccggtgctcgatttagagagagtgtgttgggtttgggggaagtaggaagactgacggtcccccaggagttcaggtgctgggcacagcggcctgggctgcctggtcaaggactacgttctctctcgactctgagcggctggcaaggcgcatagnnnnnnnnnn

SEQ ID NO: 67015 - DNA, 177 bp, Homo sapiens
  misc_feature: GYAE6OF02INYZR.49.73.G07.1.454.CMB.1.raw
  modified_base (177)..(177): a, c, t, g, unknown or other
  misc_feature (177)..(177): n is a, c, g, or t
tcagagtcgagagacacgaccggtgctcgatttagctctacgctcagggtagctctacgctcagggcacgaccggtgctcgatttagtcacgcgagaaagggaaaggggctggccctgacgtgtttctgttcccacctctctctctcgactctgagcgggctggcaaggcgcatagn

SEQ ID NO: 67016 - DNA, 502 bp, Homo sapiens
  misc_feature: GYAE6OF02HFAND.49.73.G07.1.454.CMB.1.raw
  modified_base (419)..(419): a, c, t, g, unknown or other
  misc_feature (419)..(419): n is a, c, g, or t
tcagagtcgagagacacgaccggtgctcgatttagctctacgctcagggcgacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacggccagtatcacctgctctggagatgcattgccaaagcaatatgcttactggtaccagcagagccaggccaggcccctgtcttgatcatttataaagactttgagaggcctcgagggacccctgagcgattctctggctccagctcagcgacaacagtcacgttgaccatcagtggacgtccgggnaggaggacgaggctgacttattactgtcagtcatcgagactagtagtggactacttcgtgttcgtacttcgggcggtaacggg

SEQ ID NO: 67017 - DNA, 494 bp, Homo sapiens
  misc_feature: GYAE6OF02F6PV9.49.73.G07.1.454.CMB.1.raw
  modified_base (464)..(464): a, c, t, g, unknown or other
  misc_feature (464)..(464): n is a, c, g, or t
  modified_base (485)..(485): a, c, t, g, unknown or other
  misc_feature (485)..(485): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgagggacccctgagcgattctctggctccagctcagcgacaacagtcacgttgaccatcagtggacgtccgggcagaggacgaggctgactattactgtcagtcatcagacagtagngcacttctgtcgtagttcggnggtaacggg

SEQ ID NO: 67018 - DNA, 159 bp, Homo sapiens
  misc_feature: GYAE6OF02FV1KU.49.73.G07.1.454.CMB.1.raw
  modified_base (159)..(159): a, c, t, g, unknown or other
  misc_feature (159)..(159): n is a, c, g, or t
tcagagtcgagagacacgaccggtgctcgatttagctctacgctcagggcacgaccggtgctcgatttagtcacgcgagaaagggaagggctggccctgacgtgttctgttcccaccctcctctctctcgactctgagcgggctggcaaggcgcatagn

SEQ ID NO: 67019 - DNA, 162 bp, Homo sapiens; identical to SEQ ID NO: 66590
  misc_feature: GYAE6OF02HVFM5.49.73.G07.1.454.CMB.1.raw
  modified_base (162)..(162): a, c, t, g, unknown or other
  misc_feature (162)..(162): n is a, c, g, or t

SEQ ID NO: 67020 - DNA, 218 bp, Homo sapiens
  misc_feature: GYAE6OF02G77OF.49.73.G07.1.454.CMB.1.raw
  modified_base (211)..(218): a, c, t, g, unknown or other
  misc_feature (211)..(218): n is a, c, g, or t
tcagagtcgagagacacgaccggtgctcgatttagctctacgctcagggcacgaccggtgctcgatttagagagagtgtgttgggtttggggggaagaggaagactgacggtccccccaggagttccaggtgctgggcacagcggccctgggctgcctggtcaaggactacttcctctctcgactctgagcgggctggcaaggcgcatagnnnnnnnn

SEQ ID NO: 67021 - DNA, 494 bp, Homo sapiens
  misc_feature: GYAE6OF02GWTTI.49.73.G07.1.454.CMB.1.raw
  modified_base (422)..(422): a, c, t, g, unknown or other
  misc_feature (422)..(422): n is a, c, g, or t
  modified_base (485)..(485): a, c, t, g, unknown or other
  misc_feature (485)..(485): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcgacgggacccctgagcgattctctggctccagctcagcgacaacagtcacgttgaccatcagtggagtccgggnagaggacgagctgactattactgtcagtcatcagacagtagtgacacttctgtcgtattcggnggtaacggg

SEQ ID NO: 67022 - DNA, 200 bp, Homo sapiens
  misc_feature: GYAE6OF02GBN8W.49.73.G07.1.454.CMB.1.raw
  modified_base (196)..(200): a, c, t, g, unknown or other
  misc_feature (196)..(200): n is a, c, g, or t
tcagagtcgagagacacgaccggtgctcgatttagctctacgctcagggcacgaccggtgctcgatttagctctacgctcagggcacgaccggtgctcgatttagtcacgcgagaaagggaaggggctggccctgacgtgtttctgttcccaccctcctctctctcgactctgagcgggctggcaaggcgcatagnnnnn

SEQ ID NO: 67023 - DNA, 616 bp, Homo sapiens
  misc_feature: GYAE6OF02IJSUB.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgccaaagcaatatgtcttactggtaccagcagaagccaggccacggcccctgtcttgatcatttaataaagtactttgagaggccctcgacggaccctagacgcgtacttcgtcgtcggcctccgagtcctacgacgggaaccaacgtacgtacctaccttcgacctatacgtaggtcgggacgccccggacgaacggacggacggacggtacgtacgtaacgtaactttaccgtacggtacgtaccggtacccgacgaacggtaccgaacggaccgtagggtacggtaccgttaaggtttacgttacggtttacggttacggttccggggtaccggggtagggtaacccgg

SEQ ID NO: 67024 - DNA, 163 bp, Homo sapiens
  misc_feature: GYAE6OF02FU69A.49.73.G07.1.454.CMB.1.raw
  modified_base (160)..(163): a, c, t, g, unknown or other
  misc_feature (160)..(163): n is a, c, g, or t
tcagagtcgagagacacgaccggtgctcgatttagctctacgctcagggcacgaccggtgctcgatttagtcacgcgagaaagggaaagggctggccctgacgtgtttctgttcccacctcctctctctcgactctgagcgggctggcaaggcgcatagnnnn

SEQ ID NO: 67025 - DNA, 163 bp, Homo sapiens; identical to SEQ ID NO: 66716
  misc_feature: GYAE6OF02IWETX.49.73.G07.1.454.CMB.1.raw
  modified_base (163)..(163): a, c, t, g, unknown or other
  misc_feature (163)..(163): n is a, c, g, or t

SEQ ID NO: 67026 - DNA, 505 bp, Homo sapiens
  misc_feature: GYAE6OF02FRUNH.49.73.G07.1.454.CMB.1.raw
  modified_base (497)..(497): a, c, t, g, unknown or other
  misc_feature (497)..(497): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggttaccagcagaagccaggccaggcccctgtcttgatcatttataaagtacttttgagagggcctcgacgggacccctgacgcgattctctggctccagctcagcgacaacgagtcacgttgaccatcgagtggacgtccgggcaggaggacgagggctgactagttactgtcagtcatcgagacagtagtgcacgttctgtcgtagttcggnggtaacgg

SEQ ID NO: 67027 - DNA, 505 bp, Homo sapiens
  misc_feature: GYAE6OF02G2G8Y.49.73.G07.1.454.CMB.1.raw
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtactttgagagggcctcgacgggaccctgagcgattcctctggctccagctcagcgacaacagtcacgttgaccatcagtggacgtccgggcgaggacggacgaggctagacttattactgtacagtcatcgagacaggtgtgtctacttntcgtgtacttcgggnggtaacgg

SEQ ID NO: 67028 - DNA, 501 bp, Homo sapiens
  misc_feature: GYAE6OF02F6F5A.49.73.G07.1.454.CMB.1.raw
  modified_base (142)..(142): a, c, t, g, unknown or other
  misc_feature (142)..(142): n is a, c, g, or t
  modified_base (324)..(324): a, c, t, g, unknown or other
  misc_feature (324)..(324): n is a, c, g, or t
  modified_base (419)..(419): a, c, t, g, unknown or other
  misc_feature (419)..(419): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctcctatgagctgacacagccaccctcggtgtctgtgtcctcaggacagacgccagtatcacctgctctggagatgcattgccaaagcaatatgcttactggtaccagcagaagccaggccaggccctgtcttgatcatttanaaagactttgagagggcctcgacggacccctgagcgtattctcgtggctccagctcagcgacaacagtcacgttagaccatcagtgagtccgggnagaggacgaggctgactatacgtgtcagtcatcgaagacagtaagtggactacgttctggtcgtacgttcggacggtacggg

SEQ ID NO: 67029 - DNA, 496 bp, Homo sapiens
  misc_feature: GYAE6OF02GPVAG.49.73.G07.1.454.CMB.1.raw
  modified_base (488)..(488): a, c, t, g, unknown or other
  misc_feature (488)..(488): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacggccagtatcacctgctctggagatgcattgccaaagcaatatgcttactggtacagcagaagccaggccaggcccctgtcttgatcatttataaagtactttgagagggcctcgacggacccctgagcgtattctctggctccagctcagcgacaacagtcacgttgaccatcagtgagtccgggcaggagacgagctgactatactgtcagtcatcgagactagtagtggctactttcgtgtacgtagttcggnggtaacgg

SEQ ID NO: 67030 - DNA, 177 bp, Homo sapiens
  misc_feature: GYAE6OF02FKV83.49.73.G07.1.454.CMB.1.raw
  modified_base (164)..(177): a, c, t, g, unknown or other
  misc_feature (164)..(177): n is a, c, g, or t
tcagagtcgagagacacgaccggtgctcgatttagctctacgctcagggcacgaccggtgctcgatttagtcacgcgagaaagggaaagggggctggccctgaccgtgtttctgttcccgccctcctctctctcgactctgagcgggctggcaaggcgcatagnnnnnnnnnnnnnn

SEQ ID NO: 67031 - DNA, 180 bp, Homo sapiens
  misc_feature: GYAE6OF02JFL76.49.73.G07.1.454.CMB.1.raw
  modified_base (177)..(180): a, c, t, g, unknown or other
  misc_feature (177)..(180): n is a, c, g, or t
tcagagtcgagagacacgaccggtgctcgatttagctctacgctcaggcggtgctcgatttagctctacgctcaggcacgaccggtgctcgatttagtcacgcggaaaggaaggctagcgtgttcctgttcccaccctcctctctctcgactctgagcggctggcaaggcgcatagnnnn

SEQ ID NO: 67032 - DNA, 498 bp, Homo sapiens
  misc_feature: GYAE6OF02H20LB.49.73.G07.1.454.CMB.1.raw
  modified_base (475)..(475): a, c, t, g, unknown or other
  misc_feature (475)..(475): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcagggacccctgagcgattctctggctccagctcagcgacaacagtcacgttgaccatcagtggagtccgggcaggaggacgaggctgactatactgtcagtcatcaagacagtagtcggcactttcngttcgtattcgggcggtaacggg

SEQ ID NO: 67033 - DNA, 755 bp, Homo sapiens
  misc_feature: GYAE6OF02IHZNV.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttccctcccctctcactctctgacacagtaccttcgtaggaccggtcccttaccttaagtggacgtctacgaaccaacgacgtacccctacccggttgggttcgttcgttggttccgttaccctacggaacgggaaccgaacgggacccggaccgttaaaggttacctaccctaccgttcggtccttccggtagggaagtagtcggacttagttccgaaaccgaaagactaaattagtcgtacctttacgtacggtaaccgacgacgaaaggaacgccggacggaccgacccggtcccttgttcttagtactacttaaattttaaagaaacgttcgtttaggaagggtaccgggtaccctacgggaacccgggtcccgtaggaccggtacgttactttccgttcggtcggtccctacgactcctacgaccgactaaaccgaacgtccgttacgtacgttaccgaactagtacgacggttcggaccgggtccggagagggaacggacggagtcgtacgtaactttacgttatcgtacacgtactacgtacgaatacgtaggtacgtcgacttcgttacgttcgttacgttacgggtccgggaggtaaccgg

SEQ ID NO: 67034 - DNA, 163 bp, Homo sapiens
  misc_feature: GYAE6OF02HKY6J.49.73.G07.1.454.CMB.1.raw
  modified_base (163)..(163): a, c, t, g, unknown or other
  misc_feature (163)..(163): n is a, c, g, or t
tcagagtcgagagacacgaccggtgctcgatttagctctacgctcagggcacgaccggtgctcgatttagtcacgcgagaaagggacagggggctggccctgacgtgtttctgttcccgccctcctctctctcgactctgagcgggctggcaaggcgcatagn

SEQ ID NO: 67035 - DNA, 569 bp, Homo sapiens
  misc_feature: GYAE6OF02J0BHZ.49.73.G07.1.454.CMB.1.raw
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (343)..(343): a, c, t, g, unknown or other
  misc_feature (343)..(343): n is a, c, g, or t
  modified_base (426)..(426): a, c, t, g, unknown or other
  misc_feature (426)..(426): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagccacccgtcggtgtctgtcgtcctcgaggacaggaccggccagtactcacctgctctgganatgctattgaccaaagcaatatcgcttacgnggtaaccagcaagacgccgaggccacggcccctgtcttgactctatttaanaaagtactttggaaggacgggtccgtaccggggaccctggacgcgtacttctcgtcgcctcgagtcctacacgcgaacaacgngtaccacgttcgaccagtcgaggtcggacggtccggagaggacggacgagctgtacttattacgtgtcgagtcatcgaaggtcaagggttatcggtacctagtttcgttcggtaccggttaggtcggggacggacggtaaccg

SEQ ID NO: 67036 - DNA, 246 bp, Homo sapiens
  misc_feature: GYAE6OF02HSKH9.49.73.G07.1.454.CMB.1.raw
  modified_base (245)..(246): a, c, t, g, unknown or other
  misc_feature (245)..(246): n is a, c, g, or t
tcagagtcgagagacacgaccggtgctcgatttagctctacgctcagggcacgaccggtgctcgatttagctctacgctcagggcgacgaccggtgctcgatttagagagagtgtgttgggtttgggggaagaggaagactgacggtcccccaggagttcaggtgctgggcacagcggccctgggctgcctggtcaaaggactacttcctctctcgactctgagcgggctggcaaggcgcatagnn

SEQ ID NO: 67037 - DNA, 165 bp, Homo sapiens
  misc_feature: GYAE6OF02HY35W.49.73.G07.1.454.CMB.1.raw
  modified_base (161)..(165): a, c, t, g, unknown or other
  misc_feature (161)..(165): n is a, c, g, or t
tcagagtcgagagacacgaccggtgctcgatttagctctacgctcagggcacgaccggtgctcgatttagtcacgcgagaaagggaaaggggctggccctgacgtgtttctgttcccgcctcctctctctcgactctgagcgggctggcaaggcgcatagnnnnn

SEQ ID NO: 67038 - DNA, 495 bp, Homo sapiens
  misc_feature: GYAE6OF02GP0Z6.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcaggaggacgaggctgactattactgtcagtcatcgagacaggtagtgcacttctgttcgtattcggcggtaacggg

SEQ ID NO: 67039 - DNA, 509 bp, Homo sapiens
  misc_feature: GYAE6OF02GWY97.49.73.G07.1.454.CMB.1.raw
  modified_base (452)..(452): a, c, t, g, unknown or other
  misc_feature (452)..(452): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgccaaagcaatatgcttactggtaccagcagaagccaggccaggcccctgtctgatcatttataaagactttgagagggcctcgacgggacccctgacgcgattcctctggctccagcctcagccgaacaacgagtcacgttgaccatcagtggagtccgggcaggaggacgaggctgactattacgngtcagtcatcgagtacagtagtgctacttcgtgtcggttagttcgggcggtaacggg

SEQ ID NO: 67040 - DNA, 662 bp, Homo sapiens
  misc_feature: GYAE6OF02IRUCI.49.73.G07.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctggtntctgtgtcctnaggacaggaccggccagtatcacctgctctggagatgcattgaccaaagcaatatgtcttactggtaccagcagaagccaggccacggcccctgtcttgatctatttataaagtactttagagacgggctcgacggaccctagacgcgtacttcgtctcggcctccagctacgacgaccgaacaacgtacgtaccgacgtttacggaaccctagttccgtaaggttcgggaaccgggttcccggggacgtaacgggaacgggtaaccgggacgggtaccttacgggtaaccgtttaagttaccgttacggtacctaacgggttacctaacgtaccgtaaacggtaaccgtaagggtttaacggtacgggtacccttaacgtttacccggtttacggttaccggtttaacgggtttaccggggacgggtaaacccgggggg

SEQ ID NO: 67041 - DNA, 565 bp, Homo sapiens
  misc_feature: GYAE6OF02F7M2G.49.73.G07.1.454.CMB.1.raw
  modified_base (242)..(242): a, c, t, g, unknown or other
  misc_feature (242)..(242): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtancacctgctctggagatgcattcgaccaaagcaatatgcttactggtaccagcagaagccaggccacggcccctgtcttgatctaatttaataaagtactttgagagggcctcgacgggaccctgacgcgtattctcgtgctccagctcgacgacgaacaacagtacgacgttacgaaccatcgaggtcggacggtcccgggacgaggacgggacgacggcgtagtaacttagttactcgtacgtacgtctagtacgaagtaaccgtaggtacggtcggtactacgttcgttcggttcgtacggtttcgggacgggtaaccggg

SEQ ID NO: 67042 - DNA, 172 bp, Homo sapiens
  misc_feature: GYAE6OF02HZW9R.49.73.G07.1.454.CMB.1.raw
  modified_base (171)..(172): a, c, t, g, unknown or other
  misc_feature (171)..(172): n is a, c, g, or t
tcagagtcgagagacacgaccggtgctcgatttagctctacgctcagggcacgaccggtgctcgatttagtcacgcgagaaagggaaagggggctggccctgacgtgtttctgttcccaccctcctctctctcgacctctgaggcggtcgtggacgaaggcgacaagtagnn

SEQ ID NO: 67043 - DNA, 504 bp, Homo sapiens
  misc_feature: GYAE6OF02F5YMA.49.73.G07.1.454.CMB.1.raw
  modified_base (425)..(425): a, c, t, g, unknown or other
  misc_feature (425)..(425): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcactatggcctggatccctctacttctccccctcctcactctctgcacagactctgaggcctcctatgagctgacacagccaccctggtgtctgtgtcctcaggacagacggccagtatccacctgctctggagatgcattgccaaagcaatatgcttactggtaccagcagaagccaggccaggccctgtcttgatcatttataaagtacttttgagagggcctcgacgggacccctgagcgattctctggctccagctcacgcgaacaacgagtcacgttgaccatcagtggagtccgggnaggaggacgaggctgactattactgtcagtcatcgagactagtagtgctacttcgtgtcgtacgttcggacggtaacgg

SEQ ID NO: 67044 - DNA, 500 bp, Homo sapiens
  misc_feature: GYAE6OF02GEECR.49.73.G07.1.454.CMB.1.raw
  modified_base (421)..(421): a, c, t, g, unknown or other
  misc_feature (421)..(421): n is a, c, g, or t
  modified_base (491)..(491): a, c, t, g, unknown or other
  misc_feature (491)..(491): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgagggacccctgacgcgattctctggctccagctcagcgacaacagtcacgttgaccatcagtggagtccgggnaggagggacgaggcgtgactattactgtcagtcatcaagacagtagtggcacttctgtcgttagttcggnggtaccggg

SEQ ID NO: 67045 - DNA, 490 bp, Homo sapiens
  misc_feature: GYAE6OF02FPV48.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtgagtccgggcagaggacgaggctgactattactgtcagtcatcagacagtagtgcacttctgtcgtagttcggcggtacggg

SEQ ID NO: 67046 - DNA, 504 bp, Homo sapiens
  misc_feature: GYAE6OF02G79IA.49.73.G07.1.454.CMB.1.raw
  modified_base (495)..(495): a, c, t, g, unknown or other
  misc_feature (495)..(495): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgccaaagcaatatgcttactggtaccagcagaagccaggccaggcccctgtcttgatcatttataaagtactttgagagggcctcgagggacccctgagcgattctctggctccagctcagcgacaacagtcacgttgaccatcagtggagtccgggcaggaggacgaggctgacttagtactgtcagtcatcgaagacagtagtgctacgttctggtcgttagttcgggnggtaacggg

SEQ ID NO: 67047 - DNA, 200 bp, Homo sapiens
  misc_feature: GYAE6OF02F2BJ7.49.73.G07.1.454.CMB.1.raw
  modified_base (196)..(200): a, c, t, g, unknown or other
  misc_feature (196)..(200): n is a, c, g, or t
tcagagtcgagagacacgaccggtgctcgatttagctctacgctcagggcacgaccggtgctcgatttagacgacagctcagggacgaccggtgctcgatttagtcacgcgagaaagggaagggggctggccctgacgtgtttctgttcccaccctcctctctctcgactctgagcgggctggcaaggcgcatagnnnnn

SEQ ID NO: 67048 - DNA, 498 bp, Homo sapiens
  misc_feature: GYAE6OF02FR6DB.49.73.G07.1.454.CMB.1.raw
  modified_base (490)..(490): a, c, t, g, unknown or other
  misc_feature (490)..(490): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtacttttgagtagggcctcgacgggacccctgagcgattctctggctccagctcagcgacaacagtcacgttgaccatcagtggagtccgggcagaggacgaggctgactattactgtctagtcatcgagacagtagtgcacttctgtcgtagttcggnggtacggg

SEQ ID NO: 67049 - DNA, 497 bp, Homo sapiens
  misc_feature: GYAE6OF02FN7AT.49.73.G07.1.454.CMB.1.raw
  modified_base (420)..(420): a, c, t, g, unknown or other
  misc_feature (420)..(420): n is a, c, g, or t
  modified_base (488)..(488): a, c, t, g, unknown or other
  misc_feature (488)..(488): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtcccgggnagaggacgaggctgactattactgtcagtcatcgagacagtagtggctacttctgttcgtatttcggnggtaacggg

SEQ ID NO: 67050 - DNA, 496 bp, Homo sapiens
  misc_feature: GYAE6OF02I0MUH.49.73.G07.1.454.CMB.1.raw
  modified_base (214)..(214): a, c, t, g, unknown or other
  misc_feature (214)..(214): n is a, c, g, or t
  modified_base (401)..(401): a, c, t, g, unknown or other
  misc_feature (401)..(401): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtntctgtgtcctcaggacagacggccagtatcacctgctctggagatgcattgccaaagcaatatgcttactggtaccagcagaagccaggccaggcccctgtcttgatcatttataaagactttgagagggcctcgagggacccctgagcgattctctggctccagctcagcgacaacagtcacgttnaccatcagtgagtccgggcagagacgagctgacttatactgtcagtcatcgaagacagtagtcggctacttctggtcgtagttcgggcggtacgg

SEQ ID NO: 67051 - DNA, 499 bp, Homo sapiens
  misc_feature: GYAE6OF02HGOOA.49.73.G07.1.454.CMB.1.raw
  modified_base (445)..(445): a, c, t, g, unknown or other
  misc_feature (445)..(445): n is a, c, g, or t
  modified_base (491)..(491): a, c, t, g, unknown or other
  misc_feature (491)..(491): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgacgggacccctgagcgattctctggctccagctcagcgaacaacagtcacgttgaaccatcagtggagtccgggcagaggacgagctgactattacngtcagtcatcgaagacagtgtaggctacgttctgtcgtagttcggngtaacggg

SEQ ID NO: 67052 - DNA, 519 bp, Homo sapiens
  misc_feature: GYAE6OF02GGIHQ.49.73.G07.1.454.CMB.1.raw
  modified_base (510)..(510): a, c, t, g, unknown or other
  misc_feature (510)..(510): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttaataaagtactttgagagggcctcgagggacccctgacgcgattctctggctccagctcagcgaacaacagtcacgttcgaccatcgagtggacggtccgggcaaggaggacgaggctgacttatacgtgtacagtcattcgaagacgaggtagtggtaccactttctagttcgtagttccgggnggtaacggg

SEQ ID NO: 67053 - DNA, 529 bp, Homo sapiens
  misc_feature: GYAE6OF02IWQ2F.49.73.G07.1.454.CMB.1.raw
  modified_base (258)..(258): a, c, t, g, unknown or other
  misc_feature (258)..(258): n is a, c, g, or t
  modified_base (328)..(328): a, c, t, g, unknown or other
  misc_feature (328)..(328): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctggtgtctgtcgtcctcaggacaggacggccagtatcacctgcctctgganatgcattgccaaagcaatatgcttactggtaccagcagagccaggccacggccctgtctgatcatttaanaagtactttgagagggcctcgacggacccctgagcgattctcgtggctcagctcagcacaacagtctacgttgaaccatccgagtcggacggtaccgggcgaacggacgggacggaggtacgtagaacttagttactgtactagtcatcgagaccgaagtgtacggcttacttcgttgtcgttagttcgggcggtaacggg

SEQ ID NO: 67054 - DNA, 500 bp, Homo sapiens
  misc_feature: GYAE6OF02HFDZT.49.73.G07.1.454.CMB.1.raw
  modified_base (377)..(377): a, c, t, g, unknown or other
  misc_feature (377)..(377): n is a, c, g, or t
  modified_base (420)..(420): a, c, t, g, unknown or other
  misc_feature (420)..(420): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcagggacccctgagcgattctctggctccngctcagcgacaacagtcacgttgaccatcagtggagtccgggnaggaggacgaggctgacttatactgtcagtcatcaagacaggtagtggcactttcgtgttcgtagttcggcggtaacggg

SEQ ID NO: 67055 - DNA, 294 bp, Homo sapiens
  misc_feature: GYAE6OF02GARTO.49.73.G07.1.454.CMB.1.raw
  modified_base (282)..(294): a, c, t, g, unknown or other
  misc_feature (282)..(294): n is a, c, g, or t
tcagagtcgagagacacgaccggtgctcgatttagctctacgctcagggcacgaccggtgctcgatttagctctacgctcagggcgacgaccggtgctcgatttacgctctacgctcagggcgacgaccggtgctcgatttacgagagagtgtgtgggtttgggggaagaggaagactgacggtcccccaggacgttcaggtgctgggcacagcggccctgggctgcctggtcaaggactacttcctctctcgactctgagcgggctggcaaggcgcatagnnnnnnnnnnnnn

SEQ ID NO: 67056 - DNA, 498 bp, Homo sapiens
  misc_feature: GYAE6OF02GEC9Z.49.73.G07.1.454.CMB.1.raw
  modified_base (489)..(489): a, c, t, g, unknown or other
  misc_feature (489)..(489): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagtactttgagagggcctcgacgggacccctgagcgattctctggctccagctcagcgacaacagtcacgttgaccatcagtggagtccgggcagaggacgaggctagactattactgtcagtcatcaagacagtagtgctacttctgtcgtagttcggnggtaacggg

SEQ ID NO: 67057 - DNA, 549 bp, Homo sapiens
  misc_feature: GYAE6OF02G0CN3.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtctgatcatttataaagactttgagagggcctacgacgggtacccctgacgcgtaatttcgtacgtcgggctacccgagccttcaggccgaacaaaccgagttccacgtttgaacctatcgagtgggacgtccgggcgacggaggacgaggctgacttagtactgtacagtcatacgaagaactaggtaacgtgacttacgttcgtggttccgttagttccgggaggtaaccgggg

SEQ ID NO: 67058 - DNA, 492 bp, Homo sapiens
  misc_feature: GYAE6OF02FLB92.49.73.G07.1.454.CMB.1.raw
  modified_base (466)..(466): a, c, t, g, unknown or other
  misc_feature (466)..(466): n is a, c, g, or t
  modified_base (483)..(483): a, c, t, g, unknown or other
  misc_feature (483)..(483): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtgagtccgggcagaggacgaggctgactattactgtcagtcatcagacagtagtggacncttctgtcgtattcggnggtaacggg

SEQ ID NO: 67059 - DNA, 602 bp, Homo sapiens
  misc_feature: GYAE6OF02J0AC5.49.73.G07.1.454.CMB.1.raw
  modified_base (123)..(123): a, c, t, g, unknown or other
  misc_feature (123)..(123): n is a, c, g, or t
  modified_base (142)..(142): a, c, t, g, unknown or other
  misc_feature (142)..(142): n is a, c, g, or t
  modified_base (257)..(257): a, c, t, g, unknown or other
  misc_feature (257)..(257): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctnaccatggcctggatccctntacttctcccctctcactctctgcacagactctgaggcctcctatgagctgacacacgccacccgtggtgtctgtcgtcctacgaggacaggccggccagttactccgacctgcncgtggagatgctattcgaccgaaagcaatagtctactttacgtcggtaccagacaaggacgccgaacggaccacggtcccctagtcttagactactatttaactaaagtctttaggagacggtcctgacggaccctggacgcggtactctcgtggcctcgagcctcgacgtcacgaacacgtcgtacgtgaaccagtacaggtcggacggtcccggagaacgggacggacggtacgggactcggtaactacttaacgttcggtacacgttccaagttccgaacgtacgtagtacggtacgtcgtacctttcggtggttacgttacggtcgggaccggtaaccggg

SEQ ID NO: 67060 - DNA, 110 bp, Homo sapiens
  misc_feature: GYAE6OF02F5M2Y.49.73.G07.1.454.CMB.1.raw
  modified_base (110)..(110): a, c, t, g, unknown or other
  misc_feature (110)..(110): n is a, c, g, or t
tcagagtcgagagacacgaccggtgctcgatttagctctacgctcagggcacgaccggtgctcgatttagtcacgcgagaaagggagagcgggctggcaaggcgcatagn

SEQ ID NO: 67061 - DNA, 549 bp, Homo sapiens
  misc_feature: GYAE6OF02HKYEH.49.73.G07.1.454.CMB.1.raw
tcagagtcgagagacacgaccggtgctcgatttagctctacgctcagggcacgaccggtgctcgtttagagagagtgtgttgggtttggaggtgggtccaggaggcagaactctgggtgtctcaccatggcctggatccctctacttctccccctcctcactctctgcacagactctgaggcctcctatgagctgacacagccaccctcggtgtctgtgtccctcaggacagacggccagtatcacctgctctggagatgcattgccaaagcaatatgcttactggtgccagcagaagccaggccaggcccctgtcttgatctatttaataaagtactttagagacgggcctacgacgggacccctgagcgtattccgtcgtggcctccgagggtcgaacgggacaacgggtcacgtagttcggccagtcgagttcgggacgtccgagggcaggacggacgaggcgttagaacttattattgactaatcaacgagaccacctagttacgttaacttagtcgttcgttaccggtaactgaccgtaaccgg

SEQ ID NO: 67062 - DNA, 202 bp, Homo sapiens
  misc_feature: GYAE6OF02F8QFE.49.73.G07.1.454.CMB.1.raw
  modified_base (200)..(202): a, c, t, g, unknown or other
  misc_feature (200)..(202): n is a, c, g, or t
tcagagtcgagagacacgaccggtgctcgatttagctctacgctcagggcacgaccggtgctcgatttagctctacgctacgaagggcacgaccggtgctcgtatttagtccacgcgagaaagggaagggctggccctgacgtggtttctgttcccgcctcctctctctcgactctgagcgggctggcaaggcgcatagnnn

SEQ ID NO: 67063 - DNA, 557 bp, Homo sapiens
  misc_feature: GYAE6OF02IJQNQ.49.73.G07.1.454.CMB.1.raw
  modified_base (341)..(341): a, c, t, g, unknown or other
  misc_feature (341)..(341): n is a, c, g, or t
  modified_base (381)..(381): a, c, t, g, unknown or other
  misc_feature (381)..(381): n is a, c, g, or t
  modified_base (406)..(406): a, c, t, g, unknown or other
  misc_feature (406)..(406): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagaccggccagtactcacctgctctggagatgctattcgaccaaagcaatatgtcttacgtggtaccagacaagaacgccaggccacggcccctgtcttgatctaatttaanaaagtctttgagcggcctcgacggaccctgagcgtattcncgtggctcacgtctcagcaacaacncgtcacgttcacctatacgaggtgacggtccgggacaggacggacgacggctagtacttaagttacgtcgtacgacgtactaatcgaagacgtaggtacggtacggtccttacgttcgtcgttacggtacgttccggggacggtaaccggg

SEQ ID NO: 67064 - DNA, 548 bp, Homo sapiens
  misc_feature: GYAE6OF02IXN1V.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatcccctctacttcctcccctcctcactctctgcacagactctgacggcctcctatgagctgacacagcccacctcggtgtctgtcgtcctcagggacagacggccagtatcacctgctctggagatgcattcgaccaaaggcaatatgctttacgtggtaccagcagaagccgaggccacggcccctgtcttgactcatttataaagtactttagagacgggctacgacggacccctgacgtcgattcctctcggcctccgaagctcgagcgtacaactagtccacggttgaacctatctaggtggacggtccgggacaggaggacgtaggtcgtagacttagttacgtgtcagtcagtcgaaggactaggtagtcggcttacgttcgtcgtcgttacgtcggaggtaacgg

SEQ ID NO: 67065 - DNA, 512 bp, Homo sapiens
  misc_feature: GYAE6OF02GR6Y9.49.73.G07.1.454.CMB.1.raw
  modified_base (224)..(224): a, c, t, g, unknown or other
  misc_feature (224)..(224): n is a, c, g, or t
  modified_base (503)..(503): a, c, t, g, unknown or other
  misc_feature (503)..(503): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatcacctgctctggagatgcattgccaaagcaatatgcttactggtaccagcagaagccaggccaggcccctgtcttgatcatttataaagactttgagagggcctcacgggacccctgagcgattcctctggctccagtctcagcgaacaacagtacacgttgaccatcagtggacgtccgggacaggaggacgaggctggactaattactgtacagtcagtcagactaggtaagtggctacttcgtgttacgtagttcggnggtaacggg

SEQ ID NO: 67066 - DNA, 564 bp, Homo sapiens
  misc_feature: GYAE6OF02HZ1IV.49.73.G07.1.454.CMB.1.raw
tcagagtcgagagacacgaccggtgctcgatttagctctacgctcagggcacgaccggtgctcgtttagagagaatgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgctattcgaccaaaagcaatatgtacttacgtggtaaccagcaagaacgccgacggccacggccctgtctgatctatttaataaagtactttgagaggcctcgacggaccctgacgcgtattctcgtcggctccgagctacacgcgaacaacacgtctacgttgaacctatacgagtggacggtccgggactaagggacggacgacggtcgtagtacttagttacgtgtacgagtacagtacgaagtacgtaggtagtcggaccttagttccgtcgttacggttacggttcgggacgggtaacggg

SEQ ID NO: 67067 - DNA, 213 bp, Homo sapiens
  misc_feature: GYAE6OF02JYEEX.49.73.G07.1.454.CMB.1.raw
  modified_base (206)..(213): a, c, t, g, unknown or other
  misc_feature (206)..(213): n is a, c, g, or t
tcagagtcgagagacacgaccggtgctcgatttagctctacgctcagggcacgaccggtgctcgatttagagagagtgtgttgggtttgggggaagaggaagactgacggtcccccaggagttcaggtgctgggcacagcggcctgggctgcctggtcaaggactacttcctctctcgactctgagcggctggcaaggcgcatagnnnnnnnn

SEQ ID NO: 67068 - DNA, 163 bp, Homo sapiens; identical to SEQ ID NO: 66618
  misc_feature: GYAE6OF02GFDKD.49.73.G07.1.454.CMB.1.raw
  modified_base (163)..(163): a, c, t, g, unknown or other
  misc_feature (163)..(163): n is a, c, g, or t

SEQ ID NO: 67069 - DNA, 608 bp, Homo sapiens
  misc_feature: GYAE6OF02HW91F.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcgaggacagaccggccagtatcacctgctctggagatgcattgccaaagcaatatgcttactgtaccagcagaagccgaggccacggcccctgtccttgatctatttataaagactttgagacgggctcgagggacccctgagcgattctctgctccagctcgagtcgaacaacgacgtacctacgtttacggaccctagtacgaggtagggacggtacccgggacgaacgggaagggaccgggaacgggtaccgtaggtaaccttaacgtttaacgtcgttacgaacgttcctacgttaccgaacggtaccaagggttaacggtacgggtacctacgtttccgttacggttccggtttaacggtttccggggacggtaacgggg

SEQ ID NO: 67070 - DNA, 614 bp, Homo sapiens
  misc_feature: GYAE6OF02J1HZF.49.73.G07.1.454.CMB.1.raw
  modified_base (289)..(289): a, c, t, g, unknown or other
  misc_feature (289)..(289): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctccatgagctgacacagccaccctcggtgtctgtgtcctcaggacaggacggccagtatcaccgtgctctggagatgcattgacctaaagcaatatcgactttacgnggtaccagcaacgaagccgaggccacggcccgtgtcttgactactattaataaagtactttagagtacggtactacgtacggaccccgtagacgtacgtacgttcgtcgtacggtctccacgccgtacgacgcgacaacgacgtacgtacgtacgacctatacgtagtcggaagtccgggtacgacgggaaggtaccgacgggtacgtacgtaacgttacttaacgtcgttactacggtacacgtaccgaacgtaactacgggtaacgttacggaccgttacgttacgtacggttacggttacgtaccggggtacgggtaaccgg

SEQ ID NO: 67071 - DNA, 246 bp, Homo sapiens
  misc_feature: GYAE6OF02IZ9DI.49.73.G07.1.454.CMB.1.raw
  modified_base (244)..(246): a, c, t, g, unknown or other
  misc_feature (244)..(246): n is a, c, g, or t
tcagagtcgagagacacgaccggtgctcgatttagctctacgctcagggcacgaccggtgctcgatttagctctacgctcagggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnn

SEQ ID NO: 67072 - DNA, 179 bp, Homo sapiens
  misc_feature: GYAE6OF02HBDKG.49.73.G07.1.454.CMB.1.raw
  modified_base (177)..(179): a, c, t, g, unknown or other
  misc_feature (177)..(179): n is a, c, g, or t
tcagagtcgagagacacgaccggtgctcgatttagctctacgctcagggtagctctacgctcagggcacgaccggtgctcgatttagtcacgcgagaaagggaaggggctggccctgacgtgtttctgttcccgccctctctctctcgactctgagcgggctggcaaggcgcatagnnn

SEQ ID NO: 67073 - DNA, 164 bp, Homo sapiens
  misc_feature: GYAE6OF02FI935.49.73.G07.1.454.CMB.1.raw
  modified_base (163)..(164): a, c, t, g, unknown or other
  misc_feature (163)..(164): n is a, c, g, or t
tcagagtcgagagacacgaccggtgctcgatttagctctacgctcagggcacgaccggtgctcgatttagtcacgcgagaaagggaaagggggctggccctgacgtgtttctgttcccgccctcctctctctcgactctgagcgggctggcaaggcgcatagnn

SEQ ID NO: 67074 - DNA, 162 bp, Homo sapiens
  misc_feature: GYAE6OF02HZ2ZD.49.73.G07.1.454.CMB.1.raw
  modified_base (162)..(162): a, c, t, g, unknown or other
  misc_feature (162)..(162): n is a, c, g, or t
tcagagtcgagagacacgaccggtgctcgatttagctctacgctcagggcacgaccggtgctcgatttagtcacgcgagaaagggaaagggggctggccctgacgtgtttctgttcccgcctcctctctctcgactctgagcgggctggcaaggcgcatagn

SEQ ID NO: 67075 - DNA, 684 bp, Homo sapiens
  misc_feature: GYAE6OF02JZOEY.49.73.G07.1.454.CMB.1.raw
  modified_base (143)..(143): a, c, t, g, unknown or other
  misc_feature (143)..(143): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (338)..(338): a, c, t, g, unknown or other
  misc_feature (338)..(338): n is a, c, g, or t
tcagagtcgagagacacgaccggtgctcgatttagctctacgctcagggcacgaccggtgctcgtttagagagagtgtgttgggtttgggggtgggtccgaggaggcagaactctgggtgtctcaccatggcctggatccctntacttctccccctctcactctctgcacagactctgacggcctcctatgagctgacacagcccacccttggtgtctgtcgtcctcgaggacaggaccggcctagtactccacctgcctctggagatgcattgccaaagcaatatncttanggtaccagtcagtaagccaggccaggcccctgtcttgatcatttanaaagtactttgagacgggtcctacgacgggtaccccctgacgtcggatttccgtcgttcggaccgttcccgaaggtcccttccgaggaccgtaaccgaaccgtaacggtacctacggttacgtaacccattaccgaaggttcgggtacggtcccggggtacgaacgggtaaccgggaacgggacggggtaccgtacgggtaaccttaagtttaaccgtggttaaccgtacggtaccgtaacttccggaacggtaaccgtaacggttaacggtccggtacgttaaccggttttaccgtacggtttaccgggtttacggtttaccggggtacgggttaaacccggggg

SEQ ID NO: 67076 - DNA, 651 bp, Homo sapiens
  misc_feature: GYAE6OF02IJW9L.49.73.G07.1.454.CMB.1.raw
  modified_base (214)..(214): a, c, t, g, unknown or other
  misc_feature (214)..(214): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttctccccctcctcactctctgcacagactctgaggcctcctatgagctgacacagccaccctcggtntctgtgtcctcaggacagaccggccagtactcacctgctctggagatgcattgaccaaagcaaatatgtcttactggtaccagcaagaacgccgaggccacggccctgtcttagatactatttaataaagtactttaggaggacgggtcctacgaaccgggtacccctaggacgtcgtactttcgtcgtcggccttccacgtcctacgacgaccgaacaaacgacggtacctaaccggtttgaaccctagtacggacggttggggaccggtccggggtacgaagggtaacgggaacggaggggtcctaggttaaccgttaactttacgtacggttactaacgttccaataccgaaaacgtaggtacggttacggtacctacgttttaccgtacggtttaccggtttaggttcccgggacggggtaccgggtaaccgg

SEQ ID NO: 67077 - DNA, 498 bp, Homo sapiens
  misc_feature: GYAE6OF02HFG8S.49.73.G07.1.454.CMB.1.raw
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
  modified_base (490)..(490): a, c, t, g, unknown or other
  misc_feature (490)..(490): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagacttttgagagggcctcacgggacccctgagcgattctctggctccagctcagcgacaacagtcacgttcgaccatcagtggagtccgggnaggaggacgaggctagactattacngtcagtcatcagacagtagtggctacttcgtgtcgtattcggnggtacggg

SEQ ID NO: 67078 - DNA, 532 bp, Homo sapiens
  misc_feature: GYAE6OF02HWAVO.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacgccagtactcacctgctctggagatgcattgccaaagcaatatgcttactgtaccagcagaagccaggccacggccctgtccttgatctatttaataaagtactttgagagggcctcgaacgggacccctgacgcgtattctcgtcgctccagcctcgagccgaacaacagtcacgttacacctatcgagtggaggtccgggcgaaggaggacgaggctagacttacgtactgtacgagtctatcgaagacagtagtcggactacttcgtagttcggttacgttcgggacggtaaccggg

SEQ ID NO: 67079 - DNA, 689 bp, Homo sapiens
  misc_feature: GYAE6OF02JTG53.49.73.G07.1.454.CMB.1.raw
  modified_base (142)..(142): a, c, t, g, unknown or other
  misc_feature (142)..(142): n is a, c, g, or t
  modified_base (258)..(258): a, c, t, g, unknown or other
  misc_feature (258)..(258): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctcctatgagctgacacagccacctggtgtctgtgtcctgaggtacaggacggccaaggtatccacctgctctgganatgcagttgacctaaagcaatatcgtacttacgtggtaaccagcaacgaagccgaggcccacgggcccctgtccttgactactatttaactaaacgtaccttttagaacggtacgggccctacgacgggtaccccttggacgcgtattccgtacgtcggtcctccgtacgtccgttacgacgtaccgaactaaacgtacgtaccgtacggtttacgaaccgtacgttcgtaacggttacgggtaccggttacccgggacgaagggtaacgggaaccggtacgggtaccgtaacggtaaccgtttaacgttaaccgttacgtaccgtaacgttccaacgttaccgaacggttaaccgtagggtaacggttcggaaccttaccgttttacgtacggtttaccgttacgggtttccggaccgggttaaccgggg

SEQ ID NO: 67080 - DNA, 531 bp, Homo sapiens
  misc_feature: GYAE6OF02I8ZOR.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctcggtgtctgtgtcctcaggacagacggcagtatcacctgctctggagatgcattgaccaaagcaatatgcttactggtaccagcagaacgccaggccacgcccctgtctgatcatttataaagtactttagagacgggcctcgacgggacccctgacgcgtattctcgtggcctccacgctcgagccgacaacagtcacgttcgacctatacaggtggacggtccgggacaaggaggacgacggctagacttagttactgtacagtcatacgaagactagtagtggactacgtttcgtagttcgtacgttcggacggtacggg

SEQ ID NO: 67081 - DNA, 576 bp, Homo sapiens
  misc_feature: GYAE6OF02FTDKR.49.73.G07.1.454.CMB.1.raw
  modified_base (225)..(225): a, c, t, g, unknown or other
  misc_feature (225)..(225): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctnaggacagacggccagtatccacctgctctggagatgcattgccaaaagcaatatgcttacgtggtaccagcagaacgccaggccacggcccctgtcttgatctatttataaagtactttgagacgggcctacgacggacccctgagcgtattctcgtggctcagctcgacgcgaacaacagtccacgttacgacctatcgaggtcggacggtccgggacgaggacggacggaggcctagtaaccttaatttacgtgttaccgagttacactcgaacgtacgtaaggttacgtacggtaccttacgtttcgttacggttaccggttacggttccggggacgggtaaccgggg

SEQ ID NO: 67082 - DNA, 568 bp, Homo sapiens
  misc_feature: GYAE6OF02JB0TP.49.73.G07.1.454.CMB.1.raw
  modified_base (226)..(226): a, c, t, g, unknown or other
  misc_feature (226)..(226): n is a, c, g, or t
  modified_base (467)..(467): a, c, t, g, unknown or other
  misc_feature (467)..(467): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttctccccctctcactctctgcacagactctgaggcctcctatgagctgacacagcccaccctcggtgtctgtcgtcctnaggacagaccggccagtactcacctgctctggagatgcattgaccaaagcaatatgtacttacgtcggtaccagacaagaacgccacggcccgacggcccctgttcttgactctaatttaataaagtactttagaggacgggtcctacgacgggaccccgtaggacgcgtacttctcgtcggcctccagctcgagaccgaacaacagtcacgttacgaccatcaggtggacggtccggganaggacggacgagcgtagacttatacgtgtctagtctactgaacgtacgaggtagtacggactacgtttcgtacgttcggtacgttcgggacggtaaccggg

SEQ ID NO: 67083 - DNA, 497 bp, Homo sapiens
  misc_feature: GYAE6OF02F1SP6.49.73.G07.1.454.CMB.1.raw
  modified_base (489)..(489): a, c, t, g, unknown or other
  misc_feature (489)..(489): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaaagcaatatgcttactggtaccagcagaagccaggccaggcccctgtcttgatcatttataaagtactttgagagggcctcgacgggacccctgagcgattctctggctcagctcagcgacaacagtcacgttgaccatcagtgacgtccgggcagaggacgagctgactattactgtcagtcatcgaagacagtagtggctacttctgtcgtagttcggnggtaacgg

SEQ ID NO: 67084 - DNA, 715 bp, Homo sapiens
  misc_feature: GYAE6OF02HS7XN.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccacccgtcggtgtctgtgtccctcagggacaggacggccagtactcacctgctctggagatgctattgaccaaagcaatatgcttactggtaccagcaagagccaggccacggcccctgtcttgatctaatttaataaagtactttggaaggtacgggtacctacggaacgggtaccccgtgacgtacggtactttccgtcgttcgggccttccgacgtccttccgacgacgtaaaccaaccgtacgtaccgtacgttacgaacctacgtaccgtagggtagggtaccggtcccggggacgaacgggaacggggaccgggaacgggtaccgtaacgggtaacctttaacggtttaccgttacgggttaccgtaacggttaccgtaacgtttaccggtaaacggtaaccgttaagggttaccgggttacggtacccgtttaaccgtttttcccggttacggttttaacccggttttacggtttacccgggggtacgggttaaaccccgggggg

SEQ ID NO: 67085 - DNA, 740 bp, Homo sapiens
  misc_feature: GYAE6OF02JYEUR.49.73.G07.1.454.CMB.1.raw
  modified_base (167)..(167): a, c, t, g, unknown or other
  misc_feature (167)..(167): n is a, c, g, or t
  modified_base (213)..(213): a, c, t, g, unknown or other
  misc_feature (213)..(213): n is a, c, g, or t
tcagagtcgagagacacgaccggtgctcgatttagctctacgctcagggcacgaccggtgctcgtttagagagagtgtgttgggtttgggggtgggtccgaggaggcagaactctgggtgtctcaccatggcctggatccctctacttctcccctcctcactctctncacagactctgaggcctcctatgagctgacacagccaccctcggtntctgtgtcctcaggacagacggccagtactccacctgctcgtggactagtgctattcgaccaaaagtccaaagttatacgtactttaacgttacggtaaccaacgtacgaaggaaccgacccgaacgggaccccgtaacgggtcccccttagggttccctttaggaaacttcttaaacgtttaaagtaaaacggttcgtttttaggaacgggtaacgggtcccttacggaaacggggtaccccttaggaccggtacgttaacttttccgtacgtcggtcctaccgtacgtacgtaccgtaacggccgtaaaccgaaactacggtacccgtaaacggttccggaaaccgttacgtacgtaacggtacgggtacggtccgggacgaacggtaacgggaccgggaggtaccgtacgtaacgttacgttaacgtcgttaacgtacgtacgtattacgaacggtaacgtaggtaacggttacgtaccgtacgtttcgtgttaaccggtacgtttaccggggacggtaacggg

SEQ ID NO: 67086 - DNA, 166 bp, Homo sapiens
  misc_feature: GYAE6OF02FGLK1.49.73.G07.1.454.CMB.1.raw
  modified_base (161)..(166): a, c, t, g, unknown or other
  misc_feature (161)..(166): n is a, c, g, or t
tcagagtcgagagacacgaccggtgctcgatttagctctacgctcagggcacgaccggtgctcgatttagtcacgcgagaaagggaaagggctggccctgacgtgtttctgttcccaccctcctctctctcgactctgagcgggctggcaaggcgcatagnnnnnn

SEQ ID NO: 67087 - DNA, 658 bp, Homo sapiens
  misc_feature: GYAE6OF02HEEEF.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacggcctcctatgagctgacacagcccaccctggtgtctgtcgtcctcaggacaggaccggccagtactccacctgcctctggagatgctattcgaccaaagcaatatcgtacttacgtacggtaccagcaagaacgccaggccacggcccctgtccttgatctaatttaactaaagtactttagacggtacgggcctacggaacgggtacccctggacgcgtacttccgtcgtcggcctccacgtcctcgacgtaccgaacaaacgacgtaccacgttacgaacctagttacgagggttcgggacggtcccggggacgtacgggaacgggaccggtacgggtaccttacggtaaccgttaacgttacttacggttactacgttacgtacgtaccgtaacggtaacgtaacggtacggttacggtaccttacgtttcggttacggttaccggtttacggttaccggggacgggtaaccggg

SEQ ID NO: 67088 - DNA, 183 bp, Homo sapiens
  misc_feature: GYAE6OF02I2PJD.49.73.G07.1.454.CMB.1.raw
  modified_base (182)..(183): a, c, t, g, unknown or other
  misc_feature (182)..(183): n is a, c, g, or t
tcagagtcgagagacacgaccggtgctcgatttagctctacgctcagggcggtgctcgatttagctctacgctcagggcacgaccggtgctcgatttagtcacgcggaaagggaaaggctagcgtgttcctgttcccgccctcctctctctcgactctgagcgggctggcaaggcgcatagnn

SEQ ID NO: 67089 - DNA, 556 bp, Homo sapiens
  misc_feature: GYAE6OF02JQA0L.49.73.G07.1.454.CMB.1.raw
  modified_base (281)..(281): a, c, t, g, unknown or other
  misc_feature (281)..(281): n is a, c, g, or t
  modified_base (340)..(340): a, c, t, g, unknown or other
  misc_feature (340)..(340): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctggtgtctgtcgtcctcgaggacaggaccggccagtatccacctgctctggagatgcattcgaccaaagcaaatntgtcttacgtcggtaccagccaagaacgccgaggccacggccctgtcttgatctattanaagtacttgagacggctcgacggacccgtgacgcgtacttctcgtcgctacgacgtctcacgacgaacaacgtagtctacggttcgaacctatcgagtaggtacgtccgggagtacggacggacgaggctagacttaacgtacgtacgtacacgtctagtacgaacgagtagtacggtcgtactacgttcgtgtcgtacgttcggaccgggtacgg

SEQ ID NO: 67090 - DNA, 557 bp, Homo sapiens
  misc_feature: GYAE6OF02GIGV9.49.73.G07.1.454.CMB.1.raw
  modified_base (213)..(213): a, c, t, g, unknown or other
  misc_feature (213)..(213): n is a, c, g, or t
tcagagtcgagagacacgaccggtgctcgatttagctctacgctcagggcacgaccggtgctcgtttaggagagagtgtgttggggtttgggggtgggtccaggaggcagaactctgggtgtctcaccatggcctggatccctctacttctccccctctcactctctgcacagactctgaggcctctatgagctgacacagcccaccctggtntctgtcgtcctcaggacagacggccagtatccacctgctctggagatgcattgccaaagcaatatgcttactggtaccagcagaagccaggccaggcccctgtcttgatctatttaataaagtactttgaggacgggtcctcgacgggtacccctggacgtcggtacttcctcgtcggtcctccgagcttcagaccgacaacgacgtaccgaccgtttcgacctactcgagtggacgtccgggacaggacgggaccgaggactacgtactagttacgtcgtcgagtcagtcgaagactacgtagtcgtctacgtttctcgttacgttagtcgggcggtaacggg

SEQ ID NO: 67091 - DNA, 162 bp, Homo sapiens
  misc_feature: GYAE6OF02H4G9F.49.73.G07.1.454.CMB.1.raw
  modified_base (158)..(162): a, c, t, g, unknown or other
  misc_feature (158)..(162): n is a, c, g, or t
tcagagtcgagagacacgaccggtgctcgatttagctctacgctcagggcacgaccggtgctcgatttagtcacgcgagaagggaagggctggccctgacgtgttctgttcccgccctcctctctctcgactctgagcgggctggcaaggcgcatagnnnnn

SEQ ID NO: 67092 - DNA, 579 bp, Homo sapiens
  misc_feature: GYAE6OF02F7WTJ.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttctccccctcctcactctctgcacagactctgaggcctcctatgagctgacacagcccaccctcggtgtctgtcgtcctcgaggacagacggccagtatcacctgctctggagatgcattgaccaaagcaatatgcttactggtaccagcagagccaggccacggccctgtcttgatctaatttaataaacgtactttagagacgggcctcgacgggacccctgacgcgtattctcgtcggtcctccgacgcctcgacgacgaacaacagtcacgttcgaaccatcaggtggacggtccgggacgaggacgggacggacgggcgtacgtaacttacttacgtcgtacgtagtactacgtacgaaggaacgtaggtacgtacggacgttacgttcgttacgttcggttacgttcggggtacggtaacccgggg

SEQ ID NO: 67093 - DNA, 162 bp, Homo sapiens
  misc_feature: GYAE6OF02HS8RA.49.73.G07.1.454.CMB.1.raw
tcagagtcgagagacacgaccggtgctcgatttagctctacgctcagggcacgaccggtgctcgatttagtcacgcgagaaagggaaagggggctggccctgacgtgtttctgttcccgccctcctctctctcgactctgagcgggctggcaaggcgcatag

SEQ ID NO: 67094 - DNA, 166 bp, Homo sapiens
  misc_feature: GYAE6OF02FIC4G.49.73.G07.1.454.CMB.1.raw
  modified_base (166)..(166): a, c, t, g, unknown or other
  misc_feature (166)..(166): n is a, c, g, or t
tcagagtcgagagacacgaccggtgctcgatttagctctacgctcagggcacgaccggtgctcgatttagtacgtcatcagggaaagggcgcacactgcacatcgttggtttgggcatcgaaccggacaacgctgaactggtgagcgggctggcaaggcgcatagn

SEQ ID NO: 67095 - DNA, 536 bp, Homo sapiens
  misc_feature: GYAE6OF02HLWLG.49.73.G07.1.454.CMB.1.raw
  modified_base (414)..(414): a, c, t, g, unknown or other
  misc_feature (414)..(414): n is a, c, g, or t
  modified_base (446)..(446): a, c, t, g, unknown or other
  misc_feature (446)..(446): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgctattgaccaaaagcaatatgcttactggtaccagcaagacgccaggccacggcccctgtcttgatctatttaataaagtactttagagacgggcctacgacgggacccctgacgcgtattctcgtggcctccgagtcctcgagaccgaacaacngtacacgttgaccatcaggtggagtccggganaggacggacgaggcgtagtacttagttacgtgtcgagtcatacgagacagacgagtggactagttagtggttacgttagttcgggacggg

SEQ ID NO: 67096 - DNA, 716 bp, Homo sapiens
  misc_feature: GYAE6OF02I85EE.49.73.G07.1.454.CMB.1.raw
  modified_base (109)..(109): a, c, t, g, unknown or other
  misc_feature (109)..(109): n is a, c, g, or t
  modified_base (497)..(497): a, c, t, g, unknown or other
  misc_feature (497)..(497): n is a, c, g, or t
tcagagtcgagagacacgaccggtgctcgatttagctctacgctcagggcacgaccggtgctcgtttagagagagtgtgtggttgggggttgggggtccgacgaggcgngaactactgggtggtctcaccactggccgtcggagtccctcctacttactccccctccctcactctctgcacagactctgaggcctcctactagtaggctcgacaccacgcccaccctaccggtgtctgtcgtcctcacggacgacgacggccagtatccacctcgctactggaggattgcattagccaaaacgcaatatgtacctttacgacggttaccaaggcaacggaaagccccgagggtacccgacggtccccccgtgtactttcgaattacctaattttaataaaaagtccttttaggaggacggggtccctaccgaacggggacccccgttgagccggtatttacctcgttcggcgtcccagccgtacaggccgaacaacncgtacgtaccgtcggttaaccactcagggttcggacggtaccggggtccgaaggaagggtaacccgggcggttacggttcgaaacgtttaaccgtttacgttagtaacccgtccggtaccccgttacaaccgggtaacgacggtacgaacggtacggggaccgttagtttaacggtaggtttcccgggtaagttttcccgggggaccggggggaacggg

SEQ ID NO: 67097 - DNA, 624 bp, Homo sapiens
  misc_feature: GYAE6OF02IZTS4.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacggccagtatcacctgctctggagatgcattgaccaaagcaaatatgcttactggtaccagcagaacgccaggccacggcccctgtcttgatcatttaataaagtactttgagagggcctacgacgggacccctgacgcgtattctcgtggcctcagctcgagcgaacaacgtagtcacgttcgaaccacttccgaggtagggaccggtccggggacgtacgggaacgggacggacgggcgttacggtaacctttaacgtttaccgttaggttacctaaggttaccaagtttaccgaacggtaacctaagggttacggttacgggtaccttacccgttttacgtttaccggttcggtttaaccggtttccgggggaccggttaaacccggggg

SEQ ID NO: 67098 - DNA, 585 bp, Homo sapiens
  misc_feature: GYAE6OF02F6UB9.49.73.G07.1.454.CMB.1.raw
tcagagtcgagagacacgaccggtgctcgatttagctctacgctcagggcacgaccggtgcccgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcgaggacagacggccagtatcacctgctctggagatgctattcgaccaaagcaatatgcttactggtaccagcagaacgccgaggccacggcccctgtctgatctatttataaagtacttgagacggcctgacggccctgacgtcgtattctcgtcggcctccgagtctcgagcgaacaacagtaccacggttcacctactcgaggtacggacggtccgggacgtagggacggacggacggtcgtaggtaacttacgttacgtggtactacggttacactacgaacggtacgtaaggttaggtacggtcttaaccgttcgttacggttccggttaggttccgggtacgggtacggtaacccg

SEQ ID NO: 67099 - DNA, 503 bp, Homo sapiens
  misc_feature: GYAE6OF02JBD31.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgagggatccctgagcgattctctggctccagctcgagggacaacgagtcacgttgaccatcagtggagtccaggcagaagacgagcgtagaacttagttatgtacatcagcagactaccggtgtacttagtcggtgttacgggcggtaggacaacgg

SEQ ID NO: 67100 - DNA, 551 bp, Homo sapiens
  misc_feature: GYAE6OF02JA28X.49.73.G07.1.454.CMB.1.raw
  modified_base (425)..(425): a, c, t, g, unknown or other
  misc_feature (425)..(425): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtcgtcctcaggacagacggcagtatcacctgctctggagatgcattgccaaagcaatatgcttactggtaccagcagaagccaggccaggcccctgtctgatcatttataaagtactttgagagggcctcgacggacccctgacgcgattctcgtgctccagctcagcacaacagtcacgttcgaccatcaggtggacgtccggganaggaggacgaggtcgtagtaccttaagtaccttgtaccgtagtcgaatcaaggtaacaggttaacggtcggtaccgttaccgtttcgttggttaccgtaacgtttccggggacggtaacccggggg

SEQ ID NO: 67101 - DNA, 148 bp, Homo sapiens
  misc_feature: GYAE6OF02IFBI5.49.73.G07.1.454.CMB.1.raw
  modified_base (123)..(123): a, c, t, g, unknown or other
  misc_feature (123)..(123): n is a, c, g, or t
  modified_base (129)..(148): a, c, t, g, unknown or other
  misc_feature (129)..(148): n is a, c, g, or t
tcagagtcgagagacacgaccggtgctcgatttagctctacgctcaagggcacgaccggtgctcgatttagtcactctgttcccaccctcctctctctcgactctgagcgggctggcaaggcncatagnnnnnnnnnnnnnnnnnnnn

SEQ ID NO: 67102 - DNA, 220 bp, Homo sapiens
  misc_feature: GYAE6OF02HY5UF.49.73.G07.1.454.CMB.1.raw
  modified_base (171)..(176): a, c, t, g, unknown or other
  misc_feature (171)..(176): n is a, c, g, or t
  modified_base (178)..(220): a, c, t, g, unknown or other
  misc_feature (178)..(220): n is a, c, g, or t
tcagagtcgagagacacgaccggtgctcgatttagctctacgctcaggggcacgaccggtgctcgatttacgtcacggccgagaaagggaaagggggcctggccctgacgtgtttctgtttcccaccctcctctctctcgactctgagcgggctggctaaggcgcatagtnnnnnntnnnnnnnnnnnnnnnnnnnnnnnnnnnnnnnnnnnnnnnnnnn

SEQ ID NO: 67103 - DNA, 505 bp, Homo sapiens
  misc_feature: GYAE6OF02IYJN9.49.73.G07.1.454.CMB.1.raw
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgacggcctcctatgagctgacacagcccaccctcggtgtctgtgtcctcaggacagacggccagtatcacctgctctggagatgcattgccaaagcaatatgcttactggtaccagcagaagccaggccaggcccctgtcttgatcattttataaagacttttagagagggctcgagggacccctgagcgtattctctgctccagctcagcgacacagtcacgttcgacatcngtggcgtccggngaggaggacgaggctgacttattctgtcatcatccgagacagtagtcgctacttcgtgttcgtacgttccgggaggtaacggg

SEQ ID NO: 67104 - DNA, 666 bp, Homo sapiens
  misc_feature: GYAE6OF02FQFEF.49.73.G07.1.454.CMB.1.raw
  modified_base (394)..(394): a, c, t, g, unknown or other
  misc_feature (394)..(394): n is a, c, g, or t
tcagagtcgagagacacgaccggtgctcgatttagctctacgctctagggggctacgaccggtggctcgtttagagagagtgtcgttagggtttgggggtgggtcccagggacggcgaacgaacgtctgggtgtcctcaccactcggccctagggactccctcgtacctttccctcccccgtcctccaccttcctacgtgccaccagacgtcctgacggccctcctagtgagctgacacgacgccctaccccgtgggtcgtctcggttcgtccgtcgacgggaccaggaccggccgagtactccacctgctcgtggagatgcattgaccaaagcaatatgcttacgtggtaccagcagaagccaggccacgccctgtccttgactctatttaanaaagtctttaggagacgggcctcgacgggacccctgacgcgtacgttcctcgtcggtcctccacgtcctcgacggaccgaacaacgacgtacctacggttacgaaccctattaccgaggttcgggacggtccggacggaaggacggacgggacggcttacggaaccgttatacgttcgtacgtacgtctaactacgaaggtaaccgtaggttacggttacgaccgtacgtttcgtcggtttacccgtaggtttccgggacgggtaacccggg

SEQ ID NO: 67105 - DNA, 161 bp, Homo sapiens
  misc_feature: GYAE6OF02H3OQL.49.73.G07.1.454.CMB.1.raw
  modified_base (161)..(161): a, c, t, g, unknown or other
  misc_feature (161)..(161): n is a, c, g, or t
tcagagtcgagagacacgaccggtgctcgatttagctctacgctcagggcacgaccggtgctcgatttagtcacgcgagaaagggaagggggctggccctgacgtgtttctgttcccgcctcctctctctcgactctgagcgggctggcaaggcgcatagn

SEQ ID NO: 67106 - DNA, 576 bp, Homo sapiens
  misc_feature: GYAE6OF02I4UOP.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtcctgtgtcctcaggacaggacggccagtatcacctgctctggagatgcattgaccaaagcaatatgcttactcggtaccagcagaagccaggccaggcccctgtctgatcatttataaagtactttggagagggcctcgacgggtaccccctgacgcggtacttcgtacgtggtcctccgagccgtacgacgaccgaaccaacgtagttaccgaccgtttcgaacctagtcgtacgttgggacgtccgggacaggtaggaccgaggctagtacttattacgtgtacagtactactacgacgaaccgtaggtaacgtcgaccgtactttcgtacggttcggtacgttcgggtacggtaaccggg

SEQ ID NO: 67107 - DNA, 520 bp, Homo sapiens
  misc_feature: GYAE6OF02HIKO3.49.73.G07.1.454.CMB.1.raw
  modified_base (276)..(276): a, c, t, g, unknown or other
  misc_feature (276)..(276): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatangcttactggtaccagcagagccaggccacggcccctgtcttggtgatttaataaagtactttgagacggccctcgacgggacccctgacgcgattctcgtggctccagctcgagggacaacagtcaccttgaccatcagtgacgtcgcagacggacgaggcagactattacgtgtcgacgtccgcacgacgagcaggtcggactagttagtggtacgttagttcgggacgggtaggacgtacgg

SEQ ID NO: 67108 - DNA, 581 bp, Homo sapiens
  misc_feature: GYAE6OF02GKW67.49.73.G07.1.454.CMB.1.raw
  modified_base (142)..(142): a, c, t, g, unknown or other
  misc_feature (142)..(142): n is a, c, g, or t
  modified_base (211)..(211): a, c, t, g, unknown or other
  misc_feature (211)..(211): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctcctatgagctgacacagccaccctggtntctgtcgtcctcgaggacaggacggccagtatcacctgctctggagatgcattcgaccaaagcaatatgcttacgtggtaccagcagaagccacggccacggccctgtcttgattctatttataaagtctttagagacgggtcctacgacgggaccctgacgcgtattctcgtcggcctccgagtcctacgacgcgaacaacgtacgtccgacgttcgaacctatacgtaggtcgggacggtccgggacgtaacggacgggacggaggtacgtagtaaccttaattacgtgtacgtagtcactgaacgacgtaggtaggtcggactacgtttcgttacgttacggttacggttacgggacggtaaccggg

SEQ ID NO: 67109 - DNA, 579 bp, Homo sapiens
  misc_feature: GYAE6OF02HKABH.49.73.G07.1.454.CMB.1.raw
tcagagtcgagagacacgaccggtgctcgatttagctctacgctcagggcacgaccggtggctcgtttagagagagtgtgttgggtttgggggtgggtccaggaggcagaactctgggtgtctcaccatggcctggatccctctacttctccccctcctcactctctgcacagactctgaggcctcctatgtagctgacacagccaccctcggtgtctgtgtcctcaggacagacggccagtatcacctgctctggagatgcattcgaccaaagcaaatatagtcttactcggtaccaggccaagaagccgaggccacggccctgtcttgactctatttaactaaagtactttgagtacggcctacgacgggaccctgacgcgattctcgtggctcgagctacgagacgaactaacgtagttacctacgttacgacctactacgtaggtcggacggtccgggacgacggtacgggacggtacgggcgtacgaacgttaacgttaacgtcgtactagtctagtcgaagactaggtagtcgtactacttacgtcgttacgtacgttccgggaggtaacggg

SEQ ID NO: 67110 - DNA, 654 bp, Homo sapiens
  misc_feature: GYAE6OF02IBY4R.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctggtgtctgtgtcctcaggacagacggccagtactcacctgctctaggagatgctattcgaccaaagacaattatcgtacttacgtacgtaccagacaagaacgccgacggccgacggtccccgtgttcttagactacttaatttaaataaagttctttaggacggtacggtcctacggaccgggacccctagacgccgtactttccgtcgtcggtcctccgacgtccgtacgacgtaccgaaacaacgaacgtccgtaacgttacgacctagtacgaggttacggaccgggtccgggacgagggaacgggacggacggtccgtaacgtaactttaacgttacgtcgttacgtacgtccaacgttaccgaaggtaaccgtagggtacgtccggtacttaccgtttcggttggttaccggtttacggttaccggggacggtaacccggg

SEQ ID NO: 67111 - DNA, 581 bp, Homo sapiens
  misc_feature: GYAE6OF02HU36E.49.73.G07.1.454.CMB.1.raw
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (470)..(470): a, c, t, g, unknown or other
  misc_feature (470)..(470): n is a, c, g, or t
  modified_base (503)..(503): a, c, t, g, unknown or other
  misc_feature (503)..(503): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctcctcactctctgcacagactctgacggcctcctatgagctgacacagccaccctcggtgtctgtgtcctcaggacagaccggccagtatcacctgctctggagatgcattcgaccaaagcaatatgcttactggtaccagcagaanccaggccacggcccctgtcttgatctaattttaanaaagtactttgaggagggtccctacgacgggaccctggacgcgtattcctcgtcggcctccgagtcctacgacgacgaacaaacgtacgtaccgtaacgttcgaaccctatcgtaaggtgggacggtccggganaaggaagggacgacggctagacttaacgttacngtacagtactactacgaagaacgtaggtaggtcggactacgtttcgtcggttacgtacgttccgggagggtaaccggg

SEQ ID NO: 67112 - DNA, 571 bp, Homo sapiens
  misc_feature: GYAE6OF02GDRQ4.49.73.G07.1.454.CMB.1.raw
  modified_base (560)..(560): a, c, t, g, unknown or other
  misc_feature (560)..(560): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctggtgtctgtgtcctcagggacaggacggccagtatccacctgctctggagatgcattgccaaagcaatatgtcttactggtaccagcagaacgccaggccacggccctgtctgatctaatttaataaagtactttagaggtacggtccctacgacgggacccctgagcgtattctcgtcggcctccgagcctcgagtcgaaccaacgtacgtacacgttgaccatacgagtaggacgtccgggacgaggaacggcgagggctacgtacgttaacttacgttacgacgtagtacgtaatcacggaactaggtacgtcggttacaccgtttcgtcgtacgttaggtttaccggngggtaaccggg

SEQ ID NO: 67113 - DNA, 644 bp, Homo sapiens
  misc_feature: GYAE6OF02JVVXY.49.73.G07.1.454.CMB.1.raw
tcagagtcgagagacacgaccggtgctcgatttagctctacgctcagggcacgaccggtgctcgtttagagagagtgtgttgggtttgggggtgggtccgaggaggcagaactctgggtgtctcaccatggcctggatccctctacttctccccctcctcactctctgcacagactctgaggcctcctatgagctgaccacagcccacccgtcggtgtctggtgtccctcaggacaggaccggccagtactcacctgctctggagatgctattcgaccaaagcaaatatgccttacgtacggtaccagacaagaacgccacggccacggcccctgtctgactctattaagaagtactttaggagacggtcctacggacggtaccctagacgtcgtattcctgtcggtcctcgtacgtcctacgtacgccgaacaacgtacgtaccgtacgttacaacccgtacgttacgacggtagggtaccggtacccgggacgtaacggaacgggaaccgggacgggtcctaggtaaccttacgttacgttcgtaccgattaccgactaccgtaagtacgtaaggtacggtacggtaccttaccggtttcgtacggtttaccggttacggtttaccgggacgggtaaaccgg

SEQ ID NO: 67114 - DNA, 593 bp, Homo sapiens
  misc_feature: GYAE6OF02HC31H.49.73.G07.1.454.CMB.1.raw
  modified_base (224)..(224): a, c, t, g, unknown or other
  misc_feature (224)..(224): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatcacctgctctggagatgctattcgaccaaagcaatatagtcttactggtaccagcagaagccagccacggcccctgtcttgatctatttataaagtactttagagtaggcctcgacgggtaccctgacgtcgacttctcgtcgtcctacctgctcgacgtacgaacaacgtagtccgacgttcgaacctatcgaggtcggacggtccgggacgaaggacggacggacggtctaggtaacttaacttacgtacgtctaggtacctaagtacgaacggtaactaaggttacggttacgtaccgttaacgtttccgttacggttcggtaacggttccggggacgggtaaccggg

SEQ ID NO: 67115 - DNA, 184 bp, Homo sapiens
  misc_feature: GYAE6OF02HQXO7.49.73.G07.1.454.CMB.1.raw
  modified_base (178)..(184): a, c, t, g, unknown or other
  misc_feature (178)..(184): n is a, c, g, or t
tcagagtcgagagacacgaccggtgctcgatttagctctacgctcagggcggtgctcgatttagctctacgctcagggcacgaccggtgctcgatttagtcacgcggaaaggaaggctagcgtgttcctgttccacctcctctctctcgactctgagcgggctggcaaggcgcatagnnnnnnn

SEQ ID NO: 67116 - DNA, 587 bp, Homo sapiens
  misc_feature: GYAE6OF02JJ8WN.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacggtcagtatcacctgctctggagatgcattgccaaagcaaagtatgcttactggtaccagcagaacgccaggccacggcccctagtccttgactctaatttataaagtactttagaggtacggtcctacgacgggtacccctggaacgtcgtacttcgtactcggtctccgagtcctacgacgacgaacaactacgtactacgttacgaccatccgaagtcggaacggtccgggacgacggaggacggaggtcgtagtacttagtacgtcgtactacgtactataccgaagtaccaggttacggtcggtacgtacgttcgttacggttcgttacggttacgggacggtaaccggg

SEQ ID NO: 67117 - DNA, 252 bp, Homo sapiens
  misc_feature: GYAE6OF02G4PEM.49.73.G07.1.454.CMB.1.raw
  modified_base (202)..(208): a, c, t, g, unknown or other
  misc_feature (202)..(208): n is a, c, g, or t
  modified_base (210)..(252): a, c, t, g, unknown or other
  misc_feature (210)..(252): n is a, c, g, or t
tcagagtcgagagacacgaccggtgctcgatttagctctacgctcaggggtcacgaccggtgctcgatttagacgacagctcagggacgaccggttgctcgatttagtcacgcgagaaagggaaagggggctggccctgacgtgtttctgttcccggccctcctctctctcgactctgagtcgggctggcaaggcgcatagnnnnnnngnnnnnnnnnnnnnnnnnnnnnnnnnnnnnnnnnnnnnnnnnnn

SEQ ID NO: 67118 - DNA, 618 bp, Homo sapiens
  misc_feature: GYAE6OF02JQT1C.49.73.G07.1.454.CMB.1.raw
  modified_base (142)..(142): a, c, t, g, unknown or other
  misc_feature (142)..(142): n is a, c, g, or t
  modified_base (256)..(256): a, c, t, g, unknown or other
  misc_feature (256)..(256): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctctatgagctgacacagccaccctggtgtctgtcgtcctacgaggacagacggccagtatcacctgctctgganatgcattgaccaaagcaatatgacttactggtaaccagacaagaagccaggccaggccctgtcttgatctattataaagtctttgacgagggtcctacgacgggtacccctagacgtacgtacttcgtacgtgggtacctcccaagtcctacgacgacgaacaaacgtagtaccgtacgttacgacctagtcgaacggttaggacggtacccggggactaacgggacggaacggacgggtacgtacggtaacttacgtttaacgtacggttcctaacgttccagtaaccgtagtaaccgtaggtaacgtcggacttacgtttcggtaccgttcggttacggttaccgggacgggtaaccggg

SEQ ID NO: 67119 - DNA, 683 bp, Homo sapiens
  misc_feature: GYAE6OF02FF3N7.49.73.G07.1.454.CMB.1.raw
  modified_base (142)..(142): a, c, t, g, unknown or other
  misc_feature (142)..(142): n is a, c, g, or t
  modified_base (176)..(176): a, c, t, g, unknown or other
  misc_feature (176)..(176): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactcngaggcctcctatgagctgacacagccaccctggtcgtctggtcgtcctcgaggacaggccggcctagtactccaccgtgcctctggacgatgcattcgccaaagcaatatgtcttactggtaccagcagaacgccaggccacggcccctgtcttgatctatttataaagtctttgaggacgggccctacgacgggacccctgacgtcgtaacgtttcctcgtcgggccttccgacggtcctacgacggacgaaccgaaacgtacgtaccgtaaccggtttaccgaacccgtagttaccgtacggtacggggtaccgggttacccggggacgaacgggaacggggacggtaacgggtaccgttaacgtaaccgttaactttaccgttcggttactaccggttaccgaacgtaccgtaaacggtaccgtaagggttaaccggtcgtacccgttacgtttccgttaccgggttacggtttacggttaccggggaaccgggtaacccgggg

SEQ ID NO: 67120 - DNA, 544 bp, Homo sapiens
  misc_feature: GYAE6OF02GGTRT.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaaatatgcttactggtaccagcagaagccaggccaggcccctgtcttgatcatttaataaagtacttttgagacgggtcctacgacgggtacccctgagcgattctcgtcggcctccgaggtcgaacgggaccaaacggtcaacgtagttcggaccagttcgagtcgggagtccgaggccaggaggacgaggctagacttattatgtacaatcaacagaccacgtattggtaacttagttgtcttacggaactcgaccgaccgtagtacccg

SEQ ID NO: 67121 - DNA, 710 bp, Homo sapiens
  misc_feature: GYAE6OF02JOQPJ.49.73.G07.1.454.CMB.1.raw
  modified_base (143)..(143): a, c, t, g, unknown or other
  misc_feature (143)..(143): n is a, c, g, or t
  modified_base (242)..(242): a, c, t, g, unknown or other
  misc_feature (242)..(242): n is a, c, g, or t
  modified_base (324)..(324): a, c, t, g, unknown or other
  misc_feature (324)..(324): n is a, c, g, or t
tcagagtcgagagacacgaccggtgctcgatttagctctacgctcagggcacgaccggtgctcgtttagacgagagtgtgttgggttggggtgggtccaggaggcaggaactctgggtgtctcaccgatggcctggatccctntacttctcccctctcactctctgcacagactctgagtcctcctatggacgctagacacgagccaccctggtgtctgtgtcctcagacagacgcagtacncacctgctcgtggactatgaccgtattcgaccaaaagctaattatcggtaccttacgtacggtaccaagaccaaggtaaccnccgaaggcccaaccgggtccccttaggttaccgttagtacttacctaagtttaaactaaacggtacgttttagggaaggaccgggtccctacgggtaaccgggtacccctggaacggtcgtaacgtttccgtacggtcggtaccgtccgtaacggtccttacgacggtaccgaacgtaaccgtacgttaccgtacggttacggtaaccgtacgttaccgtaggggtacggtaccgggtaccgggacgaacgggtacggaccggtacggtcctaacggtaccttacgttaccgtacggtacgtacgtcctacgtaccggtacgtacgttaacggtagtaccggtactacgttcgtcgttacgtacggttaccgggacggtaaccggg

SEQ ID NO: 67122 - DNA, 520 bp, Homo sapiens
  misc_feature: GYAE6OF02G7IVC.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttctccccctctcactctctgcacagactctgaggcctcctatgagctgacacagcccaccctggtgtctgtgtcctcaggacagacggccagtatcacctgctctggagatgcattgccaaagcaatatgcttactggtaccagcagaagccaggccaggcccctgtcttgatcatttataaagtactttgagagggcctcgacgggacccctggacgcgtattctcgtcggctccagctcagcgaacaacacgtcacgttgaccatcagtggagtccgggcaggaggacgaggctagacttattactgtcagtcatcaagactaggtaaggtggactacgtttcgtcgttcgtagttcgggcgggtaacggg

SEQ ID NO: 67123 - DNA, 210 bp, Homo sapiens; identical to SEQ ID NO: 66963
  misc_feature: GYAE6OF02IV3CC.49.73.G07.1.454.CMB.1.raw
  modified_base (208)..(210): a, c, t, g, unknown or other
  misc_feature (208)..(210): n is a, c, g, or t

SEQ ID NO: 67124 - DNA, 543 bp, Homo sapiens
  misc_feature: GYAE6OF02HAEZC.49.73.G07.1.454.CMB.1.raw
  modified_base (386)..(386): a, c, t, g, unknown or other
  misc_feature (386)..(386): n is a, c, g, or t
  modified_base (533)..(533): a, c, t, g, unknown or other
  misc_feature (533)..(533): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggcccctgtcttgatctatttaataaagacgtttgaggacgggtcctcgacgggacccctgagcgatttctctggctccngctcgacgcgaacaacagtccacgttcgaccatcgagtggacggtccgggcgaggagggacgaggcgttagacttagttactgtacgtagtcagtcgaacgactaggtacgtggtactacgtttcgtggttacggtacgttccgggnggtaaccggg

SEQ ID NO: 67125 - DNA, 576 bp, Homo sapiens
  misc_feature: GYAE6OF02I5JQK.49.73.G07.1.454.CMB.1.raw
  modified_base (142)..(142): a, c, t, g, unknown or other
  misc_feature (142)..(142): n is a, c, g, or t
  modified_base (455)..(455): a, c, t, g, unknown or other
  misc_feature (455)..(455): n is a, c, g, or t
  modified_base (565)..(565): a, c, t, g, unknown or other
  misc_feature (565)..(565): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctcctcactctctgcacagactctgaggcctcctatgagctgacacagccaccctggtgtctgtgtcctacaggacagacggccagtatcacctgctctggagatgcgattcgaccaaagacaatatcgtactttacgtacggtaccaggctaaggaacgccgacggcccgacggtcccccgtagttccttagattactaattttaaagtaaagtactttaggagacgggtcctacggacggaccccgtgacgcgtacttctcgtcgctccgagtctcgagcgaacacagtacacgttcacnctcgagtcggaggtccggagaggacggacggagctagtactaagttacgtagtcagtctagactaggactaaggtaggtcgacttcttacgtcgtacggttagtccgggngggtaaccggg

SEQ ID NO: 67126 - DNA, 716 bp, Homo sapiens
  misc_feature: GYAE6OF02I5LKZ.49.73.G07.1.454.CMB.1.raw
  modified_base (164)..(164): a, c, t, g, unknown or other
  misc_feature (164)..(164): n is a, c, g, or t
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttctccccctctcactctcngcacagactctgaggcctcctatgagctgacacagcccacccgtggtgtctggtcgtcctnaggaccaggaccggccagtatccacctgcctctgganatgctattgaccaaagctaatatcgactttacgtaggtacccagacaggaaacgaccacggcccgtaacggcccccttagtccttgactaccgtaagttttaactaaaagtaccgttttaggaacggtacggggtaccctaccggtaacggggacccccttagacggtacgtaacgttcttcgtcggtaccgtccacgtcctacgacgtaccgaaccaaacgtacggtacccgtaccgttaggtaaccctacgtacgtaacgggttaccgggacggtcccggggaacgaacggaacgggaaccgggtacgggaccgttaacggtaaccttaaggttaacctcggttaaccgtacgtactaacggttacgaaccgtaaacggttacgtaacggtacggtacgtaacgtttcggttacggttaaccgtttacggtttccggggagggtaacccggg

SEQ ID NO: 67127 - DNA, 522 bp, Homo sapiens
  misc_feature: GYAE6OF02IQXXO.49.73.G07.1.454.CMB.1.raw
  modified_base (447)..(447): a, c, t, g, unknown or other
  misc_feature (447)..(447): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttaacgtgtaccagacaagaacgccaggcccacggcccctgtcgttgatcaatttaataaagtactttagaacggagggccctcgacgggacccctgacgcgtatttctctggcctccgagctcagccaacaactagtcacgttcgaaccatcgagtggaggtccggngaggaggacgngntgacttatcgtgtacagtcatcaagctagtgtgctacttcgagttgtacgtcggaggtacgg

SEQ ID NO: 67128 - DNA, 709 bp, Homo sapiens
  misc_feature: GYAE6OF02H56BV.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcgaggacaggacggccagtatcacctgctcgtggagatgctattgaccaaagacaatatgtacttacgtggtaccagacaaggaacgccaggcccgacggtcccctgtcttagacttactaattttaataaagtacgttttagaacggtacgggtacctacgacgggtaccccttggacgtacgtacttccgttcgttcggtccgtaccctacgtccgtacgacgaccgtaaccaaccgtaacgttaccgtacggttacgtaaccgtaacgtacgtaggttacgggtacgggtaccgggacggtaacgggaacgggacgggacgggtaccgtcgttaaaaaaaaacgttcgttaacgttacgttacgtaacgttacgtaacgttacggaacggtaaccggttaacggttacggttacggtaccgttacgttttccggttacgggtttaccggtttaacggtttaccggggtacggggtaacccgggg

SEQ ID NO: 67129 - DNA, 719 bp, Homo sapiens
  misc_feature: GYAE6OF02HXVQO.49.73.G07.1.454.CMB.1.raw
  modified_base (119)..(119): a, c, t, g, unknown or other
  misc_feature (119)..(119): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttctccccctctcactctctgcacagactctgacggcctcctatgagctgacacagccaccctcggtgtctgtgtcctgaggacagaccgccagtactcacctgctcgtggagatgctattcgaccaaagcaatatgtacttacgtggtaccagcaagacgtccaggaccacggtccctgttccttagatacgttaatttaaacgtaaacgttacgttttaggaacggtacgggtaccccttacggaaccggggtaaccccttagggaacggtaccggttaacgttttccgttaccggtttcgggtacccttacccgtaacggtccttacgacggtacccggaaaactaaaccgtaacgttccgtaacggtttaacggaacccttaaggtaccgtacggttacggggacggttacccggggacgaaacgggacgggtaacgggaggtccgtaacgtaaccttacgttacgtacgttacgacgttaccagttaccgaacgtaacgtagggtaacggtacggacttaccgttcggttacggttaccggttaacggttccggggacgggtaaccggg

SEQ ID NO: 67130 - DNA, 532 bp, Homo sapiens
  misc_feature: GYAE6OF02GVBGJ.49.73.G07.1.454.CMB.1.raw
  modified_base (211)..(211): a, c, t, g, unknown or other
  misc_feature (211)..(211): n is a, c, g, or t
  modified_base (325)..(325): a, c, t, g, unknown or other
  misc_feature (325)..(325): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctggtntctgtgtcctcaggacagacggccagtatcacctgctctggagatgcattgaccaaagcaatatgcttactggtaccagcagaagcaggccaggcccctgtcttgatcatttanaaagtactttgagacgggcctcgacgggacccctgacgcgtattcgtcgtggcctccagctcagcgaacaacagtcacgttcaccatcagtcggacgtccgggacaggaggacgaggctagaccttattacgtgtactagtcatcgaagtactaggtagtcggtactacgtttcgtaggttaccgttacgttcgggcgggtaacggg

SEQ ID NO: 67131 - DNA, 653 bp, Homo sapiens
  misc_feature: GYAE6OF02F3RVO.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccccgtggtgtctgtcgtcctcgaggacaggaccggcctagtactccacctgcctcgtggagagtcgactagttcgaaccaaagactaaatatcgtactttacgtacggtaccagacgaagaacgccgacggccgaccggtccctgtcttagtatactatttaagtaaagtacttaggaggacggtcctacggaccggaccctagacgtacgtacttcgtcgtgtcctaccgacgtcctacgacggaccgaaacaaccgtacgtaccgtacgttacgaacctacgttacgacggtcgggacgggtccgggacgaagggtacgggacggtacggcgtacgtaacttacgttacgttcgtacgtacgtactacgtacgaacgtacgtaacggttacggtacggtaccttacgttacgttcggttacgttacggtcgggaccgggtaaccggg

SEQ ID NO: 67132 - DNA, 543 bp, Homo sapiens
  misc_feature: GYAE6OF02GXQY9.49.73.G07.1.454.CMB.1.raw
  modified_base (260)..(260): a, c, t, g, unknown or other
  misc_feature (260)..(260): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtcgtcctcgaggacaggaccggccagtatcacctgctctgganatgcattgaccaaagcaatatgcttacgtggtaccagcagaagccgaggccacggcccctgtcttgatcatttataagtactttggagacgggcctcgacgggaccctgacgcgtattctcgtcggcctccgagctcgacgccgaacaacgagtccacgttcgacctagtcgaggtaggacgtccggggacaggagggacggaggcgttagaccttaagttactgtacagtcatcgagacaggtagtcggctacttcgtcgtacgtacgttcggaggtaacgg

SEQ ID NO: 67133 - DNA, 647 bp, Homo sapiens
  misc_feature: GYAE6OF02JD7XW.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcccggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggccctgtcttgatctatttaataaagtacgtttagagagggtcctcgacgggacccctagacgcgtacttctcgttgggctccgacgccgtacacgaccgaacaaaccgaacgttcctaacggtttacgaaccctaactacgacgggtggtacgggttcccggggacgtaaggacgggaaccggacgggtacgtaggtaacctttaagtttacgttacggttaccgtaacgttacctacgttacgaacggtaacgtaacggttaggtacgggtccttaaccgtttccggttacggttaccgttaccggttaccggggtaccggggacgggtaaaccccgg

SEQ ID NO: 67134 - DNA, 705 bp, Homo sapiens
  misc_feature: GYAE6OF02IZSYL.49.73.G07.1.454.CMB.1.raw
tcagagtcgagagacacgaccggtgctcgatttagctctacgctcagggcacgaccggtgctcgtttagagagagtgtgttgggtttgggggtgggtccgaggaggcagaactctgggtgtctcaccatggcctggatccctctacttctcccctcctcactctctgcacagactctgacggcctcctatgagctgacacacgccaccctcggtgtctgtcgtcctacgaggacacggacggccagtactcacctgcctctggagatgctattcgaccaaagactaatatgtccttagtcggtacctagacgaacgaacgaccgacggacccacggcccctgtcttgactacgtaatttaataaacgtactttaggacgtagggtccctacggacggtacccctagacgtcgttaatttcctacgtcggtaccgtaccacggtcctacgacggaccgtaaccgaaactacggttactaccggttacgaccgtactcgtaacggtcggtacgggtaccgggacgtaacgggaacgggtaccggagggtaccgtacggttaacgttaacgtttacgtcggttacctaggtaccctaaggtacccgtaaggttaaccggtacggtttaacgggtaccggtaccgttaacgtttaccggttacggtttaaccgggtttacgtttacccgggggacgggttaaaccgggg

SEQ ID NO: 67135 - DNA, 780 bp, Homo sapiens
  misc_feature: GYAE6OF02HIK7I.49.73.G07.1.454.CMB.1.raw
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
tcagagtcgagagacacgaccggtgctcgatttagctctacgctcagggcacgaccggtgctcgtttagagagagtgtgttgggtttgggggtgggtccgagggaggcaggaactcgtggggtgtctcaccatggcctggatccctctacttctccccctcctcactctctgcacagtactctgacggcctcctatgagctagacacagccacccttcggtgtctgtcgtcctcaggacaggacggccagtactcaccgtgtctcgtggagatgactattcggaccaaaagtcaattngtacttacgnggtaaccagacaagaagccccgagggtacccacgggtccccctggttctttacgaactaccttaaagttttaaaacctaaaagggttaccttttagggaaaacggtacgggggtaacccctacggtaacccgggggaccccttaggggaacgtacccgggttaatttccggtacgtttaccgggaccttcccgaacgccgttaccgaacggtaccgaacaaaccggtacttaaccgtacggtttacggaacctaacttccgaaacggttcgggaaacgggtccccggggaagtaacgggaaacgggacgggaacggtacggtacgtaaacgttaacgtttaacgtacgtaccgttacgtacgtacgttaacgaaggtaacccgtaagggttaaggtacccgggttactaacccggttttgttaaccgggttaccggttttacggttacccggggtacgggtaaacccggggg

SEQ ID NO: 67136 - DNA, 567 bp, Homo sapiens
  misc_feature: GYAE6OF02GKDD1.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatccacctgctctggagatgcattgaccaaagcaatatgacttactggtaccagcaagaagccaggccacggcccctgtcttgatctaatttataaagtactttgagagggcctcgacgggacccctgacgcgattcctcgtggtcctccacgtctcgacgcgaacaacgagtaccacgttcgaaccatcgagtcggacggtccgggagaggaggacgaggctagacttaactacgtacgtcagtacacgtacaacggtactaacggttaggtacggacctaacgtttcgttacggttccgtttacggttccgggacggtaaccggg

SEQ ID NO: 67137 - DNA, 508 bp, Homo sapiens
  misc_feature: GYAE6OF02FYAHK.49.73.G07.1.454.CMB.1.raw
  modified_base (223)..(223): a, c, t, g, unknown or other
  misc_feature (223)..(223): n is a, c, g, or t
  modified_base (375)..(375): a, c, t, g, unknown or other
  misc_feature (375)..(375): n is a, c, g, or t
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctnaggacagacggccagtatcacctgctctggagatgcattgccaaagcaatatgcttactggtaccagcagaagccaggccaggccctgtcttgatcatttataaagctttgagagggcctcgagggacccctgagcgattctctggctccanctcagcgacaacagtacacgttgaccatcagtggacgtccgggnaggaggacgaggctggacttagttacngtacagtacatacgagacagtagtggactacgttctgttacgtacgttcgggcggtaaccgg

SEQ ID NO: 67138 - DNA, 704 bp, Homo sapiens
  misc_feature: GYAE6OF02JGXMB.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacggccagtatcacctgctctgagatgcattgaccaaagcaactatcgactttacgtggtaccagaccaggaacgccacggccacggcccctggttcttaggatctaatttaataaacgtacttttgaaggtacgggccctcggacgggtacccctggacgtacgtagtttcctcgtcggtcctacccgacgtaccttacgacggtacccgaacaacgtacgtacctaaccggtttacgaacctacgtaccgtaacggttcgggtaacgggtaccccggggcgtaaaaacgggcgggtaaacccgggaacgggtaccggttaacggtaaccgtttaacggtttaaccgtacggttaccgaacggttaccacggttaccgaacggtaaccgtaacggtacgggttaccggtacctaaccggttttccgttaacggttaccggtttacggtttacccggggaccgggtaaccgggg

SEQ ID NO: 67139 - DNA, 571 bp, Homo sapiens
  misc_feature: GYAE6OF02JL04L.49.73.G07.1.454.CMB.1.raw
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
  modified_base (483)..(483): a, c, t, g, unknown or other
  misc_feature (483)..(483): n is a, c, g, or t
  modified_base (515)..(515): a, c, t, g, unknown or other
  misc_feature (515)..(515): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctcggtgtcagtcgtccccaggacagacggccaggatcacctgctctggagatgctattgaccaaaccgtatatgtcttagttacggtacagcgaaggaacgcccgggaccgaccggtcccccgtggttacgttcggttagagttagtaagtaaacgtacacgtaggacgacggacccgtacgagggtactcccgtgagtcgtacttcgtcgtgcctcgagtcgaggacacggtcanacgtcgacntcgagtgctcgagcgaggacgacggagtcgngactagttactgtacagtacagtacagtacgnggtaagtggtactactacgtgttcggtacgttaccgggacggtaggaccgtaacgg

SEQ ID NO: 67140 - DNA, 600 bp, Homo sapiens
  misc_feature: GYAE6OF02IM679.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagaccggccagtatcacctgctctggagatgcattgaccaaagcaatatgcttactggtaccagcagaacgccgaggccacggcccctgtcttgatcaatttaataaagtactttggacgtacgggcctacgaacgggtacccctagacggcgtactttccgtcgtcggcctccgagcctacgacgacgaacaacacggtacacgttacgaacctatcgaggtgggacggtccgggcaaggacgggacggtagggctagtaaccttattacgttgtactagttacaacgttcgaacgtaaccgtaggttacggtacggacttaccgtttcgttacgggttaccgttacggttccggggacgggtaaacggg

SEQ ID NO: 67141 - DNA, 698 bp, Homo sapiens
  misc_feature: GYAE6OF02GY7CM.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgaccaaagacaatatgcttactggtaccagcagaagccgaggccacggcccctgtctgatctatttaataaagtactttagagacgggtcctacgaacgggacccctgacgcgtattctcgtacggtcctccgacgtcctcgacgaccgaacaacgtacgtaccgtaccgttacggaaccctagttaccgaacgggttacgggaccggttacccgggggaccgtaaacgggacggggaaccgggtacgggtaccggttaacgggtaacctttaaacggtttaccgttaacgggttaccgttaacggttactaaccgttaccggaaacggtaaccggtaaacgggtttaacgggtacgggttaccttaaccggtttccgtttaccgggtttaccggttacggttttaccccgggggacgggggtaaaccccgggg

SEQ ID NO: 67142 - DNA, 722 bp, Homo sapiens
  misc_feature: GYAE6OF02HCV9H.49.73.G07.1.454.CMB.1.raw
  modified_base (285)..(285): a, c, t, g, unknown or other
  misc_feature (285)..(285): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctggtgtctgtcgtcctgaggacaggaccggccagtatcacctgctacgtggggaatgcgattacgtccgaaaacgaanaactaatcgtacttaaccgtttacggtaaccgacgacgaacggaaacgaccgacggaccgaccggtaccccgtccttgttcgtatactaactttaagttaaaagtaacgtttgtaggacggtaccgtccgtacggacccgtcgagacgtacgttacctcgtcggtccgtaccgtacgtacgtaccacggtaccgaaaccgtaaacaaccggttacgtaaccgttcggaaccaacgttcgtaacgggtggtacgggtacccggcggaacggaagggaccgagggacgttccgtaacgttaacttttacggtacgtacgttacgtacgtacgttactaacggaaacggttacgttaaggggttaccgtaccggtaaccttttccggtttcggttaccggttaaccggtttaccgggacggggtaaccgggtaaacccgg

SEQ ID NO: 67143 - DNA, 768 bp, Homo sapiens
  misc_feature: GYAE6OF02H9OE5.49.73.G07.1.454.CMB.1.raw
  modified_base (128)..(128): a, c, t, g, unknown or other
  misc_feature (128)..(128): n is a, c, g, or t
  modified_base (160)..(160): a, c, t, g, unknown or other
  misc_feature (160)..(160): n is a, c, g, or t
tcagagtcgagagacacgaccggtgctcgatttagctctacgctctagggtcgacgaccggtgctcgtttagaggacgagtgtggttcgggtttgggggtggggtccaggaggcagaactctggggtntcctcgaccatggcctggatccctctacttcncccctctcactctctcgcacagactctgagcctctatgagctgacacagccgacccgtcggtgtctggtcgtcctcaggacagtaccgtccagttatccacctggcctacgtacgggaggtacgtcggccctaagttcggaacctaaaggtctaaacttagttacggtacttaccgtaggttaaccccaaggtacgaacggaacggaccggtacggggacccctaccgggtacccccgtggtttccgttaggtacgtcttaaagttttaacgaaacgttacgttttacgggaacggtacgggtacccgttacgtaaccggggtaccccttagacgtacggttacttccgttcgtacggcctccgtaggtcctacgaccggtacgaaactaaccgtacgtaccgtaacgtttaccgtaacctagtaccgtaaggttcggtaacggtacccgggaacgtaccgggaacgggtaccgtaacggggtccgtacgggtaaaccgttaacgtacggttacgttaccgtacgtaccgtacgttacgacggtactaggtacggtacgaccgtttcgttccgtaccggttacggtacgttcccgggacgtaaccggg

SEQ ID NO: 67144 - DNA, 636 bp, Homo sapiens
  misc_feature: GYAE6OF02IDWPU.49.73.G07.1.454.CMB.1.raw
  modified_base (243)..(243): a, c, t, g, unknown or other
  misc_feature (243)..(243): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtacncacctgctctggagatgcattgaccaaagcaatatgtcttactggtaccagcaagaacgccacggccacggccctgtctgatctatttaataaagtactttagagacggcctcgacgggacccctagacgcgtacttcgtacgtcggtctccgacgtctcgacggccgaaacaaacgacggttacctaacggtttacggaaccctaacgttaccggagggttacgggacgggttacccggggacgaacgggtacgggacggaagggtcgttaacgacgtttaaacgttacgttagtaccgtagtactaacgttacgaacgtacgtacggtaacggtcgtaccttacgtttacgttcggttaccgtttacggttaccggggacgggtaaccggg

SEQ ID NO: 67145 - DNA, 189 bp, Homo sapiens
  misc_feature: GYAE6OF02I1TRC.49.73.G07.1.454.CMB.1.raw
  modified_base (178)..(189): a, c, t, g, unknown or other
  misc_feature (178)..(189): n is a, c, g, or t
tcagagtcgagagacacgaccggtgctcgatttagctctacgctcagggtagctctacgctcagggcacgaccggtgctcgatttagtcacgcgagaaagggaaggggctggccctgacgtgtttctgttcccaccctctctctctcgactctgagcgggctggcaaggcgcagtagnnnnnnnnnnnn

SEQ ID NO: 67146 - DNA, 647 bp, Homo sapiens
  misc_feature: GYAE6OF02JDH6W.49.73.G07.1.454.CMB.1.raw
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (618)..(618): a, c, t, g, unknown or other
  misc_feature (618)..(618): n is a, c, g, or t
tcagagtcgagagacacgaccggtgctcgatttagctctacgctcgagggcacgaccggtgctcgtttagagagagtgtgttgggtttggggtgggtccaggaggcagaactctgggtgtctcaccatggcctggatcctctacttctcccctcgtcactctctgcacagactctcgacgcctctatcgagcctgacacacgccaccctcggtgtctgtcgtcctacgaggactacgacggccaggtactaccacctgtctctgganatgctattcgaccaaagcaaatntcgactttacgtcggtaccagactagaacgccaaggtccaacgggcccctagtccttagactctatttataaacgtctttggacgacgggtccttacgaacgggtacccttaggaacgtcgtaagtttccacgttcggacctaccgtaacgtccgttacgacgacggtaaccaacgtacgtaccgtacgtttacgacctaacgttcgaagttcggacgtccgggactaacgggtacggaacgacgggtctacggtacgttaagttaaccgtgtacccgtagtacgtaacttacggaacgtacggtaacgtaggtacgcgtacgtttcncggttctacggttccgggaccggtacggg

SEQ ID NO: 67147 - DNA, 523 bp, Homo sapiens
  misc_feature: GYAE6OF02FWWE7.49.73.G07.1.454.CMB.1.raw
  modified_base (428)..(428): a, c, t, g, unknown or other
  misc_feature (428)..(428): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacgccagtatcacctgctctggagatgcattgccaaagcaatatgcttacgtggtaccagcagaagccaggccaggccctgtcttgatctatttataaagtctttgagagggccctacgacgggacccctgacgcgattctctggctccagctcagcgacaacagtcacgttgaaccatcgagtgggacgtccgggnaggaggacgaggctagactagttacgtgtcagttcatacgagaccgtagtagtgtactacttcgtcgtcggttacgttccgggagggtaaccggg

SEQ ID NO: 67148 - DNA, 536 bp, Homo sapiens
  misc_feature: GYAE6OF02G6TWK.49.73.G07.1.454.CMB.1.raw
  modified_base (401)..(401): a, c, t, g, unknown or other
  misc_feature (401)..(401): n is a, c, g, or t
tcagagtcgagagacacgaccggtgctcgatttagctctacgctcaggcacgaccggtgctcgtttagagagagtgtgttgggtttgggggtgggtccgaggaggcgagaactctgggtgtctcaccatggcctggatcctctacttctcccctcctcactctctgcacagactctgagggcctcctatgagctgacacagccaccctcggtgtctgtgtcctcaggacagacgccagtatcactgctctggagatgcattgcaaagcaatatgcttactgtaccagcagaagccaggtcacgccctgtctgatctagtttaataaagtctttagagagggcctcgaacgggacccctgaagcggatttcgtcgtgctcagtctacgagtacgactaaacngttacacgttacgaacctatcgaaggtggaacggtccgggctaaagggacggacggagcgtacgacttaacgtctacgtcagtcatacgaagtactaggtagtgctagttcgtgtaggtcgttcgagggtaacgg

SEQ ID NO: 67149 - DNA, 670 bp, Homo sapiens
  misc_feature: GYAE6OF02H3JSX.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgacggcctcctatgagctgacacagccaccctggtgtctgtcgtcctcgaggacagaccggccagtatcacctgctctggagatgctatgaccaaagcaatatgtactacgtcgtacagcagacgcacggccacggccctgtcttgatcatttataaacgtacttttgaggtagggtcctacgtaccgggaccctggacgtcgtaagttccgtaccgttgggtcctcccgtacgtacccgtcgtaacggtccgaaaacgtaaccgtacggtacccgtaaccggttttcgaacccgtaacgttaccgtaacggttacgggaacgggttacccgggggacgaaacggggtaacgggaaccgggaagggttaccgtacggtaacccgtttaagtttaaccgttacgttacgtaacgttacgacgttaacgagtaaccgtaggttaacgtcggtacttacgttcgtcgtttacggttacgttcgggacggtaaccggg

SEQ ID NO: 67150 - DNA, 657 bp, Homo sapiens
  misc_feature: GYAE6OF02GYK2P.49.73.G07.1.454.CMB.1.raw
  modified_base (211)..(211): a, c, t, g, unknown or other
  misc_feature (211)..(211): n is a, c, g, or t
  modified_base (254)..(254): a, c, t, g, unknown or other
  misc_feature (254)..(254): n is a, c, g, or t
  modified_base (329)..(329): a, c, t, g, unknown or other
  misc_feature (329)..(329): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctggtntctgtgtcctcaggacagacggccagtatcacctgctctgganatgcattgccaaagcaatatgcttactggtaccagcagaacgccaggccacggcccctgtcttgatctaatttanaaagtactttagagacggtcctcgacgggaccctggacgcgtattccgtacgttcggccttaccgacgtcctacgacggtacgaacaaacgtacgtaccgaacgtttacggaaccctaagttccgagggttacgggacggttacccggggacgaacgggacgggtaaccgggacgggtaccgttaacggtaacctttaacgtttaacgttacggttacgtaacggttactaacgttacggaacggtaaccgtaagggttacggttacggtaccgttacctttacggttaccggttccggtttaagtttccggggaccggtaaccgggg

SEQ ID NO: 67151 - DNA, 588 bp, Homo sapiens
  misc_feature: GYAE6OF02IVDUB.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgacggcctcctatgagctgacacagcccaccctcggtgtctgtgtcctcaggacagacggccagtatcacctgctctggagatgcattgaccaaagcaatatgcttactggtaccagcagaagccagcacgccctgtctgatcatttaataaagacttgacgagggcctcgacgggtacccctgagccgtattcctcgtacggtcctcccgaagcctcgacgaccgtacaaacaggtacctacggtttacgacctagtcgaagtgggaccggtaccgggacgaggtaacgggacgaagggtcctgaacctttaagttacgtaggttactagtacacgtcaaggtaacgtaggttaacggcggtactaccgttacgttcggttacgttacggttccgggccgggtaacggg

SEQ ID NO: 67152 - DNA, 686 bp, Homo sapiens
  misc_feature: GYAE6OF02JJH6E.49.73.G07.1.454.CMB.1.raw
  modified_base (225)..(225): a, c, t, g, unknown or other
  misc_feature (225)..(225): n is a, c, g, or t
  modified_base (328)..(328): a, c, t, g, unknown or other
  misc_feature (328)..(328): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtcgtcctnaggacaggcgccagtatcacctgctctggagatgcattcgaccaaagcaatatgcttaactggtaccagcagaagccaggccaggccctgtctgatcatttanaaagctttagagcgggcctcgacgggacccctgagtcgatttccgtcgtgggtcctcccgacgtctccgacggccgaaacaacgacgttaccgacggtttacgaaccgtacgtaccaacgggttcgggaacggtaccccggggtacgaagggaaccggggtaaccggtacgggtaccgttacgggaaaccttttaacggttaacgttacggtaccgttaacggttactaaccgttacggtaaacggtaacccggtaagggtttaaccggttcgggtaccccgtttaaaccggttttcccggttacggtttaccgggtttaaccgggttttaccccggggacgggggttaaaacccggg

SEQ ID NO: 67153 - DNA, 525 bp, Homo sapiens
  misc_feature: GYAE6OF02HHCR8.49.73.G07.1.454.CMB.1.raw
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
  modified_base (475)..(475): a, c, t, g, unknown or other
  misc_feature (475)..(475): n is a, c, g, or t
  modified_base (518)..(518): a, c, t, g, unknown or other
  misc_feature (518)..(518): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttctccccctcctcactctctgcacagactctgaggcctcctatgagctgacacagccaccctcggtgtctgtgtcctcaggcagacgccagtatcacctgctctggagatgcattgccaaagcaatatgtcttacgtggtaccagcagaagccgaggccgacggcccctgtcttgatactatttaataaagtactttggaggacgggcctcgacgggacccctgacgcgacttctctcggcctccgagtctcacgcgaacaacgacgtcacgttcgaccatcaggtaggnggtccgggnaggaggacgngctagtactattcgtgtcngtcatcaagctagtagtcgactacgttcgtgtcgtaggtcggnggaacgg

SEQ ID NO: 67154 - DNA, 776 bp, Homo sapiens
  misc_feature: GYAE6OF02FJ8SM.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagccacccgtggtgtctgtcgtcctcgacggacgacggccggccaagtactccaccgtcgcctcgtggaagagtcgctactttcggaaccaaacgactaaattacgtcggtactttaacgtcggtaaccgaacgacgaaggacggaccgacggaccgaccggtcccctgttcgtttcgggattaagttttaaagaaacgttacgttttaggaacgggtaccggtccccgtacggaccgggtacccctaggaacgacgtttacttcgtcgttcggtcccttccggaacgtccgttaccggaacgggtaaaccaaccggtagtttaccctaaccggtttaccgaacccgttaagtccgtaagggttccgggtaaacgggttccccgggaccgtaaacggggaacgggtaaccggtacgggttccgtaacggttaaacctttaccgttttaacgtaccgtacgttaccgtacccgacgacggaaccgtaccggtacgacgggttacggaccgttaaggtttacgttaccggttacggttacggttaccgggggtaccgggtaacgggttacccgtaccggg

SEQ ID NO: 67155 - DNA, 675 bp, Homo sapiens
  misc_feature: GYAE6OF02FJ4CA.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaaccagcagaagccaggccacggcccctgtccttgatctatttaataaagtactttagacgagggcctcgaacgggtacccctaggacgtcggtatttcctacgttcgggtccttaccgacggtcctaccgtaacggccggaaccaaaccgacggttaccgaaccggtttaggaaacccctaagttaccgaaggttacgggaccgggttacccgggggaccgaagggtaaccgggaaccgggtaacgggtacgttacggtaaaccttacgtttaaaccgttcggtaccgtaaggtcctaagtacgaacggtaaccgtaggttaacggtcggtaccgtacgtttccgttcggttaccggtttacgttaccgggtaccgggtaaccgggg

SEQ ID NO: 67156 - DNA, 166 bp, Homo sapiens; identical to SEQ ID NO: 66858
  misc_feature: GYAE6OF02G96E7.49.73.G07.1.454.CMB.1.raw
  modified_base (164)..(166): a, c, t, g, unknown or other
  misc_feature (164)..(166): n is a, c, g, or t

SEQ ID NO: 67157 - DNA, 759 bp, Homo sapiens
  misc_feature: GYAE6OF02JVL4A.49.73.G07.1.454.CMB.1.raw
  modified_base (143)..(143): a, c, t, g, unknown or other
  misc_feature (143)..(143): n is a, c, g, or t
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
tcagagtcgagagacacgaccggtgctcgatttagctctacgctcagggcacgaccggtgctcgtttagagagagtgtgttgggtttgggggtgggtccgaggaggcagaactctgggtgtctcaccatggcctggatccctntacttctccccctctcactctctgcacagactctgacggtcctcctatgagctgacaccngcccacccgtcggtgtcctgtcgtcctacgagacagaccgggccagttacncacctgctcgtggagntgctattcgacctaaagcaatactgtcttaacgtcggtaaccagacgaaggaaccaccgacggacccgaacgggtccccctagtttcctacggtacttacttaaatttaaacgtaaagtacttttcggaaaggtcggggtaccctaggaacccggggtcccctagtacgtccggtaattccgtccggttacggtccgtacccgtacgtacgtccgtaacggaccgaaaccgtaaaccgtaccgttaccgtaacgttacccgggtacctaaacgttccggaaggttacccgggaacgggtaccgggaaccgaacgggtaccgggaacggtacgggtacgttacgtaacgtttaaccttaacgtttacggtaccgttaggtaccgtaacgtacggtacggtaaaccgttaacgggttaagggtcccgtaacgtttcccgttaggttaaccggttttacggtaccgggtttaccggggacgggtaaaccggg

SEQ ID NO: 67158 - DNA, 759 bp, Homo sapiens
  misc_feature: GYAE6OF02IC8TU.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgagcctcctatgagctgacacacgccaccctggtgtcctgtcgtcctacgaggacaggaccggcctagtactcacctgctcgtaggactatcgctattccgaccgaaagcctaaatcgtcgtacttaccgtacgggtaaccaggacgaacgacgaccgacggacccgtacggaccccttggtaccttagtactaccttaatttaaacggtaagttaccgtttacggaagggtaccggtacccgtacggaccgggtacccctagacggtaccgttacgttaccgtttccggaccggttctacccgtacggtccgtacgaaccgtacggtaaaccaaaccggttaccgtaccgttaacggttaccggaaaccgttacgtcgtaacgggtacgggtaccgggaccggggtacgaaccggggaacgggtaccgggtacgggccgttaacgtaaccgttacgtttaccgtagttaccgaacggttactacggtaccggaacttacggtaacgggttcggtacgtaccgttaacccgtttggttccggttaaccgggttacggtttacccgggggaaggttaacccggg

SEQ ID NO: 67159 - DNA, 709 bp, Homo sapiens
  misc_feature: GYAE6OF02J0EN3.49.73.G07.1.454.CMB.1.raw
  modified_base (142)..(142): a, c, t, g, unknown or other
  misc_feature (142)..(142): n is a, c, g, or t
  modified_base (411)..(411): a, c, t, g, unknown or other
  misc_feature (411)..(411): n is a, c, g, or t
  modified_base (425)..(425): a, c, t, g, unknown or other
  misc_feature (425)..(425): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctcccctctcactctctgcacagactctgacggcctctatgagctgacacagccaccgtcggtgtctgtcgtcctacgaggacacggaccggccagttactccaccgtgccgtcgtaggacgtagtcgactagttcgaaccaaaagctaaatgtcgtacttaacgtcggtaaccagtcaaggaacgccgacggccacgggtcccctgtactcgatactaagtttaacaagtcgtttaggaggacggtcctacggaccggtaccnggactcgtacttcncgtcgtcaccgagtctacgacgaccgtaaacacgtaacgtccgtaacggttcgaaccgtacgtacgtacgggacgggtaccggtaccgggcgtaaacggtacggggtacggaccgggtccgttaacgttaacgttaacggtttaccgtacggtttacgaacgttacgacgtttaacgaacgggtaacgttaacgggttaacgggttccggtaaaccctttaccgttttacggaccgggttttaaccggtttacggggtacccggggtaccgggttaaaccgggg

SEQ ID NO: 67160 - DNA, 729 bp, Homo sapiens
  misc_feature: GYAE6OF02F2FY3.49.73.G07.1.454.CMB.1.raw
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctctacttctccccctctcactctctgcacagactctgacgcctctatgagctgacacagccacccgtggtgtctggtcgtcctgacggacacgacggcagtactccacctgctcgtggagatgactattcgaaccaaagtcaaatactggtacttaacgtcggtaaccgagacgaagaacggcccgaacgggacccaacgggtccccccgttggttaccgttacggaacttaccgtaaagttttaaactaaaaggttacgttttaacggaagggtaaccggggtcccttaacgggaaccgggtaaccccgtgggacgtacggtaactttccgtcgtccggtacctaccgacggtacctaccggtaggtaccgtaaacgtaacgaacggttaccgtaacggttaacgaacgtaccgtacggtacggttagggaccggttaaccgggacgtaagggaaccggtacgggacggtacgttaacggtaaccgttacgtacgttagtacgttacgtacgaacgtacgtaagaacggtagtaacggtgtaccgttacgttccggttaggttccgtaggttaccgggacgggtaacgg

SEQ ID NO: 67161 - DNA, 226 bp, Homo sapiens
  misc_feature: GYAE6OF02JYBF1.49.73.G07.1.454.CMB.1.raw
  modified_base (210)..(226): a, c, t, g, unknown or other
  misc_feature (210)..(226): n is a, c, g, or t
tcagagtcgagagacacgaccggtgctcgatttagctctacgctcagggcacgaccggtgctcgatttagagagagtgtgttgggtttgggggaagaggaagactgacggtcccccaggagttcaggtgctgggcacagcggccctgggctgcctggtcaaaggctacgttcctctctcgactctgagcgggctggcaaggcgcatacgnnnnnnnnnnnnnnnnn

SEQ ID NO: 67162 - DNA, 668 bp, Homo sapiens
  misc_feature: GYAE6OF02IWH5A.49.73.G07.1.454.CMB.1.raw
  modified_base (141)..(141): a, c, t, g, unknown or other
  misc_feature (141)..(141): n is a, c, g, or t
tcagagtcgagagacacgaccggtgctcgatttagctctacgctcagggcacgaccgttgctcgtttagagagagtgtgttgggtttgggggtggtccaggaggcagaactctgggtgtctcaccatggcctggatccctntacttctcccctctcactctctgcacagactctgaggcctctatgagctgacacagcccacccgtcggtgtctgtcgtcctacgaggacaggaccggccaaggttactccaccgtgcctcgtggagatgcattgaccaaagcaatatcgtcttacgtcggtaccagcaagaacgccgacggccacggtcccctgtccgttgacttacctaatttaagtaaacgtactttaggaacggtacgggtaccctcggaaccgggtacccctaggacgtaccgtactttccttacgtcggtccctaccgtacgtacctcgacgtaccgaacgtaactacggtaccgtacggttacgaacctacgtacgtagggtacggtacggtaccgggacgaacgggacggaacggtacgggtacgtacgtaacctttagttacgttacgtcgtaacgtactacgtacgaaggtaacctaagggtacgtacggtaccttacgttcgttacgttacggtacggtttcgggacggtaaccggg

SEQ ID NO: 67163 - DNA, 512 bp, Homo sapiens
  misc_feature: GYAE6OF02FIJK4.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctggtgtctgtgtcctcaggacagacggccagtatcacctgctctggagatgcatttgccaaagcaatatgcttactggtaccagcagaggccaggccaggcccctgtcttggtgatttataaagtacttttgagaggccctcacgggacccctgagcgattctctggctccagctcgagggacaacagtcaccttgaccatcagtggacgtccggccaggagacgaggctgactattacgtgtcagtccgcagacagcagtacgactagttatcgtcgttagttcgggacggtagggactaccgg

SEQ ID NO: 67164 - DNA, 755 bp, Homo sapiens
  misc_feature: GYAE6OF02G7G8G.49.73.G07.1.454.CMB.1.raw
  modified_base (266)..(266): a, c, t, g, unknown or other
  misc_feature (266)..(266): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacggcctcctatgagctgacacacgcccacccgtcggtgtctgtcgtccctcgaggacaggaccggccagtactccacctgctctgganatgctattcgacctaaaagcaaatacgtcgtactttaacgtcggtaaccaggaccgaaggaacgcccgaacgggcccaaccgggtcccccttaggttcctttaggacttacctaaagttttaaactaaaacggttaccttttagggaaacgggtacggggtacccttacgggtaaacccggggtaccccctagggaaccggtaccgtaacgtttccgttacgtaccgggtccttacccgacgtccttaccgacggtaccgtaaaccaacgtaacgtacccgtaaccggttacgaaccctacgtaccgaagggtcgggtaacgggtcccgggacgaacgggtaacgggacggaacgggtcctaacggtaacctttaattaccgtacggtaccgtacgttactaacgtacgaacggtaacgtacgggttaacgtcggtaacctacggttttcgtcggttacggttacgggttacgggacgggtaacccggg

SEQ ID NO: 67165 - DNA, 518 bp, Homo sapiens
  misc_feature: GYAE6OF02GQXA8.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgcattgccaaagcaatatgcttactggtaccagcagaagccaggccacggcccctgtcttgatctattataaagtactttgagagggcctcgacggacccctgacgcgtattctcgtggctccagtctcgagcgacaacagtccacgttcgaccatcgagtggacgtccgggcaggaggacgaggctgacttattactgtcagtcatcgaagacaggtagtcggctacgttctcggttcgtacgttcgggcggaacggg

SEQ ID NO: 67166 - DNA, 683 bp, Homo sapiens
  misc_feature: GYAE6OF02GCCJ7.49.73.G07.1.454.CMB.1.raw
  modified_base (262)..(262): a, c, t, g, unknown or other
  misc_feature (262)..(262): n is a, c, g, or t
  modified_base (336)..(336): a, c, t, g, unknown or other
  misc_feature (336)..(336): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccgtcggtgtctgtgtcctgaggacaggaccggccagttatccacctgctcgtagganatgctattcgaccaaagtcaaatatcgtacttacgcggtaccagacagaacgccgaggccacgccctgtctagntactaatttaactaaagtctttaggaggtacggtcctacggaccggtaccctgacgtacgttattccgtacgtcggcctacgcggtcctacgaccgacgaaacctaaaccgtacggttacccgtaaccgttacgaaccctagtacggtaacggttacgggaccggtacccggggaacgtaacgggtaacggggaccgtagggtaccgtacgtaacgtttaactttaccgtaggttaccgacgttacctaacgtaccggtaaacgtacgttaacggtaggttaccgtacgtttaacgtttcggttacggttaccggtttacgggttaccggggaaccgggtaaccggg

SEQ ID NO: 67167 - DNA, 717 bp, Homo sapiens
  misc_feature: GYAE6OF02JYGCA.49.73.G07.1.454.CMB.1.raw
  modified_base (295)..(295): a, c, t, g, unknown or other
  misc_feature (295)..(295): n is a, c, g, or t
  modified_base (385)..(385): a, c, t, g, unknown or other
  misc_feature (385)..(385): n is a, c, g, or t
tcagagtcgagagacacgaccggtgctcgatttagctctacgctcagggcacgaccggtgctcgtttagagagagtgtgttgggtttgggggtgggtccagggaggcaggaactcgtgggtgtcgtcaccatggcctggatccctctacttctccccctcctcactctctgcctacagacgtcctggacggcctcctatcgtagctgacacagccctacctcggtgtcctgtacgtccctacaggacaggaccggtccaagttactccgaaccttggtactcgtgggaactgtanccgtaagttcggaaccaaaacggtctaaaagtactcgtaccttagtacggtaccaggcaagaccgccgagcccacggtccctgtccgtanacgtcttaacgtttaataaaccgttaagtttcgaacgggtaaccgggtcctaacggtaccggggtaacccttggaaccggtcgtaactttccgtcgtacgcctaacgtcgacctacggacgtacaacacgacgtacgtacgtccgtaactagtccgtaaaggtcggtacggtacccggagagacggacgcgtaacgtcgtacgtttaacctacgttcgaccgttaacgtccgttaacacggtaaccgacggttaacgttaacggggtacttaaccggtcttttacgggtaacccggttgtttaaaccggttccgggggacggtaaacccggg

SEQ ID NO: 67168 - DNA, 654 bp, Homo sapiens
  misc_feature: GYAE6OF02IOXU8.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttctccccctctcactctctgcacagactctgaggcctcctatgagctgacacagcccacccgtcggtgtctgtgtcctcgaggacaggaccggcctaaggtactcaccgtgctcgtggagatgctattcgaccaaagcaaattatgtacttacgtggtaccagacaagaacgccacggaccacggtccctgtctgactactatttaataaagtactttagacggtacgggtcctacgaaccgggaccctaggacgtcgtactttacgtcgtcggtcctaccgacgtcgtacgacgtacgaacctaaacgtacgttacgtaacggtttacgaaacctacgtacgtaagggttcgggacgggtccgggacggaaacggacgggtaacggacgggtctaaggtaaccttacgttacgtacgtacgacgtacacgtacgaacgtaacgtaggttacggtacgtacttccgttacggtcggttacggttacggttccgggacggtaaccggg

SEQ ID NO: 67169 - DNA, 597 bp, Homo sapiens
  misc_feature: GYAE6OF02IMOLX.49.73.G07.1.454.CMB.1.raw
  modified_base (171)..(171): a, c, t, g, unknown or other
  misc_feature (171)..(171): n is a, c, g, or t
  modified_base (215)..(215): a, c, t, g, unknown or other
  misc_feature (215)..(215): n is a, c, g, or t
  modified_base (439)..(439): a, c, t, g, unknown or other
  misc_feature (439)..(439): n is a, c, g, or t
tcagagtcgagagacacgaccggtgctcgatttagctctacgctcagggcacgaccggtgctcgtttagagagagtgtgttggggtttgggggtgggtccaggaggcagaactctgggtgtctcaccatggcctggatccctctacttctcccccctctcactctctgcanagactctgaggcctcctatgagctgacacacgccaccctcggtntctgtcgtcctcaggacagcggccagtactcacctgctctggagatgcattgaccaaagcaatatcgtcttacgtggtaaccagacagaacgccaggccacggccctgtcttgactctaatttaataaagtactttgaaggtacggtacctacgacgggacccctggaccgtcggtaatttccgtcgtacgggtctccgtacggctacacgtacaacctaacgngtaccgtacgttcgaacctaagtcaaggtacggcggtaccgggacgtaaggaacggacggagtacgtagtacttaagttacttgtactagtcaatcgaacgacgtagttagtcggacttacgttcgtggttaccgttcggttccgggacgggtacggg

SEQ ID NO: 67170 - DNA, 512 bp, Homo sapiens
  misc_feature: GYAE6OF02FNBW5.49.73.G07.1.454.CMB.1.raw
  modified_base (397)..(397): a, c, t, g, unknown or other
  misc_feature (397)..(397): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggcccctgtcttgatcatttataaagtactttgagagggccctcacgggacccctgacgcgattctcgtggctccagctcacgcgacaacngtcacgttgaccatcagtgacgtccgggcaggaggacgaggtctagacttaagttactgtcagtcatcgaagacagtagtggtctacttcgtgttcgtagttcggaggtaacggg

SEQ ID NO: 67171 - DNA, 591 bp, Homo sapiens
  misc_feature: GYAE6OF02H612U.49.73.G07.1.454.CMB.1.raw
  modified_base (236)..(236): a, c, t, g, unknown or other
  misc_feature (236)..(236): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctcctcactctctgcacagactctgagcctcctatgagctgacacagccaccctcggtgtctgtgtcctcaggacagacggtnagtatcactgctctggagatgctattgaccaaagcaatatgtacttacgtacggtaccagacaggaacggccgacggcccgacggtccccgtgttcttgattactaatttaataaagtacttttaggaggacgggtccctcggaacgggacccctagacggtcgtacgttactcgtcggcctccgagtcctcgacgacgaaccaacacgtctacgttacgaacctatcgtagtgggacggtccggagaggacggacggagtcgtacgtacgttagttactcgtacacgtcatacgaaggaccgtaggtacgtgtaccttacttcgtaggttcgtacggttcgggacggtaacggg

SEQ ID NO: 67172 - DNA, 530 bp, Homo sapiens
  misc_feature: GYAE6OF02HHUUQ.49.73.G07.1.454.CMB.1.raw
  modified_base (408)..(408): a, c, t, g, unknown or other
  misc_feature (408)..(408): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacggccagtatcacctgctctggagatgcattgaccaaagcaatatgtcttacgtggtaccagcagaagccaggccacggcccctgtcttgatcatttaataaagtactttgagacggcctacgacgggtacccctgacgcgtattctcgtcggcctccagcctcgacgcgaacaacngtacacgttgaccatcgagtcggacgtccgggcaggacggacggaggctagacttattactgtcagtcatcgaagtacaggtgtcggactacgttctggttacgtagttcgggcggtaacgg

SEQ ID NO: 67173 - DNA, 726 bp, Homo sapiens
  misc_feature: GYAE6OF02GF7C8.49.73.G07.1.454.CMB.1.raw
  modified_base (248)..(248): a, c, t, g, unknown or other
  misc_feature (248)..(248): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgacggcctcctatgagctgacacacgcctacccgtcggtgtctgtcgtcctcgaggacaggacggcctagtcncacctgctcgtggagatcgactagttcgaccaaagactaatatgtacttacgtacggtaccacgacgacggaacgaccgacggccgaccgggtccccttaggttcttagactcttaatttaagtaaaagttactttggaaggtacgggtaccctacggaccgggtaccccgtgacggtccgtacttccgtcgtacggcctaccgtacgtccgtcgtaacggccgtaaactaacgtacgttaccgtacggttaccggaacctaacgttcgtagggtacgggtaccggtcccggggacgtaagggaccgggaacggtacgggtaccgttacggtaaccgtttaacgtttacggtacgttacgtacgtacgtaacgtaccgaaacggttacggtaacggttaacggtaccggttacccttacgtttacggttacggtttaccgggttaaccggtttccgggggacgggttaaacccggggg

SEQ ID NO: 67174 - DNA, 655 bp, Homo sapiens
  misc_feature: GYAE6OF02I2Y9F.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtcgtcctcaggacaggaccggccagtatcacctgctcgtggagatgcattcgaccaaagcaatatgtacttactcggtaccaggacagacgccgaggccgacggcccctgtccttgatctattaataaagtactttggacgacgggccctacgaccgggtaccctggacgtcgtattccgtcgtcggcctaccgacgtcctacgacgacgaaccaacgtacgttcctacggttacgaacctagtacgtagggttacgggacgggtcccggggacgagggtaaccgggaccggtaacgggccgtaggtacctttaagttacgtacggtacgtacgtcctaagtaccgtaacggcgtaaacggtcggttaccggtaccgttaaccgtttcggttacggttaccggtttaacggttacccggggaccgggtaaaccgggg

SEQ ID NO: 67175 - DNA, 635 bp, Homo sapiens
  misc_feature: GYAE6OF02FLO6H.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctctatgagctgacacagcccacctcggtgtctgtcgtcctcgaggacagacggccagttactccacctgctcgtggagatgctattgaccaaagcaaatatgtacttacgtggtaaccagacagaacgccgaggcccgacggtaccccttgtcttagataccgtaatttaagtaaagttacgtttaggaggtacgggtccctacggaccgggtacccctaggacgtcgtactttccgtcgtcgggcctaccgagtccgtacgacgaccgaacgaacgtacgtaccgtacgtttcgaacctacgtacgtacggtcgggacggtcccggggacgaacgggtaacgggacggaacggtcgtaacgtaacgttacgttacgttgtacctagtcgtatacgtaacacgtagtagtcggtactacgttcgtaggtcgtacggttcggacggtaaccggg

SEQ ID NO: 67176 - DNA, 686 bp, Homo sapiens
  misc_feature: GYAE6OF02HFH2P.49.73.G07.1.454.CMB.1.raw
  modified_base (288)..(288): a, c, t, g, unknown or other
  misc_feature (288)..(288): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttccctccccctctcactctctgcacagactctggacggtccttacctatggacgtcgtagaaccacacgcccctacccgttcggtctcgtgtcgtcctgaggacacggaccggcagtactccaccgtgctacgtaggagtancgactattcgaccaaagactaatagtcgtactttacgtcggtaaccagacgaacggaacgaccgacggcccgaccggtccccgttgtcttacgacttacttaagtttaaagtaaagttcgtttaggagggtacggtcctacggaccgggtaccctaggaacggtcgtacttccgtcgtacggtccctccacggtctaccggaagccgtaaacaacgttacgtactacggttaccactagtacgaggtcgggtacgggccggcgaagggaaccggacgggacgtacgtacggtaactttacgttaactcggtaactaccgtatacggtacaaggtacgtaaggttacggcgtaccttcgtttcgtacggttcgttaccgggtcggggacggtaaccggg

SEQ ID NO: 67177 - DNA, 625 bp, Homo sapiens
  misc_feature: GYAE6OF02GERWC.49.73.G07.1.454.CMB.1.raw
  modified_base (428)..(428): a, c, t, g, unknown or other
  misc_feature (428)..(428): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattcgaccaaagcaaatatgtaccttaccgtcggtaccacgacgagaacgccgacggccgacggtcccctgttctgatacgtaatttaataaagtactttagaggacgggtccctacgaccgggtaccccgtggacgtccgtactttccgtcgtacggtcccgtaccncggtacctccgacggtacccgaaccaaacgtacgtacccgtacggttacgacctagtacaggtcggacggtccggacgaggacgggacgacggtccgtagaaccgttattaacgtcgtacgtagtcaacgtcgaaggtacgagtacggttcggtacctcgtttcgtcggttacgtacggttacgggcggtaaccggg

SEQ ID NO: 67178 - DNA, 616 bp, Homo sapiens
  misc_feature: GYAE6OF02IQ1JJ.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacggccagtatcacctgctctggagatgcattgaccaaagcaatatgtcttacgtggtaccagcagaacgccgaggccacggcccctgtccttgatctaatttataaagtactttaggagacgggtcctacgacgggtacccctgacgcgtactttcgtacgtcggcctccagcctacaggccgaacaacgacgtactaacgttgaacctaacttcgaaggttcgggacggtcccgggacgtaaagggaacgggaaccggagggcgtacggtaacctttaacgttacgtagtaccgtacgtacgtaacttaccgaagaaccgttaaggtacggtacggtacttaccgttcgttacgttacggttacgttccggggcggtaaccggg

SEQ ID NO: 67179 - DNA, 647 bp, Homo sapiens
  misc_feature: GYAE6OF02H8GT9.49.73.G07.1.454.CMB.1.raw
  modified_base (213)..(213): a, c, t, g, unknown or other
  misc_feature (213)..(213): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggcctcctatgagctgacacagccaccctggtntctgtgtcctgaggacagacggccagtactcacctgctctggagatgctattcgaccgaaaagacaatatcgtacttacgtacggtaccaagacaaggaaacgccgacggcccgacggcccctgttcttagatacgtaatttaataaacgtacgtttagaggacgggtacctacggacgggtacccctagacgtccgtaacttccgtcgttacgtcgtacctacgccgttacgacggtaccgaacaacgacgttactacggtttaccgaacctactacggtagtacgggtacggtccgggacgaggaacgggacgacgggtacacggtaacttacgtaccgtagtcgtaagtacacgttaccgagtaacgtaaggtacgtacgaccttacgtttacgtcggttacggttacgttaccggggacggtaaccgggg

SEQ ID NO: 67180 - DNA, 593 bp, Homo sapiens
  misc_feature: GYAE6OF02I6T02.49.73.G07.1.454.CMB.1.raw
  modified_base (142)..(142): a, c, t, g, unknown or other
  misc_feature (142)..(142): n is a, c, g, or t
  modified_base (263)..(263): a, c, t, g, unknown or other
  misc_feature (263)..(263): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctcctcactctctgcacagactctgacggcctcctatgagctgacacagccaccctggtgtctgtcgtcctcgaggacaggacggccaagtatccgacctgctcgtgganatacattgaccaaagcaatatgactttactcggtaccagacgaagacgccgaaggccacggcccctgtcttgatctattaataagtcttagagcggtcctagacggaccctgacgcgtacttctcgtggcctccgacgtctcgacgtcgaacaacacgtacacgttacacctactacgtaggtacggacgtcccgggagaagggacggacgacggcttacggactttaagttaccgtgtaccgagttactagtacaggtaacgtaggttaacggtcggacttaccgtttctacgggttcgttacggtaccgggtacgggacggtaaccgg

SEQ ID NO: 67181 - DNA, 752 bp, Homo sapiens
  misc_feature: GYAE6OF02JWOS9.49.73.G07.1.454.CMB.1.raw
tcagagtcgagagacacgaccggtgctcgatttagctctacgctcagggcacgaccggtgctcgtttagagagagtgtgttgggtttgggggtgggtccgaggaggcaggaactcgtgggtgtctcaccatggcctggatccctctacttcctcccctctcactcctctgcacagactctgacggcctcctatgagctgacacacgccaccctcgggtgttctgtacgttccctcgaggacaggaccggccaaggttactccgaccgttgcctcgtagggacgtagtcgtctagtttaccggaccaaagtacctaaatacgtggtaccttacgttacgggaaccctagacctaaggaaccgccgaccggtaccgaccgggtcccccttggttaccttaggtaaccttccttaaagttttaaaccgaaaacggttacgttttacggaacgggtacgggtcccttaaccggtaacgggtaccccgttaggacgtaccggttacttaccggttccgtacgggtaccgtacccgtaacgtccgtaacgacgtaccgaaaccaacgtacgtacctaccggttacgaaccctagtacgtaacggttcggaccgggttaccgggagtaacggacggaggacgggtcgtaacgtacgttaattacggatacgttacgtcagtacgaacggtaacgtaggtacggtacgtacgttaccttacggttaccgtacggtttacggttcgggaaccggtaacggg

SEQ ID NO: 67182 - DNA, 708 bp, Homo sapiens
  misc_feature: GYAE6OF02IAHQ5.49.73.G07.1.454.CMB.1.raw
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttcctccccctctcactctctgcacagactctgacggcctctatgagctgacacacgcccacccgtcggtgtctgtcgtcctcaggacagccggccagtactccacctgctctgganatgcattcgaccaaagctaatactgtacttacgttntaccgagtacaaggtaacgaccgacggccacggccccgttgttccttaggacttaccttaattttaaacgtaaacgtacgttttaggaacggtacggtcccgttacggaaccggggttacccctaggacgtcgtactttaccgtacgtcggtcctaccgtacgacctacgaacgacccgaaacgtaaaccgtacggtacccgtaacgtttaccgaaccctaagtaccgtacgggtagggtacgggtacccgggtagaacgggaacgggacggacggtaccggttacgtaaccgttaactttacgtacgtacgtacggtacaccgttacgaggtaaccgtagtaacggttacggtcgttaccggtttcgttaccggtttacggtacggtttccgggacgggttaaccggg

SEQ ID NO: 67183 - DNA, 818 bp, Homo sapiens
  misc_feature: GYAE6OF02JVDQE.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgttagagagagtgtgttgggtttgggggtgggtccaggaggcagaactctggggtgtctcaccatggcctggatccctntacttcctcccctctcactctctgcacagactctgaggccctcctatgagctcgacacagcccaccctcggtagtcctggtcgtcctacgaggacacggtaccgggcctaggttaactccaacccgtttgccgttcgtaggagtacgtcggcctagtttcggacccaaaaaggcctaaaagttacttcgtaccgtttacggttacggttaacccgacgtaccgaacggaaacggtcccgaacgggtcccgtaacgggtccccgttaggttccgtttagaaccgttacttaaacgttttaataaaacggttaacgttttagggaacggtacggggtacccctacggtaaccggggtacccccttaagggacggtaccgtacggtttccgtttacccgtgggtcccttaccgtcggtaccgttccgaaccggtaccgaaaccgtaacgtacggtacctaacggttacggtaacctaccgtgtaaaccggtcgggtacggtaccggggacgaacggtacgggtaacggaacgggtcgttaacggtacttaaacggtttacttacgttacgtaccggttacgtagtaccggaacgtaaccgtagggttaacgggtacggttaccgtaacctttcgttaacggttacggttaccggtttacggggtaccgggtaaccgggg

SEQ ID NO: 67184 - DNA, 794 bp, Homo sapiens
  misc_feature: GYAE6OF02HXLQ3.49.73.G07.1.454.CMB.1.raw
  modified_base (267)..(267): a, c, t, g, unknown or other
  misc_feature (267)..(267): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgacggcctcctatgagctgaccacacgccacccgtcggtgtctgtgtacctcgaggacaaggaccggccagtactcacctgcctgtgganatgcattcggacaaagactaatagtcgtacttacgtcggtaaccagaccaaggaacgaccgacggcccgaacggtcccccgtgttaccgttgaactccttaaattttaaacggtaaattacgtttaggaacggtacggggtccccttaacgggaaccgggtacccccgttaaggacggtaccggtttaacctttctaccgggtttcggtacccgttacccgtaccgttaccgtaaccgtaaccggaccgttaaaccgaaaaccgtaacgggttacccttaaaccgggtttaaccggaaaccctaaccgttacgtaaacggggttacgggtaaccgggttcccggggaacggaaaccggggttaaaacggggcgggtaaaccggtcgtaacggttaactttaacgtaacgttaccgttacggtacttaccgaacgttcggaacgttaaacgtacggttagggtaccgtacgttaccggtttccgttagggttaccgttacgggttaccgggtaaccggggtaaccggg

SEQ ID NO: 67185 - DNA, 649 bp, Homo sapiens
  misc_feature: GYAE6OF02F5W2L.49.73.G07.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (256)..(256): a, c, t, g, unknown or other
  misc_feature (256)..(256): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgacggcctcctatgagctgacacagcccaccctggtntctgtcgtcctnaggacagacggccagtactcacctgctcgnggatatgctattcgaccaaagctaatatgtacttacgtcggtaaccagacaaggaacgccgacggacccaccggtccccttgttccttagtcttactaagtttaaactaaaggttcgtttaggaaccggtacgggtcccgtacggaacccggggtaccctagggtaacgtccggtaatttccctcgtcggtcctaccctagtcctacgacggaccgaactaacgtcgtaccgtacgttacgaccagtccggaggtcggacgggtccgacgacggaggtaccggagggtctacgtactttaagtacgtgtcacgtacacgtacgaaacgagtaacggtaggttcgacttaccggttcgttcggttacggtacggttacggggacggtaaccggg

SEQ ID NO: 67186 - DNA, 642 bp, Homo sapiens
  misc_feature: GYAE6OF02HDND7.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccacccgtcggtgtctgtgtcctcaggacagaccggccagtatcacctgctctggagatgcattgaccaaagcaatatgtcttacgtggtaccagcagaacgccaggccacgcccctgtcttgatctatttaagtaaagtactttggaagacgggtacctacgacgggtacccctgacgacgtacgttcctcgtcgggacctccgagtcctacgacggacgaaccaaacgtacttcgaaccgttcgaaccgtatccgagggtacggacgggtcccgggagtaacgggaacgggaccggtacgggtacgttacgaaccgtttaagttaaaccgttggtaccgttaacgtactaacgttacgaaacggtacctaaggttacggtacggacttaccgtttcgttacggttaccggttacggtttaccgggcgggtaacccggg

SEQ ID NO: 67187 - DNA, 753 bp, Homo sapiens
  misc_feature: GYAE6OF02H7MSR.49.73.G07.1.454.CMB.1.raw
  modified_base (264)..(264): a, c, t, g, unknown or other
  misc_feature (264)..(264): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctctatgagctgacacacgccacccctgggtgtctgtcgtcctcgaggacaggacggcctagtactcgacctgctcgtggantgcattcgaccaaagcaatatgacttacgtagtacctagacaaggaacgccgagggacccacggtcccctgttaccttaggacttcttaatttaagaaagttcttttaggaaggcgggtacctacggaccgggtccctagacggcgtacgtttcgtacgtcggccttaccgacgtacccgtcacgtacgaaacgtaaaccgtacgtagtaccgtttacggaaaccttacgttacgaacgggttcggggacggtacccgggtacggaacgggtaaccggggaccggtaagggtacccgttaacgggttaaactttaacgttttaacggttacggttaacctaaacgttaaccaaaccggttaaaccgtaacccgaacccgtttaaggtttaacccgggtttaaacttttacggtttacccggttttaaccgtttaaccggggtaacccggtttacgggtaacccccggttaacggttaaaacccccgggg

SEQ ID NO: 67188 - DNA, 553 bp, Homo sapiens
  misc_feature: GYAE6OF02IWZ0N.49.73.G07.1.454.CMB.1.raw
  modified_base (224)..(224): a, c, t, g, unknown or other
  misc_feature (224)..(224): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctnaggacagacggccagtatcacctgctctggagatgcattgccaaagcaatatgtcttactggtaccagcagaagccgaggccacggcccctgtcttgatctatttataaagtactttagagacgggcctacgacgggacccctgacgcgtacttctcgtcggctccagctcacgcgaacaacacgtccacgttacgaccatcgtaggtacggacggtccgggacaggacggacgacggacgtacgtacttaattacgtagtcacgtacgatcgaacgtacgagtagtcgtactacgttcgtcgttacgtacgttcggacgggtaacggg

SEQ ID NO: 67189 - DNA, 655 bp, Homo sapiens
  misc_feature: GYAE6OF02HZ842.49.73.G07.1.454.CMB.1.raw
  modified_base (119)..(119): a, c, t, g, unknown or other
  misc_feature (119)..(119): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttcctccccctctcactctctgcacagactctgacgccttcctatgacgtctagaccacacgcccacccgtcggtgtctgtcgtcctcgaggacaggccggcagtactcacctgctcgtggagatgctattcgaccaaagcaattatacgtcttacgtacggtaaccagacgaagaacgccacggccacggtcccctgtcttgactacgtattaagtaagtactttagaggacggtactacggaccggtacccctagacgtacgtacttccgtacgtcgtcctaccgagtcctacgacggacaacaacgtacgtacgtacgttaccgaacctactacgtacggtacgggtaccggtccgggagaaacggtacgggaaccggtacggtccgtaaggttacgttacgttacgtacggttaccgtacgtacgtaagtccgaaggtaccgtaaggtacggtcgaccgttacttacggtacggtttaccggtagttccggggacggtaaccgggg

SEQ ID NO: 67190 - DNA, 787 bp, Homo sapiens
  misc_feature: GYAE6OF02JZ5XO.49.73.G07.1.454.CMB.1.raw
  modified_base (142)..(142): a, c, t, g, unknown or other
  misc_feature (142)..(142): n is a, c, g, or t
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgagcctctatgagctgacacagccaccctcggtntctgtcgtccctanaggaccaggaccggcctaaggtactccaacccgttgccttcgtaggagagttcggctaagtttcgaaccccgaaaagtcctaaaagttacgtacggtaccttttaaccgtacggggttaacccaagtaccgaaacggaaaccggcccgaacggggaccccaacggggtccccccgttaggttacccgttacggttaactccttaaattttaaacgttaaaacggttaccgtttttagggaacggtaaccggggtaccccttaccggtaaccggggtacccccgttaggaaccggtaccgttaacgttttaccgtcgttaccgggtcccttaccgacggtccgttaccgaacggtaccgaaaccgaacgtacgtaaccgtaccggttacgtaccgtaacgtcgtaacggtcgggtacgtacccgggacgtaacggacggaacggtacggtacgtacgtaacgttacttacgtacgtacgtagtctacgtacgacgtaacgtagtaacggtcgtaaccgttacgttccgttacggtttccgtaaggtttccgggacggtaacggg

SEQ ID NO: 67191 - DNA, 698 bp, Homo sapiens
  misc_feature: GYAE6OF02JXZ1M.49.73.G07.1.454.CMB.1.raw
  modified_base (142)..(142): a, c, t, g, unknown or other
  misc_feature (142)..(142): n is a, c, g, or t
  modified_base (661)..(661): a, c, t, g, unknown or other
  misc_feature (661)..(661): n is a, c, g, or t
tcagagtcgagagacacgaccggtgctcgatttagctctacgctcagggcacgaccggtgctcgtttagagagagtgtgttgggtttgggggtgggtccgaggaggcagaactctgggtgtctcacatggcctggatccctntacttctcccctcctcactctctgcacagactctgaggcctcctatgagctgacacagccaccctggtgtcctgtcgttcctgaggaccagaccggccagtataccaccgtgccttcgtggagagtgacattcggaccaaagccaaatatgcctttaacgtgggtaccagacctaaggaacgaccggaacggccacggccccttgtccgttgacttctaaattttaacgaaagtaccttttaggacggtaacggggtccctacggtaaccggggtacccccttaggacggtaccggttaatttccgtttaaccgtcggggtaccctacccgtacggtacttaccggaacgaaccgaaacgtaaaccgtacgtacgtacgtttcgaaccctagttacacgggttggaacggtcccgggagtacggaaggaccggaggccgtacggtaacttagtttacgtacgtcgtacgtacctagttaccgaagaccggtagttaacggtacggtactacgttttacncggtttaccgttacggttccggggaagggtaaccggg

SEQ ID NO: 67192 - DNA, 658 bp, Homo sapiens
  misc_feature: GYAE6OF02G850H.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagccaccctcggtgtctgtgtcctcgaggacagacggccagtatccacctgctcgtggagatgctattcgaccaaaagacaaatagtcgtactttaacgtcggtaaccagacgaaggaacgccgaacggccgacggtcccctgtctagtatactaatttaactaaagtacgtttagacggacggtcccgtacggaccgggtaccccgtgacgtacgtactttccgtacgtcggtacctccgacgtacctacgacgaccgaacaacgtacgtaccgtacgttacgaacctagtacgaaggtcgggtacggtccgggacgaacgggacggaacgggacggacgttacggtaaccgttagttacgtacgtacgtacgttacaacttacgaacgtaacgtaggttacggtacggacttacgttcggttacggttacgtttacggttacgggaccgggtaacggg

SEQ ID NO: 67193 - DNA, 345 bp, Homo sapiens
  misc_feature: GYAE6OF02F4TFO.49.73.G07.1.454.CMB.1.raw
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (269)..(345): a, c, t, g, unknown or other
  misc_feature (269)..(345): n is a, c, g, or t
tcagagtcgagagacacgaccggtgctcgatttagctctacgctcaggggacgaccggtgcgtcgatttagctctacgctcagggacgaccggtgctcgatttagagagagtgtgtttgggtttggggggaagaggaagactggaccggtccccccaggagttcaggtcgctgggcacagccggccctggctgcctggtcaaggtctacgttcctctctccgactcgtgagcgggcgttggcaacgggcgacagtancanctnagntgnnnnnnnnnnnnnnnnnnnnnnnnnnnnnnnnnnnnnnnnnnnnnnnnnnnnnnnnnnnnnnnnnnnnnnnnnnnnn

SEQ ID NO: 67194 - DNA, 210 bp, Homo sapiens
  misc_feature: GYAE6OF02FZN7S.49.73.G07.1.454.CMB.1.raw
  modified_base (209)..(210): a, c, t, g, unknown or other
  misc_feature (209)..(210): n is a, c, g, or t
tcagagtcgagagacacgaccggtgctcgatttagctctacgctcagggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnn

SEQ ID NO: 67195 - DNA, 164 bp, Homo sapiens; identical to SEQ ID NO: 66630
  misc_feature: GYAE6OF02FJXP8.49.73.G07.1.454.CMB.1.raw
  modified_base (163)..(164): a, c, t, g, unknown or other
  misc_feature (163)..(164): n is a, c, g, or t

SEQ ID NO: 67196 - DNA, 728 bp, Homo sapiens
  misc_feature: GYAE6OF02IB3CJ.49.73.G07.1.454.CMB.1.raw
  modified_base (119)..(119): a, c, t, g, unknown or other
  misc_feature (119)..(119): n is a, c, g, or t
  modified_base (230)..(230): a, c, t, g, unknown or other
  misc_feature (230)..(230): n is a, c, g, or t
  modified_base (285)..(285): a, c, t, g, unknown or other
  misc_feature (285)..(285): n is a, c, g, or t
  modified_base (571)..(571): a, c, t, g, unknown or other
  misc_feature (571)..(571): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttcctccccctcctcacctctcctgaccacagtacctctggacgcccttcctatgacgctagaccacgacgtcccacccgtggtntccttgtcgtacctacgaggacacggtaccgcctagtactcacgtgctcgtgagntcgactagtacgaacaaagactaaagtctcggtacttacgtacgtaccagtacaacgacgacccgtacggcccgaccggtccccttagttccgtagtactacttaagttaaacgtaagttaccgtttagaacgggtacggtaccgtaccgaccggggtacccctaggacgtaccgttacttcgtcccgggtagtcccgtaccgtcgtaccgtacgacggaaccgtaaacaaacgtcgtaccgaccgtacgacctaacgcgtaacggtcggtaacggtcccgggaanaacggggtacggaaccggtacgggtacctaagttaaccttagttacgtaccgtcgtaacgtacgaagtaccgaaacggtacgtagggtaaccgtccggttaactaccgtttcgggtaaccgtttcggtacgggttacccggggaggaaaccccgggg

SEQ ID NO: 67197 - DNA, 610 bp, Homo sapiens
  misc_feature: GYAE6OF02F5S97.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgaggcctctatgagctgacacagccaccctcggtgtctgtgtcctcaggacagacggccagtatccacctgctctggagatgcattcgaccaaagcaaatatgtcttaacgtcggtaccagacaagaacgccgaggccacggcccctgtcttgactcatttaataagtactttgagcgggtcctcgacggacccctgacgcgtactttcctcgtcggtcctaccgagtctacggacggaacaacgacgtacctaaccgttcgaacctacgtacgtaggtcgggacgtcccgggaccagggtacggacggagggtactacggtaactttaacttacgtacgtacgtacgtccgtacgaacgacgaacggccgtaagggtcggacgttaaggttacgttggttaccggttagtttccggggacggtacgggtaaccg

SEQ ID NO: 67198 - DNA, 645 bp, Homo sapiens
  misc_feature: GYAE6OF02HTUNI.49.73.G07.1.454.CMB.1.raw
  modified_base (223)..(223): a, c, t, g, unknown or other
  misc_feature (223)..(223): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccaccctggtgtctgtgtcctnaggacagaccggccagtactccacctgcctctggagatgctattcgaccaaagaccaaatatcgtacttacgtaggtaccagacaagagccgacggccacggccctgtcttgatctaatttaataaagtactttaggacggtacgggcctacgacgggtacccctagacgtcgtacgttctcgtacgtcctccgagtccttcgaacggacgtaaacctaaacgtacgtacgtaaccgttacgacctaacgtcgaacgggttcggaccgggtccgggacgaacgggaacgggtaaccggacgggaccgtacgtaacgttaacgtttaccgtggtaccgtacggtacactacgaacgtaccgtaggtaggttacgacttacgtttcgtacggttacggttacggttccgggacgggtaaccggg

SEQ ID NO: 67199 - DNA, 656 bp, Homo sapiens
  misc_feature: GYAE6OF02I92X0.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccacctcggtgtctgtgtcctcaggacagacggccagtatccactgctcgtggagatgctattcggaccaaagcaatacttgacgtttactaggtacccagccgaaggaacgaccgaaggcccgacggccccccttagttcttcgaactctaattttaaagtaaaacgttacgttttggaacggaacggggtcccttacggacgggtaacccccgttggaacggtaccggtatttcccgtgtcgggtacctccgaacgtcctacgaccggcgaaaccgaactacggtaccgtaacggtttcgaacctatacgtaggtcggacgggttccgggacagggacggacgtacggcgttagtaccttagtttactcggtctaaggtccagtaccgaaggtaaccgagttaggacgtcctacgtttccgtagttcgttacggttaccgggacggtaaccggg

SEQ ID NO: 67200 - DNA, 775 bp, Homo sapiens
  misc_feature: GYAE6OF02HMWVG.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagacctgtaggacgtcctactagtaggacgtcgtacgaacaacgaccgtacccctaccggttcggttcgttcgttcgttccgtccctaggacggaaacggtaccgggaccgaaccgtaagttactacctaccgtcgtccgtaggtaggagtaacgtcgtacttacgtaccgaaacgaaacgtaactaaattcgtacgttacgttacggttaccgaacgacgacgaaggtaccgaccggacggacccgtcccggtaccttggttactagtacttacttaaagttaaataacgttgtacggagggtaccgtaccgtacgggacccggtacgtacgactacgttacttcggtccgtacgtcctcgactccgtaacgaccgaacaactaacggtcctaacggttacgtaaccgtaactacgtacggtagggtacggtccgggtaccgggaataggggaaccggtacggtacgtacggtaacgtttaacgtacgtttacacggtaagtaccgtacgtaacgtaacgaaggtaccggttaggtaccggttagtaccctttcggttaccgttggtttaacccgggtaggtaccgggggtaaccgtaacccggg

SEQ ID NO: 67201 - DNA, 764 bp, Homo sapiens
  misc_feature: GYAE6OF02JLVSF.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgagcctctatgagctgacacacgcccaccgtcggtgtctggtcgttcctcgaggacaggaccggtccagttactccacctcgtccgttcctggagagtcggcatttgaccaaaggccaaaatagtgtacctttaacgtacggttaccagcgaagaacgaccgacgggtcccgaacgggtccccctgttccgtttacggactactaagttttaaactaaaacgtaccgttttttaggaacggtaacgggtcccttaccggaaccggggttaacccccgtaggaaccggtccggtaaaccgtttccgttccggttcggccgttcccgagtccgtacgtacgccggaaccaacgtacgtaccgtaccggttacgacccgactagtacgtcggggtacgtccggggtaacgacggtacgggaaccggtagggtaccgtccgggttaacttaacgttaccgtttacggtacgtaacgttaccgtacgtaccgtaaggaaccgttaacggtacggttccgtacggttaccgttttaccgttacggttacgggtttaaccggtttaccggggtacccggggttaaacccgggggg

SEQ ID NO: 67202 - DNA, 718 bp, Homo sapiens
  misc_feature: GYAE6OF02ILUUB.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgacggcctcctatgagctgacacagcccacccgtcggtgtctgtcgtcctcgaggacaggaccggccagtactcacctgctcgtggagatgctattcgaaccaaagactaaattagtgtacttacgtacggtaccacgacgaaggaacgaccgacggcccgaccggtccccttgttacttacgtattacttaattttaaacgtaaacgttacgtttaggaacggtacgggtcctacggaccggaccccgtaggacgtcgtactttctcgtcggtcctcacgtcctacgacgaccgaacaacgtacgtaccgtacgttaccgaacctacgtacggtacgggtacgggtaccggtacccggggaacgaacggggtaacgggtaacgggacgggtaccgttacggtaaccgtttaacgttaccgtagttaccgtacgtacctaacgtacgaaacggtaaccgttaagggttacggtacggtaccgttaccgtttacggttacggtttaccggttacgggttaccggggaaccgggtaaccggg

SEQ ID NO: 67203 - DNA, 681 bp, Homo sapiens
  misc_feature: GYAE6OF02JWWCB.49.73.G07.1.454.CMB.1.raw
  modified_base (119)..(119): a, c, t, g, unknown or other
  misc_feature (119)..(119): n is a, c, g, or t
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggactccctntacttcnccccctctcactctctgcacagactctgacgcctctatgagctgacacacgccacctggtntctgtcgtcctnaggacagcgccagtacncactgctgtggantcgctagtcgaccaaagcaatntcgtcttacgcggtaccagcaagaccgaccgtacggacccacgggtcccttgttaccgttagtacttaccttaagtttaacgtaaacgtacgttttggaacggtacgggtacccttacggaacgggtaccctagacggtaccgtacttccgtcgtacggtcctacgtagtcctaccgaggaccgtaaacgaacgtacgtaccgtaacggttacgaaaccgtttagacgacggttacgggtacggtccgggaacgtaacggacggtacgggtaggtaccgttggtaacctttagttaccggtagttacctacggtactaacgttacggaaaccgtaacggtaaaggttccgtacgtaaccgttacgttcgttaacgggtcgtttacgggtacgggacggttaacggg

SEQ ID NO: 67204 - DNA, 192 bp, Homo sapiens
  misc_feature: GYAE6OF02FHAY9.49.73.G07.1.454.CMB.1.raw
  modified_base (186)..(192): a, c, t, g, unknown or other
  misc_feature (186)..(192): n is a, c, g, or t
tcagagtcgagagacacgaccggtgctcgatttagctctacgctcagggcacgaccggtgctcgatttagctctacgctcagggcacgaccggtgctcgatttacgtccgatagtgaagggctatgcgtcttcatcttcccaccctcctctctctcgactctgagcgggctggcaaggcgcatagnnnnnnn

SEQ ID NO: 67205 - DNA, 688 bp, Homo sapiens
  misc_feature: GYAE6OF02GFJLP.49.73.G07.1.454.CMB.1.raw
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
tcagagtcgagagacacgaccggtgctcgatttagctctacgctcgagggcacgaccggtgctcgtttagagagagtgtgttgggtttgggggtgggtccaggaggcagaactctgggtgtctcaccatggcctggatccctctacttctccccctcctcactctctgcacagactctgacggcctctatgagctgacacacgcccaccctggtntctgtctcctanaggacacgaccggcctaagtactccactgcctcgtaggatagtgcttagttaccgaaccaaagtcctaaagttgtacggttacctttaacggtacggtaacccagacgaaggaaccgtccgaaccggtcccgaccgggtcccctgtttcctagacttacttaaatttaaagtaacgtacgtttagaacgggtccggtacctacgacccggggtacctggacgtaccgttattccctaggtcggtacctaccgacgtctacgacgaccgtacaacgtacgtaccgtacgttacgaaccctagtccgtagggtacggccgggtaccggaagaaggtacgggacgtacgtccgtagttacttattaccgtgtacgtcgtactacgtacgtaacgacgtacgggttagaccgtaccgttacgtttcggttggttaccggttacggttccgggggaacggaacggg

SEQ ID NO: 67206 - DNA, 652 bp, Homo sapiens
  misc_feature: GYAE6OF02F1OBL.49.73.G07.1.454.CMB.1.raw
  modified_base (191)..(191): a, c, t, g, unknown or other
  misc_feature (191)..(191): n is a, c, g, or t
  modified_base (259)..(259): a, c, t, g, unknown or other
  misc_feature (259)..(259): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatganctgacacagccaccctcggtgtctgtgtcctcaggacagacggccagtatcacctgctctggagatgnattgaccaaagcaatatgctttactggtaccagacagaacgccgaggccgacggcccctgtcttgatctaatttataaagtctttaggacgtagggcctacgacgggaccccttgacgacgtatttacctcggtcggccttccgacgtcctacgtcgaccgaaccaaccgtaggttaccgtaccgttcggtaaccctacgttacgtaacgggtcgggtacgggttcccggggacaacggggaaccgggtacggtagggaccgttacggtaaaccttaactttacgttagttaccgtacggttacacgtaccgtaaggaccgtaaggttacggttacggtaccgtaccgtttcgttcggttaccggttacggtttaccgggccgggtaaccggg

SEQ ID NO: 67207 - DNA, 657 bp, Homo sapiens
  misc_feature: GYAE6OF02FWHQ0.49.73.G07.1.454.CMB.1.raw
  modified_base (213)..(213): a, c, t, g, unknown or other
  misc_feature (213)..(213): n is a, c, g, or t
  modified_base (243)..(243): a, c, t, g, unknown or other
  misc_feature (243)..(243): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgacggcctcctatgagctgacacagccacctcggtntctgtgtcctcgaggacagacggccagtancacctgctctggacgatcgcattacgacctaaaagactaactattgtacctttacgtcggttaaccgaggacaacggaaacgcccgaacgggcccgaaccggtcccccgttaggttccttacgtacttacgtaattttaaataaagtacgttttaggaggtacgggtacctacgacgggtaccccgtagtacgacgtactttccgtacgtcgggtcctaccgtagtcctacgacgacgaaccaacgtacgtacgtacgttacgaacgtactcgacgtcggtacggtcgggacgtaggacggacggaggtcgtacgaacttactacgtcgtactagtctagacgtaacggaacgtaaggttagtacggtactacgtttcgtacggttacgttacggttacggacgggtaaccggg

SEQ ID NO: 67208 - DNA, 171 bp, Homo sapiens
  misc_feature: GYAE6OF02F1HZQ.49.73.G07.1.454.CMB.1.raw
  modified_base (157)..(157): a, c, t, g, unknown or other
  misc_feature (157)..(157): n is a, c, g, or t
  modified_base (163)..(171): a, c, t, g, unknown or other
  misc_feature (163)..(171): n is a, c, g, or t
tcagagtcgagagacacgaccggtgctcgatttagctctacgctcagggcacgaccggtgctcgatttagtcacgcgagaaagggaaagggggctggccctgacgtgtttctgttcccgccctcctctctctcgactctgagcgggctggcaaggcncatagnnnnnnnnn

SEQ ID NO: 67209 - DNA, 680 bp, Homo sapiens
  misc_feature: GYAE6OF02HWZYQ.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttcctccccctcctcactctctgcacagactctgacggcctcctatgagctgacacacgccacccgtcggtgtctgtcgtcctcgaggacacggaccggccagtatccacctgctcgtggagtagtgactagttcgaacctaaagactaatagtcgtacttacgtacggtaaccagacaagacgaccacggccgtaccggtccctagttctacgactacttaagttaaagtaaagttcgtttaacgggaggtacggtacccgtacggaccgggtaccctaggtacgtaccggttacttcgtccggtacggtcctaccgtagtccgtacgacgtaccgaaactaacgtacgttacgtaacgtacgaacctacgtacgtacgggtagggtacggaccgggtacggaacggtaacgggacggtacgggatacgtaacgttactacggtatacgtacgtactagtacggaagtaccggtaggtacgtacgtacttacgttccggtagttaccggttaggttaccgggacggtaaccgg

SEQ ID NO: 67210 - DNA, 697 bp, Homo sapiens
  misc_feature: GYAE6OF02IERE0.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgacggcctctatgagctgacacagccacccgtggtgtctgtcgtcctgaggacagacggccagtactcacctgcctctggagatgctattcgaccaaagcaatatgtcttacgtggtaccagcaaggaacgccgaggcccacggtccctgtcttgatctaatttaataaacgtctttaggaaggtacggtcctacggaaccgggtaccctagacggcgtatttccgtacggtcgtacctccgacgtcctacgacggacctaacgaaacgtacggttacccgttaacggttaccgaaacccgttattacggtaacggttggggtaaccgggtcccgggacggtaacgggaaccggggtacgacgggtaccgttacggttaaacctttaacgttaacggttcgttaacgtacggttaccgtaacgtaacggtaggtaaaccgtaagggttacggttacggtacccgttacgttttcggtaccggtttacgggtttaccggttaccggggacgggtaaaccgggg

SEQ ID NO: 67211 - DNA, 550 bp, Homo sapiens
  misc_feature: GYAE6OF02GUOAX.49.73.G07.1.454.CMB.1.raw
tcagagtcgagagacacgaccggtgctcgatttagctctacgctcagggcacgaccggtgctcgtttagagagagtgtgttggggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacaggacggccagtatcacctgctctggagatgcattgccaaagcaatatgcttactggtaccagcagaagccaggccaggcccctgtcttgatctatttaataaagtactttgagtacgggcctcgacgggacccctgacgcgattcctcgtcggctccgagtctcacgcgaacaacagtcctacgttcgaaccagtcaggtggacggtccgggcgagggacggacgaggctagacttaacttactgtacagtcatacgaagacgtagtaggtacggacctacgtttccgtgttacggtacgttcgggacggtaaccgggg

SEQ ID NO: 67212 - DNA, 551 bp, Homo sapiens
  misc_feature: GYAE6OF02FR5VX.49.73.G07.1.454.CMB.1.raw
  modified_base (198)..(198): a, c, t, g, unknown or other
  misc_feature (198)..(198): n is a, c, g, or t
  modified_base (541)..(541): a, c, t, g, unknown or other
  misc_feature (541)..(541): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgagcctctatgagctgacacngccaccctggtgtctgtgtcctcaggacagacggccagtatccacctgctctggagatgcattgccaaagcaatatgcttactggtaccagcagaagccaggccacggcccctgtcttgatctatttactaaagtactttgagagggccctcgacgggacccctgagccgatttcctctcggcctccagcctcgacgaccgacaaccgagtccgacgttcgacccatcagtgggtacggtcccgggacgaacggagggacgacggacgtacgtaactaacttacgtgttcagttacactccgaagacaggtaagtgcctacttcgtggtacggtagttccggnggtaaccggg

SEQ ID NO: 67213 - DNA, 563 bp, Homo sapiens
  misc_feature: GYAE6OF02IOB10.49.73.G07.1.454.CMB.1.raw
  modified_base (142)..(142): a, c, t, g, unknown or other
  misc_feature (142)..(142): n is a, c, g, or t
  modified_base (263)..(263): a, c, t, g, unknown or other
  misc_feature (263)..(263): n is a, c, g, or t
  modified_base (457)..(457): a, c, t, g, unknown or other
  misc_feature (457)..(457): n is a, c, g, or t
tcagagtcgagagacacgaccggtgctcgatttagctctacgctcagggcacgaccggtgctcgttttagagagagtgtgttgggtttgggggtggtccaggaggcagaactctgggtgtctcaccatggcctggatccctntacttctccccctctcactctctgcacagactctgaggcctacctatgagctgacacagcccaccctcggtgtcctgtctcctacaggacacggaccggccagtatcacctgctctggagntgcattgaccaaagcaatatgcttactggtaccagacagaacgccgacggccacggtcccctgttaccttgattacatttataaagtctttagaggaggtcctacgacgggtacccctaggacgcgaattctacgtgccttccagctacagcgaacacacgtccagttcgaccactcgagtcggacgtccgggnaaggacggacgaggctagaccttattacgtcgtactacgtcagtcgaaggtaactaggtagtacggactacgttcctagtcggtacgttccgggagggtaaccggg

SEQ ID NO: 67214 - DNA, 572 bp, Homo sapiens
  misc_feature: GYAE6OF02FLO0Z.49.73.G07.1.454.CMB.1.raw
  modified_base (200)..(200): a, c, t, g, unknown or other
  misc_feature (200)..(200): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttctccccctcctcactctctgcacagactctgaggcctctatgagctgacacngccaccctcggtgtctgtcgtcctcaggacagacggccagtatccacctgctctggagatgcattgaccaaagcaatatgcttactcggtaccagcagaacgccaggccacggccctgtcttgatctatttaataaacgtatttagagagggcctcgacgggtaccccgtgacgcgtatttctcgtcggtctaccgacgtctacgacgacgaacaacacgtctacgttcgaaccactcaggtgtacggtccgggcgagggacgggacgacggacgtagtacttaatttacgtcgtacgagtcactacgagacgtacgtaggtgtactacgtttcgtacggtttacggtacggttccgggacgggtaaccggg

SEQ ID NO: 67215 - DNA, 680 bp, Homo sapiens
  misc_feature: GYAE6OF02G3IU2.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccacccgtcggtgtctgtctcctcgaggacagaccggccagtactcacctgctcgtggagatgctattcgaccaaagcaatatgacttacgtggtaccagcaagaacgtccgaggcccacggaccccttgtacgttgacttacgtaatttaacgtaaagtactttaggaacggtacgggtccctacggaccgggtacccctggaacgacgttacttcctcgtacgcctaccgacgtctaacgtacggaccgaacgtaaccgtacgtaccgtaccgttcgaaacctcgtacgtaggtcggaccggtaccgggacgtaacgggaacggacggtacggtaccggtacgtaaacgtttaacgttaacgttcggtaccgtacgtacgtaacgtacgaaccggtaacgttaagggtacggtacgttaccgttacgtttccggttacggtttaccgtacgggttcccgggacggtaaacccgggg

SEQ ID NO: 67216 - DNA, 690 bp, Homo sapiens
  misc_feature: GYAE6OF02HNB2Z.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcacatgggcctggatccctctacttcctccccctcctcactctctgcacagctctgacggcctcctatggatcgtgaccaacacgccctacccgttggtgtctggtcgtcctacgaggacgaggccggacctagtactcaccgtggcctcgtaggagtagtgtactattacggaaccaaagactaaattacgtacgtacctttaaccgttacggtaaccaacggacaaacgaaccgaccggacggacccggaccggtaccccgttcgttacgttacgtacttaaccgttaatttaaacgtaaacgttaacgtttaggacggtacgggtcctaaccggtaccgggtacccctaggtaccgtaccgttacttaccgtcgtcggctacgtacgtacctcgtacgaccgaaactaacgacgtacgtacgtacaacctgacgtaggtacggacgtcggaggacggaggacggacgtcgagttaacttacgtacgtcgtacgtacgtacacgtcgaagactaggtacgtacgacttacgttcggacgtttcggtacgttcgggacggtaacggg

SEQ ID NO: 67217 - DNA, 703 bp, Homo sapiens
  misc_feature: GYAE6OF02FU3T0.49.73.G07.1.454.CMB.1.raw
  modified_base (213)..(213): a, c, t, g, unknown or other
  misc_feature (213)..(213): n is a, c, g, or t
  modified_base (272)..(272): a, c, t, g, unknown or other
  misc_feature (272)..(272): n is a, c, g, or t
  modified_base (579)..(579): a, c, t, g, unknown or other
  misc_feature (579)..(579): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatcggcctggatcccctctacttctccccctcctcactctctgcacagctctgagcctctatgagctgacacagcccacccgtcggtntctgtgtcctgaggacagaccggccaagtactccacctgcctcgtggacagtcgacgtnttacggaacccaaaaggcctaaaagttagtcggtaacctttacgtccgggttaaacccgacgtacgaacggaaacgtcccggaaacggtcccgaaccgggtccccctttgggttaccctttggaacttaccgttaaattttaaacgtaaaacgttcgttttaagacggggtacgggtcccttaccgggaaccgggtacccctagggacgtaccgttactttccgtcgtacggtcctcgacgtcctacgacgtaccgaacgactacgtacgtacgttacgacctatacgtggtacggtacggtccggngaacggacggacggacgggtacgtacgtacgttaacgttacgtgttacgtaccgtacgacgtagtacgtaacgtacggtaacgtcgtactcgttcgttacgtcgttacggttcggacggtacgg

SEQ ID NO: 67218 - DNA, 670 bp, Homo sapiens
  misc_feature: GYAE6OF02H3FGM.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagcccacccgtggtgtctggtcgtcctcgacggacaggaccggccagtactcacctgctcgtggagtatgctattcgaccaaagactaatagtcgacttacgtacggtaccagacgagaacgccacggacccgacggtccccttagttccgttagtactacttaattttaaagtaaacgtacgttttaggaggaccgggtacctacggaccggtaccccgtaggacgtacgtactttcgtacgtcggtcctccgacgtcctacgacgaccgtaacgaacgtacgtacctacggtttacgaacctacgtacgtagggtacgggtaccggtaccgggcgaagggacgggacgacggcgtacgtaacgttagttactcggtactacgtactacgtacgaacgtacgaacggttaggaccggtacgttaccgtttcggttacgttacggtttacggtccggggtacggtaaccggg

SEQ ID NO: 67219 - DNA, 176 bp, Homo sapiens
  misc_feature: GYAE6OF02HQLYA.49.73.G07.1.454.CMB.1.raw
  modified_base (165)..(176): a, c, t, g, unknown or other
  misc_feature (165)..(176): n is a, c, g, or t
tcagagtcgagagacacgaccggtgctcgatttagctctacgctcagggcacgaccggtgctcgatttagtcacgcgaggaaagggaaggggctggccctgacgtgtttctgttcccgccctcctctctctcgactctgagcgggctgggacaaggcgcaatagnnnnnnnnnnnn

SEQ ID NO: 67220 - DNA, 634 bp, Homo sapiens
  misc_feature: GYAE6OF02F2QEI.49.73.G07.1.454.CMB.1.raw
  modified_base (502)..(502): a, c, t, g, unknown or other
  misc_feature (502)..(502): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacagccacctcggtgtctgtgtcctcaggacagaccggccagtactcactgctctggagatgctattgaccaaagcaatatcgtctttacgtcggtaaccgagtacgaagaacgccgacggcccgacggtcccctgtcttagacttactaattttaactaaagtacgttttagacggtacgggtcctacggaccgggaccctagggacgtcgtacttccgtcgtcggtcctcgacgtctacgtacgaccgacaaaccgtcgtacctacgttacgaaccgtatcgtaggtcgggtacggtccggganacgggagggacggaggtcgtacgtaacgttacgttacgtcgtcgtacgtctaagtaccgtaagtacgttaagggtacgtcggtaccgttactttacgtcggttacgttaacggttccggggaggtaaccggg

SEQ ID NO: 67221 - DNA, 163 bp, Homo sapiens
  misc_feature: GYAE6OF02JFKP7.49.73.G07.1.454.CMB.1.raw
  modified_base (157)..(163): a, c, t, g, unknown or other
  misc_feature (157)..(163): n is a, c, g, or t
tcagagtcgagagacacgaccggtgctcgatttagctctacgctcagggcacgaccggtgctcgatttagtcacgcgagaaagggaaggggctggcctgacgtgttctgttcccacctcctctctctcgactctgagcggctggcaaggcgcatagnnnnnnn

SEQ ID NO: 67222 - DNA, 707 bp, Homo sapiens
  misc_feature: GYAE6OF02JS2DX.49.73.G07.1.454.CMB.1.raw
  modified_base (144)..(144): a, c, t, g, unknown or other
  misc_feature (144)..(144): n is a, c, g, or t
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
  modified_base (618)..(618): a, c, t, g, unknown or other
  misc_feature (618)..(618): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatcccctntacttctccccctctcactctctgcacagctctgacggcctcctagtgagctgacacacgccacccgtcggtgtctggtagtccctagaggactacggaaccggccaggttactctaccgtgtcctcgtggantcgactattccggaacctaaagccaagtntacgtcttacgtacgtaccagcaagacgaccgaggaccctcggcccgttgtaccgttaggaccttacgttaatttaaacgtaacggttaccgtttagggaacggtacgggtacccttacgggaccgggtacccctaggaccggtaccgtcgtttaccgtaagtccggtaccgtcccacgttccacggacggacccgtaacgtaacgtacgtaccgtacgttaccgaccgtaacgtacgtaggtacgggtaaccggtcccgggaagacggaccgggtaacggcggtagtaccgtaacgtttacgtaacggttntacggtactcaacggtcctaaaggactagggttcgtaacgtcgttaccgtttggacggtttacgtacgggtccgggtagggtaacccgg

SEQ ID NO: 67223 - DNA, 295 bp, Homo sapiens
  misc_feature: GYAE6OF02I11XD.49.73.G07.1.454.CMB.1.raw
  modified_base (275)..(275): a, c, t, g, unknown or other
  misc_feature (275)..(275): n is a, c, g, or t
  modified_base (281)..(295): a, c, t, g, unknown or other
  misc_feature (281)..(295): n is a, c, g, or t
tcagagtcgagagacacgaccggtgctcgatttagctctacgctcagggcacgaccggtgctcgatttagctctacgctcagggcacgaccggtgctcgatttacgctctacgctcagggtcgacgaccggtgctcgatttacgagagagtgtgttgggttgggggaagaggaagactgacggtcccccaggagttcaggtgcgtggcacagcggccctgggctgcctggtcaaggactacttcctctctcgactctgaggcggctggcaaggcncatagnnnnnnnnnnnnnnn

SEQ ID NO: 67224 - DNA, 658 bp, Homo sapiens
  misc_feature: GYAE6OF02FYOFR.49.73.G07.1.454.CMB.1.raw
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacgcctctatgagctgacacagccaccctggtgtctgtgtcctgaggacagacggccagtacnccactgctctgganatgctattcgacaaagctaaatatgacttacgtcggtaccagtcgaagaacgccgaaggcccgacggtccccttgtccttgactctaatttaagtaaagtctttagacggtacgggtccctacgaacgggtaccccttggacgtcgtacgtttcctcgtcggtccctaccgacgtcgtccgaacggtaccgaaaccgaacgtaacggtcctaaccggtttacgaaccctagttccggtaagggttacgggtaccgggtcccgggacgtaacggggacgggacggtacggtcgttacgtaacgtttacgttacgtcgtacgtacggtactacgtacgtaaggactaaggtcgtacgtccttacgttcgttacggtacgtttacggtaccgggtacggtaaccggg

SEQ ID NO: 67225 - DNA, 611 bp, Homo sapiens
  misc_feature: GYAE6OF02IITV8.49.73.G07.1.454.CMB.1.raw
  modified_base (424)..(424): a, c, t, g, unknown or other
  misc_feature (424)..(424): n is a, c, g, or t
  modified_base (601)..(601): a, c, t, g, unknown or other
  misc_feature (601)..(601): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgaggcctcctatgagctgacacagcccaccctcggtgtctgtcgtcctcaggacagaccggccagtactcacctgctctggagatgcattcgaccaaagcaatatgtcttacgtggtacccagcagaacgccgaggccacggtccccgtagttccgttagacttcgtaatttaagtaaagtacttttaggaggacgggtcctacgacgggtacccctgacgcgtattctcgtacggccttccgacnctaccgagaccgaacaacgtacgtccgtacggtttcgaaccctatacgaggtcgggtaccggtccgggacgaaggacgggaacgcggtactaggtaaccttagttacgtgtacgtagtcacgtcgaactacggtaagtacgtcgccgttaacttcgtacgttacgtacggttacggnggtaaccggg

SEQ ID NO: 67226 - DNA, 633 bp, Homo sapiens
  misc_feature: GYAE6OF02GTUKB.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcgactctctgcacaggacctctgacggcctcctatgagctgacacacgcccacccgttggtgtctgtgtcctgaggacacggacggccagtactccaccgtgctcgtggagatgctagttcgaccaaagctaatatgtacttacgtcggtaaccagacgaagacgccgacggccgacggtccccgtgtcttagtactactaatttaacgaaagttacgtttaggacggacggtccctacggaccgggtaccctgacgcgttattcctcgtcgctaccgtagtcacgtacgaccgaaccgtaacgtacgtacgtacgttacgtaacctagtacgacggtaggtacggtaccgggagacggaaggtacggacggtcgtacgtaattacgttacgtacgtacgtacgtacacgtacgaagacgtaggtacggtacgtacgtacgttcgtacggttcgtacggtccgggacggtaaccgg

SEQ ID NO: 67227 - DNA, 185 bp, Homo sapiens
  misc_feature: GYAE6OF02GJ53Y.49.73.G07.1.454.CMB.1.raw
  modified_base (179)..(185): a, c, t, g, unknown or other
  misc_feature (179)..(185): n is a, c, g, or t
tcagagtcgagagacacgaccggtgctcgatttagctctacgctcagggtagctctacgctcagggcacgaccggtgctcgatttagtcacgcgagaaagggaaaggggctggccctgacgtgtttctgttcccgccctcctctctctcgactctgagcgggctggcaaggcgcatagnnnnnnn

SEQ ID NO: 67228 - DNA, 780 bp, Homo sapiens
  misc_feature: GYAE6OF02F4CL9.49.73.G07.1.454.CMB.1.raw
  modified_base (223)..(223): a, c, t, g, unknown or other
  misc_feature (223)..(223): n is a, c, g, or t
tcagagtcgagagacacgaccggtgctcgatttagctctacgctcagggcacgaccggtgctcgtttagagagagtgtgttgggtttgggggtgggtccaggagggcagaactctgggtgtctcaccatggcctggatccctctacttctccccctctcactctctgcacagactctgaggcctcctatgagctgacacagccaccctggtgtctgtgtcctnaggacagacgccagtatccacctgctctggacgatgcgtattcgaccaaaagctaaagtactagacctttaacgtcggtaaccagtaccgaaggaacgccgaacggacccgacgggcccccttagtccgtttacgattacctaattttaagtaaacgttacttttacggacggtacgggtaccctacggaaccgggaccccttaggacggtcgtaacgtttcgtacgtcgggaccttccgacgtcctcggacgtaccgaacgaaaccgtacgtaccgtaaccggtttacgaaccgtacgttaccgtaacggttacgggtaccggtaccggggacgtaacgggaaccgggtaaccggaacgggtaaccgttacggttaaacgtttaacgttaaccggtttacggttaccgtaacgttacccgtaacgtacggtaaacggtaaacccgttaaggggttaacgggttaaccggtaaccggttacccggttttacgggtttaacgggtttacccgggttttaacgggttttacccgggggaaccggggttaaacccggggg

SEQ ID NO: 67229 - DNA, 164 bp, Homo sapiens; identical to SEQ ID NO: 67073
  misc_feature: GYAE6OF02GWC63.49.73.G07.1.454.CMB.1.raw
  modified_base (163)..(164): a, c, t, g, unknown or other
  misc_feature (163)..(164): n is a, c, g, or t

SEQ ID NO: 67230 - DNA, 677 bp, Homo sapiens
  misc_feature: GYAE6OF02IE32K.49.73.G07.1.454.CMB.1.raw
  modified_base (265)..(265): a, c, t, g, unknown or other
  misc_feature (265)..(265): n is a, c, g, or t
  modified_base (398)..(398): a, c, t, g, unknown or other
  misc_feature (398)..(398): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacacgactctgacggccttcctatgagctgacacacgccacccgtggtgtctgtcgtcctagagacagaccggccagtactcacctgcctcgtgganagtgctagttcgacaaagcaatatagcttacgtcgacagcagacgcgacgccgtacggccctgttcttagactcgtaatttaaactaaacgttatttaggacggacgtccgtacgaccgggtacccgtgacgngtacttacgttcgtcggtcctacgtacgtccgtaacgacgtacgaactaacgtacgtacttacgttaccggtaacctagttacggaggttacgggtacccgggtcgggaacgtaacgggacggggtaaccggtacggtcgttaacgtacgttaacgtttacgtcgtaacgtcgtactacggtaccgtaaggtaaccgtaacggttacgggtaccgtaaccgtttccgtttacggttacggttacggttaacgggttccggggttaaccgggaacccggg

SEQ ID NO: 67231 - DNA, 648 bp, Homo sapiens
  misc_feature: GYAE6OF02F8G8S.49.73.G07.1.454.CMB.1.raw
  modified_base (142)..(142): a, c, t, g, unknown or other
  misc_feature (142)..(142): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggccttcctatgagctgacacagcccacccgtggtgtctgtcgtcctacgaggacaggaccggccagttactccacctgctcgtggagatgctattcgaccaaaagctaaatatcgtacctttacgtcggtaccagacgaaggaacgaccgacgggcccacggtcccctagttctgatactatttaanaagtctttgaggacggtccncggacgggaccctaggactacgtattcgtcgtcggaccttccgacgtctaccgacgaccgaaaccaacgtacgttaccgtaacgttacgaacctacgttacgacgggttagggtaccggtaccgggacgaagggaccggtaacgggtacggaccgttagaacctttacgttacgttcgtacgtacgtacacgtacgaagtaccgtaggtagtcggtaccttacgtttcgtcggttacggtacgttcggggacggtaaccggg

SEQ ID NO: 67232 - DNA, 715 bp, Homo sapiens
  misc_feature: GYAE6OF02JCKST.49.73.G07.1.454.CMB.1.raw
  modified_base (141)..(141): a, c, t, g, unknown or other
  misc_feature (141)..(141): n is a, c, g, or t
tcagagtcgagagacacgaccggtgctcgatttagctctacgctcgagggcacgaccggtgctcgtttagagagagtgtgttgggtttggggtggtccaggaggcagaactctgggtgtctcaccatggcctggatccctntacttctccccctctcactctctgcacagacctctgagccttcctatgagctgaccacgacgccctacccgtggtgtctggtcgtcctcgaggacagaccggccaggactccaccgtgcctcgtcggagtatcgctagttccgaacccgtaaaccgtattagtcgtacctttaagttacggtaccgaggtacgaacggaaccggtcccgggaccgtaccggtcccccgttaggttccggtttaggtacgtaagttacgtaaagtaaacggacctaagtaggtaacggtccggtacccgtacggagggtacctacccggtagacgtaccgtacttccgtacgtcgtcccgtacgtaacgggtcgaacggaccgtacggtaccacgttacgtccgaccgtacttacgtacggtacgtacgtaccgaggacgaaggtaccgggacggtacggtccttagtacgttaagtttacgtacgtaaacgtacgtaccgaacgtacgtaaccgtacgttaacgttacgttacttacgttccgttacgtaccgtacgtacgaccgtaccgtaccggttacccgg

SEQ ID NO: 67233 - DNA, 516 bp, Homo sapiens
  misc_feature: GYAE6OF02JE92D.49.73.G07.1.454.CMB.1.raw
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (426)..(426): a, c, t, g, unknown or other
  misc_feature (426)..(426): n is a, c, g, or t
tcagagtcgagagacacgaccggtgctcgatttagctctacgctcagggcacgaccagtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctnaggacagaccggccagtatcacctgctctggagatgcattgccaaagcaatntgcttactggtaccagcagaanccaggccaggcccctgtcttgatcatttataaacgactttggagagggcctcagggacccctgacgcgatctctagctccagtctcgagcaccaacagtacacgttgaccatccgagtggaggtccggngaggaggacgaggtactcgactacgtacttgctagtcgatccgagacgagttagtaggtctacgttctcggtacgttcgtcggtaccggg

SEQ ID NO: 67234 - DNA, 665 bp, Homo sapiens
  misc_feature: GYAE6OF02IBSE8.49.73.G07.1.454.CMB.1.raw
  modified_base (194)..(194): a, c, t, g, unknown or other
  misc_feature (194)..(194): n is a, c, g, or t
  modified_base (216)..(216): a, c, t, g, unknown or other
  misc_feature (216)..(216): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctaccttctccccctcctcactctctgcacagactctgacggcctcctatganctgacacagcccaccctcggtnttcctgtcgtcctcgaggacagacggccagtactcactgctcgtggagatgctattcgacaaagactaattagtctacttaccgtagggtacccagaccaaggaacgccgaacggcccacgggtcccctggtacttgacttctaatttaataaaggttagtttacggaggtacgggtaccttacggaccgggaccctgacgtccgtaagttccgtcgtcgtaccctacgacgtccttcgaacgtaccgaaacacgtaacgttaccgtacgttacgacctatacgagtacggacgggttccggagacgggacgggagacgggtctacgtacgttaacttggtaacgtcgaagttccaacgtggaacctaaaggtacggttacggttaccggactttaccggttcgttaccggttacggttttacggtacccggggtacgggtaaaccggg

SEQ ID NO: 67235 - DNA, 677 bp, Homo sapiens
  misc_feature: GYAE6OF02JE1T1.49.73.G07.1.454.CMB.1.raw
tcagagtcgagagacacgaccggtgctcgatttagctctacgctcaggtcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctgacacacgccacccgtcggtgtctgtcgtcctcgaggacaggacggccagtactcacctgctcgtggacgtagtcgtcattcgaccaaagctaaactaatcgtacttacgtacggtaccacgacgaagaacgccgacggtccgacggtccccgttgtcttgatctaatttaataagtactttaggacggtacgggtacctacggaccgggtaccccgtaggtaccgtcgtaacgtttcgtcggttcgggacctccgtagtccgtaacgacgtaccgtaacgaaacgtacggtacctaacgttccgaacctacgtacggtaacggtcgggtaccgggtacccgggacgaacgggaacggacgggtacggtcgtacgtaacgtttacgtaccgtgtaccgtacggtactagtacgtaataagtaacgggtgtaccgtacgttcgttacgtggtttccggttaacggttaccgggacgggtaacggg

SEQ ID NO: 67236 - DNA, 257 bp, Homo sapiens
  misc_feature: GYAE6OF02FQ0RT.49.73.G07.1.454.CMB.1.raw
  modified_base (213)..(257): a, c, t, g, unknown or other
  misc_feature (213)..(257): n is a, c, g, or t
tcagagtcgagagacacgaccggtgctcgatttagctctacgctcaggggcacgaccggtgctcgatttagagagagtgtgttgggtttggggggaagaggaagactgacggtccccccaggagttcaggtgctgggcacagcggccctgggctgcctggtcaaggactacttcctctctcgactctgagcgggctggacaaggcgcaatcgnnnnnnnnnnnnnnnnnnnnnnnnnnnnnnnnnnnnnnnnnnnnn

SEQ ID NO: 67237 - DNA, 661 bp, Homo sapiens
  misc_feature: GYAE6OF02F114F.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctggtgtctgtgtcctcaggacagacggccagtatcacctgctctggagatgctattgaccaaagcaatatgtcttacgtcggtaccagcaagaacgccgacggccgacggtcccctgtcttgtatactaatttaataaacgtactttaggaggacgggtcctacgacgggtacccctggacgcgtactttcgtcgtcggtcctccgagtcctacgacgtaccgaacaaacgtacgtacgtaaccggttacgaaccgtacgttaccgtagggtacgggtaacgggtcccgggaacgtaacggggaacgggaacggacgggtacgtacggtaacgtttaacgttacgttcgtacgtaacgttacgtaactaccggaacgtaacgtaaggtaacggtcggtaccttacgtttccgttacggttaccggttacggttaccgggaccgggtaaaccggg

SEQ ID NO: 67238 - DNA, 598 bp, Homo sapiens
  misc_feature: GYAE6OF02JJH0F.49.73.G07.1.454.CMB.1.raw
  modified_base (142)..(142): a, c, t, g, unknown or other
  misc_feature (142)..(142): n is a, c, g, or t
  modified_base (342)..(342): a, c, t, g, unknown or other
  misc_feature (342)..(342): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctcctcactctctgcacagactctgaggcctctatgagctgacacagccaccctcggtgtctgtgtcctcgagacagaccggcagtatcacctgctctggagatgacagttgaccaaagcaatatgtacttacgtcggtaccagacaggaacggccgggccacggccccgtggttgtggtgatgttaanaaagacagtagaggacggtccctcgagggactcccgtagacgcgtacttctcgtcggcctaccgaggtcgaagggaacgaacggtcgaactagttacggaccagtacgaggtacggacgtccgagggcgaaggtacggaacgacggtacgttaggactttaagttattacgtataacgtacaaacgacgaacctaaccgttatttaggtacctttagttacgttacgttacggaacttcggaccgtacgtaaccgg

SEQ ID NO: 67239 - DNA, 520 bp, Homo sapiens
  misc_feature: GYAE6OF02FI5Q9.49.73.G07.1.454.CMB.1.raw
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
  modified_base (463)..(463): a, c, t, g, unknown or other
  misc_feature (463)..(463): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacagccaccctggtgtctgtgtcctcaggacagacggccagtactcacctgctctggagatgcattgccaaagcaatatgcttactggtaccagcagacggccaggccacggcccctgtcgttggtgtatttagaaagtactttgagacggccctcgacgggacccctgagcgattctcgtggctccgagctcgaggacaacngtcaccttgacatcngtggacgtccgcagacggacgaggctgactattacgtgtcagtccgacngacagcgaggtcggctagttactcggtacgtcgttcgggagggaccggtctaaccgg

SEQ ID NO: 67240 - DNA, 703 bp, Homo sapiens
  misc_feature: GYAE6OF02GY18Y.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctctatgagctgacacagccacctggtgtctgtcgtcctcaggacagaccggcagtactcacctgctctcggagatcgcattgaccaaagcctaaagtactgtaccttacgtcggtaaccagcgaacgtaacggccgaacgggccctaacgggtccccccttgttacccgttaggaacttcgtaacttttaaagtaaacggttacgttttacggaggtaacggggtccctacggaccgggtacccctagacggtcgtatttccgtacgtcggtacctccgacgtccgtacgacggaccgaaactaacgtacgttaccgtacgttcgtaaccgtaacgttcgaaggtacgggtaccggttaccggggacagggtacggacggtacggtccgtaacggtacgtttaacgtaccgttacggtacgtacgtacgtaacttacgtaacggtaactacgggtacggttacgtaccgtaacgtttccgttacggttcggttaccggtttacggggaccggttaaccggg

SEQ ID NO: 67241 - DNA, 644 bp, Homo sapiens
  misc_feature: GYAE6OF02FH6A5.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtcgtcctcgaggacaggacggccagtactccacctgctcgtggagatgcattcgaccaaagacaatatgcttacgtcggtaccagtacaagacgccgaggccacggccctgtctgatctattataagtactttggagcgggtcctcggaccggtaccctgacgcgtacttccgtcgtcgggtccttaccgacgtcctcgacggtaccgaaaccgaactacggtccgtaacggttccgtaaccgtacttacgaacgggttcggggtaccggttaccggggacgtaacgggaacgggaccggtacgggtcgttaacggttaaccttaacgtttacggttcgtacacggtactaacgcggtaacgtacgtaggttaacggtcgtaccttacgttcgtaggttacggtcggttacggggacggtaaccggg

SEQ ID NO: 67242 - DNA, 667 bp, Homo sapiens
  misc_feature: GYAE6OF02I0KCR.49.73.G07.1.454.CMB.1.raw
  modified_base (167)..(167): a, c, t, g, unknown or other
  misc_feature (167)..(167): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
  modified_base (446)..(446): a, c, t, g, unknown or other
  misc_feature (446)..(446): n is a, c, g, or t
tcagagtcgagagacacgaccggtgctcgatttagctctacgctcagggcacgaccggtgctcgttttagagagagtgtgttggggtttgggggtgggtccaggaggcagaactctgggtgtctcaccatggcctggatccctctacttctccccctctcactctcngcacagactctgaggcctctatgagctgacacagcccacctcggtgtcctgtgtcctcgaggacctaggacggaccagttanccactgctctggagntgcattgacctaaagacaatatgcttacgtcggtacctagacgaacggaacnccgaacggccgacggcccccttgttccgtgtactataactttaagtaaacgtagtttagaggtacgggtcctacggaccggtaccctggtacgacgtaacttcgtacgtcggcctacctacggtcttacncggtaacgaaacctaacgtacggtactacggttcgaaccagtacgtacgtacggtaccgggttccggaggtaacgacggggtaccgaacggtcgtacgtaaccgtttaagttacgttagtacctagggtacctaatccgtaaagtaacgtaaggttacggtacggtaccttaccgttagttaccggttaccgttacgggttaccggacggggttaaccggg

SEQ ID NO: 67243 - DNA, 759 bp, Homo sapiens
  misc_feature: GYAE6OF02GZ9YF.49.73.G07.1.454.CMB.1.raw
  modified_base (143)..(143): a, c, t, g, unknown or other
  misc_feature (143)..(143): n is a, c, g, or t
  modified_base (219)..(219): a, c, t, g, unknown or other
  misc_feature (219)..(219): n is a, c, g, or t
  modified_base (591)..(591): a, c, t, g, unknown or other
  misc_feature (591)..(591): n is a, c, g, or t
  modified_base (611)..(611): a, c, t, g, unknown or other
  misc_feature (611)..(611): n is a, c, g, or t
tcagagtcgagagacacgaccggtgctcgatttagctctacgctcagggcacgaccggtgctcgtttagagagagtgtgttgggtttgggggtgggtccagggaggcagaactctgggtgtctcaccatggcctggatccctntacttctccccctctcactctctgcacagactctgacggcctcctatgagctagaccacgacgcccacccgtggtntctgtctcctgaggacaggtaccggctagtactcacctgactcgtggagtatcgctatacgaccaaagactaattagtcgtaccgttaacgtggtaaccccgaggaccgaaggtaaccggacccgtaacgggcccgtaccggtccccccgttaggttaccgttacgtaacttaccgttaaagtttttaaaacgtaaaacggttaccgttttagggaaacgggtaccggggtcccgtaaccggacccgggggttacccctagggtaacggtacgtaccgtttaccgtccgtccgggtaccctacccgtagtaccgtaccgacggtaccggtaaaccaaccgtacgtaccgtaaccgttacgaccacgttacgngggtacggacggtcccgggngtaacgggacgggacgtaggtaccgtgtaaccgtttacgttacgttacgtaccgttagtacccgagtaaccgaaggtaaccgttaggtacgttcggaactttccgtttacggtcgttacggtacgggttccgggacgggttaaccggg

SEQ ID NO: 67244 - DNA, 712 bp, Homo sapiens
  misc_feature: GYAE6OF02FMWSI.49.73.G07.1.454.CMB.1.raw
  modified_base (201)..(201): a, c, t, g, unknown or other
  misc_feature (201)..(201): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacggccctcctatgagctgacacncgcccacccgtggtgtctgtcgtcctcgaggacaggaccggcctaagtactccacctgctctggagatgctattcgaccaaagactaaatacgtcggtacctttacgtcggtaccagacgaaggaacgccgacggacccgtaccggtaccccttggttccttagtacttacttaaagtttaaacgtaaaggtcttttacggaacggtacgggtccctaccgaccggggtacccctaggcgtaccgtatttccgtacgtcggtcctacgacgtctaccgacggtacccgaaccgtaacgtaccggtaccgtaaccggttacgaaccttacgtacgtacgggtagggaccgggtaccgggacgagggacggacggtacgtcgtaagttaccttagttacgtgtaccgtaggttaccacgtacggtaacggtaacgttaacgggttacggtaccgttacgttaccgtttccggtacggttacggtttacgggtcccgggtaagggtaacccggg

SEQ ID NO: 67245 - DNA, 735 bp, Homo sapiens
  misc_feature: GYAE6OF02IF73L.49.73.G07.1.454.CMB.1.raw
  modified_base (279)..(279): a, c, t, g, unknown or other
  misc_feature (279)..(279): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcacctctctgcacagactctgaggccctcctatgagctagaccacacgccctacccgtggtgtctgtcgtcctacgaggacaggaccggcctaagtactccaccgtgctcgtggatacgngtactagttcgaaccgaaagacaaagttagtacggtactttaaccgttcggtaaccgacgacgtaacggaaccgacccgaacgggtccccgaaccgggtcccccgttgtttaccgtacgtaacttacgttaaattttaaacgtaaaacgttcgtttaagggaacgggtaccgggttacccgtaaccggaaccgggttacccctagggtaaccgtaccggtacgttttccgtacggtacggtccttccgacgtccctacgacgacgaaccaaacggtacgttaccggtacgttaccgaacctagtaccgtaacgggttcgtaccgggtcccgggaacgtaacgggacgggacgaacggtccgtaacgtaaccttacgtacgtcgtacgacgtacgactacggagacttagtacgcgttactacgttacgtcggttacggttacgcgggtacggacgg

SEQ ID NO: 67246 - DNA, 746 bp, Homo sapiens
  misc_feature: GYAE6OF02JJKTT.49.73.G07.1.454.CMB.1.raw
  modified_base (142)..(142): a, c, t, g, unknown or other
  misc_feature (142)..(142): n is a, c, g, or t
  modified_base (295)..(295): a, c, t, g, unknown or other
  misc_feature (295)..(295): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttcctccccctcctcactctctgcacagacctctgaggcctcctatgagctgacacacgcccacccgtggtgtctgtcgtccctcgaggacaacggccggcctaagtactccacctgcctcgtggagatgcattcgaccaaagtcaaatntcgtaccttacgtcggtaccagaccgaaggaacgccgacggcctaccggccccgttgtacttggacttacttaatttaaacgtaaacgttacgtttaggaacggtaaccggggtccctaccgggaaccgggtacccctagggtaaccgtacgttacttccgttcgtccgggttaccctaccggtacgtccttaaccggaacggaccgtaaccgaaacgtacggtaccgtaaccgttcgaaacctacgtacgtagggtccggtacggtacccgggagaacgggtacgggacggtacggtacttaacgtcgtttaaaccgttggtaaccgttacgaaccgttaccgttaagtaccggtaacggttaacgtacgggttaggtaccggttactttacccgtttacggttaccggttaacgggtttaccggttacgggggaaacccggtaaccggg

SEQ ID NO: 67247 - DNA, 742 bp, Homo sapiens
  misc_feature: GYAE6OF02JPH57.49.73.G07.1.454.CMB.1.raw
  modified_base (142)..(142): a, c, t, g, unknown or other
  misc_feature (142)..(142): n is a, c, g, or t
  modified_base (191)..(191): a, c, t, g, unknown or other
  misc_feature (191)..(191): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctcccctcctcactctctgcacagactctgacggcctcctatgngcttgacacacgcccacccgtcggtgtctgtctacgtcaggacagacggcctaagtatcaccttgccgttcaggtggaatcggctaattcggaccaaaagtctaaagtactcgttacttacggtccggtaacacgtacggaaacggtaaccgaccgaccggaccgaccgtcccgttcgttacgtacgtactacttaacgtttaagttaacgttaacgttacggtacggtacggtaccggtaccggtaacccggtacccgtacgtaccggtacggttaccgttcgttacggtcgtaccgtaccgtaccgtaccgtaccgacggaaccgtaaccgtaaaccgtacggtaccgtaccggttaaccgtaaccgtaacgtacggtacgggtacgggtaccgggtaccgggaccggtacgggacgggaacgggacggtacgtacgtaacgttacgttacgttcgtacgtacgtacgtacgtaacgtacgtacggtaacgtacggtacgtacgttaccgttaccggttacggttacggttaccggtaccgggtacggg

SEQ ID NO: 67248 - DNA, 202 bp, Homo sapiens
  misc_feature: GYAE6OF02H4LF4.49.73.G07.1.454.CMB.1.raw
  modified_base (191)..(202): a, c, t, g, unknown or other
  misc_feature (191)..(202): n is a, c, g, or t
tcagagtcgagagacacgaccggtgctcgatttagctctacgctcagggcacgaccggtgctcgatttagctctacgctcagggcacgaccggtgctcgatttagtcacgcgagaaaggaagggctggccctgacgtgtttctgttcccacctctctctctcgactctgagcggctggcaaggcgcatagnnnnnnnnnnnn

SEQ ID NO: 67249 - DNA, 705 bp, Homo sapiens
  misc_feature: GYAE6OF02I4HNE.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccaccctcggtgtctgtgtccctcaggacaggaccggccagtatccaacctgctctggagatgcattgccaaagcaatatgcttactggtaccagcagaagccaggccacggcccctgtcttgatctatttaataaagtactttaggagacgggcctacgacgggacccctggacgccgtattcctcgtcgggtcctccgacgtccttcacggtaccaacaaccacgttaccgacggttacggaaccctagttacccgaaggttcgggaaccgggtacccggggacggaacggaacggggtaaccgggacgggtaccgttacgggtaaacctttaacggtttaaccgttacggttaaccgtaacggttacctaaccgttacggtaaaccggtaaaccgtaacggggttacgggttaccgggaccgtttaacccggttttacccggtttcgggtttaccgggtttacggttttaccggggggaaccggggttaaacccgggggg

SEQ ID NO: 67250 - DNA, 592 bp, Homo sapiens
  misc_feature: GYAE6OF02GCH25.49.73.G07.1.454.CMB.1.raw
  modified_base (141)..(141): a, c, t, g, unknown or other
  misc_feature (141)..(141): n is a, c, g, or t
  modified_base (148)..(148): a, c, t, g, unknown or other
  misc_feature (148)..(148): n is a, c, g, or t
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatggcctggatccctntacttcncccctctcactctctgcacagactctgacggcctctatgagctgacacagcccaccgtcggtgtctgtcgtcctgaggcaggcgcagtactcacctgctctggagtntgctattcgacaaagctaatntgcttacgnggtaccaagagaacgcacggccacggcccgtgtctgtatctatttaagtaacgtcttaggagacgggtcctacgacggtaccgtgacgcgtacttctacgtgtccgtccgactcgtctacgaccgtacaacgtacgtacgtacgtactaccgtactaccgtaggtacggtacggtccgggtacgacgggtaggacggaggtcgtagtactaacgttacgtcgtcgacgtccgtactacgcgagacgtcggtacggtacgtacgtttacgtggttaccggtacggtaccgggtacggtaggtaaccgg

SEQ ID NO: 67251 - DNA, 795 bp, Homo sapiens
  misc_feature: GYAE6OF02HSK9P.49.73.G07.1.454.CMB.1.raw
  modified_base (142)..(142): a, c, t, g, unknown or other
  misc_feature (142)..(142): n is a, c, g, or t
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctcatgatcngacacacgccacctggntctgtntcctnagtacagaccggacagtactcacctnctactaggactagnctaatcgaacaaagtnaagtagtctactacgtacggaccagcgaagacgtccgaagcctacggccccttgtcctagtactataagttttaaaacaacgttacgtttacgggaacggtacggtttaccccgtaaccggaaaccgggaacccccgtttaagggaacgtacccggttactttaacccgggtcgtttacccggaaccggttaccctaacgggttaacccctacccggtaaacgggtacccctaaaacgaaaaaccggttccggttaacccggtaaacggtttaaacccggaacttaaacccgtaggtaaacccgggtagggtaaccggggtaaccccgggagtaaacgggaagggttaaccgggtacggtacgtaaccgttaaccgttaagttaacgttaacgttaccggaaccggttcctaaatacccggttaaaggaacccggttaaggtaccggtacgtccgttaaaacccgttttcggtaggtttaaccccggtttaaagggtcccgggggtaggtaaaacccggg

SEQ ID NO: 67252 - DNA, 755 bp, Homo sapiens
  misc_feature: GYAE6OF02I84A3.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctagtgagctgacacagcccacccgtcggtgtctgtctcctcgaggacagaccggccagtactcacctgctctaggagagtcgctagttcgaccaaaggcaattagtcgtactttacgtcggttaaccagaccaaggaacgccgtacgggacccgaccgggcccccgtttgtccgtttagaactttcgtaaactttttaacgtaaaacgttaccgtttttaagggaacgggtaaccggggtaccccggttaccgggggtaacccccggtaccggaacgtaccggttaccgtttaccgtttccgttacgggtacctaccccgtaacgcccggtttaccgacggtacccgaccgaaacgtacgtaccgtaccggttacgtaaccgaaccttacgcggttacgggacgggtaccgggtaccggacgggaaacggaccgggtaggaccgttacgtaaccgttactttacgttacgttcgtaccggttacacgttacgacgtaacggaacgttacggtacgtcgttaccttcgttacggttaccgtacggtttcgggaccggtacgggtaacccgg

SEQ ID NO: 67253 - DNA, 752 bp, Homo sapiens
  misc_feature: GYAE6OF02JUXHS.49.73.G07.1.454.CMB.1.raw
  modified_base (119)..(119): a, c, t, g, unknown or other
  misc_feature (119)..(119): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttcctccccctctcactctctgcacagactctgacggcctcctatgacgctgaccacacgccctacccgtcggtgtcctgtcgtcctcgaggcaggaccgcagtactcgacctgcctcgtgganacgtancgtattacggaccaaagcctaagtactcgtacgtttaccggtacgtaaccacgacgacggaacgacccgacggtacccgaccggtacccccgtttgttccgttagtaactaccgtttaaagtttaaacgttaaacggtacgttttacgggaacggttacgggtacccgttacggaaccgggtaccccgtagtacgtaccgtatttaccgttcgttcggtccttaccgacgtccgttcgaacggaccgaaaccgtaaacgtacgttaaccctaaccgttaccgaccgtacgttaccggtacgggttacggacccgggtaccgggaccggtaacgggaacggacccggtaacggggtccttaccgggttaaccttacgtttacgaccgttaacgtcgtacttacgaccggtaacgacggttaaggtaacggtccgtaacttcgttaccgtggttacgtacgggttacgggacgtaacgg

SEQ ID NO: 67254 - DNA, 775 bp, Homo sapiens
  misc_feature: GYAE6OF02I9FPL.49.73.G07.1.454.CMB.1.raw
  modified_base (682)..(682): a, c, t, g, unknown or other
  misc_feature (682)..(682): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacggcctcctatgagctgacacacgcccaccctcggtgtcagtcgtccccaggaccaggaccggccgaggactccacctgctcgtggagatggctattcgaccaaaaccggattagtcgtctttagttcggtacccagtcaacggaacggcccgggaccacggcccccgttggtttagggttcggtaggtacgttaggttaaacttaaaacggaccgtaacgttacgggacggtaccgggtccccttacggaacggggtactttccccggtaggtaaccgggtaccgttaacgtttccgttccggtcgggtacccgttacccggtaacgggtaccggtaaaggggaaacccgtaaccgggttaccgaacgttacggtttaccgggacccttaagtacggttaacggttaccgggtagtacccgaggggtaccgtaagggaaccgggtacggaccgggtcgtaacgtaccgttaagtttagttacggtactaaacgttacgaaacncgaaccgtaccgttaagtttacggttaacttacgttacgtttaccgttacggtaacttcgggaccgaaccgttaacgggtcccgtaaccccgg

SEQ ID NO: 67255 - DNA, 724 bp, Homo sapiens
  misc_feature: GYAE6OF02F84AL.49.73.G07.1.454.CMB.1.raw
tcagagtcgagagacacgaccggtgctcgatttagctctacgctcagggtcgacgaccggtgcctcgtttagagagagtgtgttgggttgggggtgggtccaggagggccagaactctgggtgtcgtcaccatggcctggatcccgtctaccttctccccctctcactctctgccacagactctgacgcctcctatgagtctgactacagtcccacccgtcggtgtctcgtcgtacctcgaaggtacgacggaccggcctaagtacgtccaccttgctcgtaggtactatcgctagttcgaaccaaaggactaaacgtgtcgtactttacgtcggtaccagtaccaaggtacgaccgacggtacccgacggtccccttagttacttaggtaccttaccgttaaaagttttaacgtaaaccgttcggtttaaggacgggtaccgggtcccttaacgggaaccgggtacccctaggaacctacggttacgtttccgtacgtcggtaccttaccgacgtcctaacgaggtaaccaaacgtcgtaacgtaccgtacacctagtcgtaaggtacggtacgtccggtagaaggtacgtacgtacggtctaacggtacttaagttacctgtaccgtacgtactacgtacacggtaacggtaacggttacggtacgtaaccgttcgtttacgtacggttacgttaccggtacgggaccggtacgtaacccgg

SEQ ID NO: 67256 - DNA, 716 bp, Homo sapiens
  misc_feature: GYAE6OF02GDTJP.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctcctcactctctgcacagactctgaggcctcctatgagctgacacagcccacccgtcggtgtctgtcgtcctacgaggtaccaggaccggccaaggttactccaccgtgtctcgtggagatgctattcgaccaaagacaatagtgtcttaacgtcggtaccagcgagaacgccgtacggccgacggtacccctgttaccttagtacttactagttttaacgtaaacgtacgttttaggacggaccggtccgtacggaaccgggtacccgtaggacgtcgttactttccgttcggtccggttccctaccgtacgtaccgtacgaccggacgaaaccgtaaacgtacgtaccctaccgggttaaccgaacgtacgtaccgtaacgggttacgggtaccgggttacccggggaacgaacggaacgggtaccgggacggtacgttacggtaacctttacgttacgacgttacgacgttaccgacgtaaccgaaggtaccgtaggttacgtcggtactttacggttacgttcggttaccggttacggttaccgggcgggtaaccggg

SEQ ID NO: 67257 - DNA, 902 bp, Homo sapiens
  misc_feature: GYAE6OF02HNMPW.49.73.G07.1.454.CMB.1.raw
  modified_base (310)..(310): a, c, t, g, unknown or other
  misc_feature (310)..(310): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgcacagactctggacggcctcctatgagctgacacacgcccacccgtcggtgtcttgtcgtccctcgaaggacacggaccggccaagtatccaccgtggccttcgtaggagtagtcgctaagttcgaaccgaaaagactaaatntacgtccgtttaacgtacggtaccaggacgaacggaacgccgaacggcccgtaccggtccccgttgttcttagtacttacgtaaattttaagtaaaacgttacgtttagggaacggtaccgggtaccctaaccggtaacccggggtaccccctaggtaaccggtaccgtttaccgttaccgtttccggtacggtcccgtacccgtacgttcccgtaaccgtaaccggacccgtaaaaccctaaaccggtaaccgttacccgtaaaccgggtttaacccggtaaaccgttaacggttaacccggtaacgggggttaccggggttaaccggggttaaccccgggggtaacggaaccgggggtaaaccggggtaaccgggggtaaaccggggttaaccgttaaccgggttaaacttttaaccgtttaaaccgttaccggttaccgtaaccggtttaaccgttacggttaaaccggtaaacggtaacggttaaaccgggtaacgggtttacccgtaaccgtttacccggttttagttacccggggtttaaccgggtttaccggggttaccgggggtaacccggggtaaacccgggg

SEQ ID NO: 67258 - DNA, 612 bp, Homo sapiens
  misc_feature: GYAE6OF02HD3EY.49.73.G07.1.454.CMB.1.raw
  modified_base (119)..(119): a, c, t, g, unknown or other
  misc_feature (119)..(119): n is a, c, g, or t
  modified_base (363)..(363): a, c, t, g, unknown or other
  misc_feature (363)..(363): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttcctccccctcctcactctctgcacagactctgacggcctcctaatgagctgacacagcccacccgtcggtgtctgtcgtccctcgaggacaggaccggccagtactccacctgctcgtggagatcgactattcgaccaaagactaatatcgtcttacgtcggtaaccagcaaggaacgccgacggccacggtccctgtcgtgtatactaatttaanaaagttacttaggaggtacgggacctacggaccgggtacccctggacgtccgttactttccgtcgtcggtacctcccgtagtcctacgacgtaccgaacaacgtacgtaccgtacggtacaaccctattcgaggtcgggaccggtccggacgagggacggacgaggctagtacttacgtactgtacacgtcatacgaagtacgtaggtagcggtactacttgtcgtacgttacggtacggacggtacgg

SEQ ID NO: 67259 - DNA, 648 bp, Homo sapiens
  misc_feature: GYAE6OF02JL2LF.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctctgcacagactctgaggcctcctatgagctcgacacacgcccaccctcggtgtctgtgtcctcaggacacggccgccagtactcacctgctcgtggagatcgctatgaccaagactaatatcgtacttacgtcggtaccacgtactaggaacgccgaacggccaccgggtccccgtgttccgtgtacgtactaatttaaagtaagttacgttttaggacggtaaccgggtcccgtaacggtaccggggtacccccgttagggacggaccggttaactttccggttaccgttcggtacccgttacccgacgtcccgtacgacgaccgtaaaccaacgtacgtaccgtacgttaccgactacgtacgtacggtcggtacggtccggacgtaggacggacggacgtacgtcgtacttacgtactacgtactagtcagtacgagacgtagtcgagtctacgttcgtcgttagtacggtcggacgtacgg

SEQ ID NO: 67260 - DNA, 788 bp, Homo sapiens
  misc_feature: GYAE6OF02JHCOL.49.73.G07.1.454.CMB.1.raw
  modified_base (141)..(141): a, c, t, g, unknown or other
  misc_feature (141)..(141): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatggcctggatccctntacttctccccctctcactctctgcacagactctgaggcctcctatgacgtctgaccacgacgcccgaccgttcggtgttcctgtcgtccctacgaggaccaggacgccaagtctacaccgtgctcgtaggacgagttcgctagttcggacccaaagctaagtacgttcgtacttacggttacggacccagtaccgaacggaaccgaccggaacgggacccgtaccggtccccgtaggtttaccgtacggtaacttacttaaacgtttaaacgttaaaacgtaccgttttaaggaccgggtaaccgggtacccgtaaccgggtaaccgggtacccctaggtacccgttacggtacgtttccggtacggtcggtacccgtcgtaaccggtctaacccggtacggtacctaaaccggaaacttaccgggtaccgttaccggttaccggtaaccacggttaccgttagggtaaccgggttgggaacccggggttagaaaccgggtagggtaaccggacgggtaccgttacggtaacgttcgttaacgtaccgttagaccgttacgtacgtacgtaacggtaacggtaggtacggttaccgtactaccggtttcgtacggttacggtaacggttccgggacgggtaaccgg

SEQ ID NO: 67261 - DNA, 735 bp, Homo sapiens
  misc_feature: GYAE6OF02FL6EI.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccacccgtcggtgtctgttcgtcctcaggacaggaccggccagtatccacgtgctcgtggagatgacgtattcgaccaaaagcaaattagtcgtactttaaccgtcggtaacccaagtacaacggaacgaccggtacggacccgaaccgggtcccccgttgttccgtttacgtaacttaccttaaagttttaaagtaaaaagttccgttttaagggtacggtaccggggtcccgtaccggtaaacccggggtacccccgttaggaacgggtccggttaagtttccctcggttacccggtcgttacccgacggtccttaccgacggtaccgaaaccgaaaccgtacggttacgtaccgttacgaccgtactacgtaggtcggtaccggtaccgggcgaggaacgggaccggtagtaacgtagtaacgtttacgttacgtacgtcaacgttacacgtacgtaacgtaacgtaggttaacggcgtaccgttctttcggttaggttcgtttacggttacggggaccggtaaccgggg

SEQ ID NO: 67262 - DNA, 807 bp, Homo sapiens
  misc_feature: GYAE6OF02IG10V.49.73.G07.1.454.CMB.1.raw
  modified_base (120)..(120): a, c, t, g, unknown or other
  misc_feature (120)..(120): n is a, c, g, or t
tcagagtcgagagacacgaccggtgctcgatttagctctacgctcagggcacgaccggtgctcgtttagagagagtgtgttggggtttgggggtgggtccaggaggcagaactctgggtntctcaccatggcctggatccctctacttcctccccctctcaccttctctgaccacagactcgtgacggcctctatgagctgacacgacgccctacccgtcggttgtctggtcgtccctacgaggaaccaggaccggacctaagttactccgtaaccctgtccttacggtacggaaggtactagtactagttacgaaccaaacgtactaaagttagttacgtactttacggtaccggtaacacgacgaaggaccgaccgacgtacccgaccggtccccgtgttcgttacgtaacgttacgttaatttaaagttaaacgttacgttttaggaacggtacggaccgttaaccgggtaaccgggtaccccgtaggaccggtacgtacgttttaccgtcgttacgtacccgttccgtaaccggtacccgtacggtaaaccggaccgtaaaaccgtaacccgtaacggtacccgttaaccgtaccgtaacgttaaccgtacggtacgggttacggggtacgggtaacccgggtacggtaaggaacgggtaccggaacggttaccgtaacgtaaccgtttaaacgttaccgttacgtaccgtaagtactacgtaacgtaagaaccgttaggtaacgttacgtacgttaccgttacggttacggttaacgttacggttaccggacgggtaaccgg

SEQ ID NO: 67263 - DNA, 171 bp, Homo sapiens
  misc_feature: GYAE6OF02I7CZS.49.73.G07.1.454.CMB.1.raw
  modified_base (112)..(112): a, c, t, g, unknown or other
  misc_feature (112)..(112): n is a, c, g, or t
  modified_base (161)..(171): a, c, t, g, unknown or other
  misc_feature (161)..(171): n is a, c, g, or t
tcagagtcgagagacacgaccggtgctcgatttagctctacgctcgagggcacgaccggtgctcgatttagtcacgcgagaaagggaagggggctggccctgacgtgtttcngttcccgcctctctctctcgactctgagcgggctggcaaggcgcatagnnnnnnnnnnn

SEQ ID NO: 67264 - DNA, 783 bp, Homo sapiens
  misc_feature: GYAE6OF02G66J0.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttcctccccctctcactctctgcacagactctgacgcctcctatgagctagacacagcccacccgttcggtgtctggtacgttcctcgagggacacggtaccggacctagtactccaccgtggtctcggtaggagtactcgactagttcgacctaaagactaaattacgttagttaccttaacgttacgggtaaccaaggacgaaggaaccgtccgaacgggcccggtaacccggtccccgttgttacgttacggtaacttaccgttaaacttttaagttaaaaaccgttcgtttaagggaaccgggtacgggtaccccgtttaacggaacccgggggttaaccccttacgggaacggtaccgttaacggttttcccgtcggttaccggtaccgtcccgtacgtaccgttaccgacggtacgaaaccgaacgtacgtaccgtaacggttacgaaacctagtacgtagggtacggtaccggtccggaacgacgggaaggaacggtcggaacgtacggtaaccttaacgtacgttacgtacgtagtaccgaagttccgaaacggtacgtaaggttaacgacggttaccttacggtttacgttggtttaccggttaacgggtccggtaacgggtaaccggg

SEQ ID NO: 67265 - DNA, 701 bp, Homo sapiens
  misc_feature: GYAE6OF02GJXVH.49.73.G07.1.454.CMB.1.raw
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (496)..(496): a, c, t, g, unknown or other
  misc_feature (496)..(496): n is a, c, g, or t
tcagagtcgagagacacgaccggtgctcgatttagctctacgctcagggcacgaccggtgctcgtttagagagagtgtgttgggtttgggggtgggtccaggaggcaggaactctgggtgtctcaccatggcctggatccctctacttcctccccctcctcactctctgcacagactcgtgacggcctcctagtgagctgacacacgccctacccgtggtgtccgtgtacgtccctagaggacacggaccggcctagtactccacctgcctcgngganagtgactattacggaaccctaaaagctaattacgtcgtacctttacgtaccggtaaccgagaccgaagaaccgccggacggacccgaccggtcccccttgttaccgttagtacttaccttaaatttaacgtaaaacgttacgttttaggaacggtacgggtaccgtaccggaaccgggtacccctaggacgtcgtacgttccgtcgtcggcctaccgngtccgacgacgacaactacgtacgtaccgtacgtacgacctagtacgtaggtacgggtcggtaccgggagacgggaacggacggacggtaccgtagttaccgttacgttacgtacgtactacgttacacgttacgacggtaacgtaaggtcgttacgtcttaccgttgttaccggttcggtacgggttaccgggacggtaaccgg

SEQ ID NO: 67266 - DNA, 697 bp, Homo sapiens
  misc_feature: GYAE6OF02HA0ZZ.49.73.G07.1.454.CMB.1.raw
  modified_base (221)..(221): a, c, t, g, unknown or other
  misc_feature (221)..(221): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacggcctcctagtgagctgacacagcccacccgtggtgtctgtntcctcgaggacacggaccggcctagtatccacctgctcgngganatgactatgaccaaagtcaatatagtcttacgtacgtaacagacaacggacgccgacggcccgacggtcccctgttccgttagtaacttacttaatttaaagtaaaacgttagtttacggaggtacccggggtcctaccgggaacccgggtaccccgtagggtacggtaccgttacgtttccgtacggtaccggcccgtaccgtacggtccgtacgaacggtacccgtaaaaccgaaccgtaacggttacccgtaccggttaccaccgaacgttacgtagggtacggggtaccgggtccgggaacgaacggggaaccgggacggtaacggtcgtaacgtaacgttaacgtttacgtacgtacgacgtactacgacgaagaacgttaggtagtcgttatcgttcgtggttacgtggttaccgggagaaccggg

SEQ ID NO: 67267 - DNA, 764 bp, Homo sapiens
  misc_feature: GYAE6OF02IKNGA.49.73.G07.1.454.CMB.1.raw
  modified_base (119)..(119): a, c, t, g, unknown or other
  misc_feature (119)..(119): n is a, c, g, or t
  modified_base (142)..(142): a, c, t, g, unknown or other
  misc_feature (142)..(142): n is a, c, g, or t
  modified_base (177)..(177): a, c, t, g, unknown or other
  misc_feature (177)..(177): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctntacttctcccccctctcactctctgcacagacctntgacgcctcctatcgagctgacacacgcccaccctggtntctggtcgtccctagagacaggaccgtcagtacncacctgctctggagatcgctagtcgaccgaaanactaatactgtaccttacgtcggtaaccgagtacgaagaacggaccgacggtccgaccggtaccccgttgttacttacgattacgtaatttaacgtaaacgtaacgttttagaacgggtaccggacccgttacggtaacccgggtaaccccgtaggtaaccgttccgtaacgttttccgtccggttacgggtcccttccgaacgttccgtaacgaccgaaccggaaacctaaacgtacggtacccgtaacggtttacgaacccttaacgttacggtacgggtaacggggtacccggtaaccggggacgtaacgggtaacggggtaaccggtacgggtccgttaaccggttaacttttaaccggttacgttacgttacggtactaccgttacgtaacggaacgtacgtaacggttacgtaccggttaccttacgttccggtttacggttaccggttaacggggtccggtacggggaaaccgg

SEQ ID NO: 67268 - DNA, 700 bp, Homo sapiens
  misc_feature: GYAE6OF02GB068.49.73.G07.1.454.CMB.1.raw
  modified_base (142)..(142): a, c, t, g, unknown or other
  misc_feature (142)..(142): n is a, c, g, or t
  modified_base (253)..(253): a, c, t, g, unknown or other
  misc_feature (253)..(253): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgacacagactctgacgcctcctatgagctgacacacgccaccgtcggtgtcctaggtctcctacgaggacacggtaccggcagttacnccgacttggctcgtggagatgactattacgaccaaagacaagttactgtacttacgtacggtaaccaggtacaacggaacgaccgacggcccgacggtccctgttacgttagtaactactaagtttaaagtaaacgttacgtttaggaacggtacgggtacccttaccggaccgggtaccccgtaggtacgtaccgttagtttaccgtcgttcgggtacctaaccgtcgtacttaccgaacggaccgtaaaccaaacggtaccgttaacggtaccgttacgaaccgtactacgtaggtacgggtaccggtacgggaaggaacgggaggaacgggtacgcgtaagtacctttaagtacgtttacgcgttaagtctacgtacggaagtaccgtaggtacggtcgtacttacgttcgttcgttacgttacggttacgggaccgtaacggg

SEQ ID NO: 67269 - DNA, 774 bp, Homo sapiens
  misc_feature: GYAE6OF02I6C3N.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctggacggcctctatgagctgaccacagccctaccgtcggtgtctgtcgtcctcgaggaccaggaccggcctagtactccaccgtgaccttcgtaggacgtagtacgtcgtacttcgaaccgtaaaggacctaaatacgttcgtacctttaacgtacggtaaccaggaccaaggaaccgaccggaccggcccgaaccgggtccccttgttcgttacggtacttacttaattttaaacgaacgttcgttttaggacggtaccgggcctaccgggtaaccgggtaccccgtagtacggtaccgttacgtttccgtcgttcggtaccctaccgtacgtacttaccgaacggtacccgaacgaacgtacggttacctaccgttacgaaccgtcttacggtacggtacgggtaccggtacccgggacggtaaggaacgggtaaccgggtaggtaccgttaacgtaaccgttttaacgttaccggttacgttaccgtaccgttacaacgttaccggaaaggtaaccggttaaggttacgggtaccgtaccgtttaccggtttcggttaccggttaccggtacggggtaccggtaccgggaaccggg

SEQ ID NO: 67270 - DNA, 828 bp, Homo sapiens
  misc_feature: GYAE6OF02JU967.49.73.G07.1.454.CMB.1.raw
  modified_base (216)..(216): a, c, t, g, unknown or other
  misc_feature (216)..(216): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctctcactctctgcacagacctctgacgcctcctatgagctgacacgacgcccaccgtcggtntcgttgtcgtcctcgaggaccgagaccggacctagttacgtccacctgaccttcggtacggtaagtacgtcgtacttaagtttacgaacccgtaaaaggtacctaaattacgttacgttaccgttaccgtaccggtaaccacgacgaacggaacgacccgtaacggcccgtaaccggttccccgttaggttaccttacgttacctaaacgtttaagtttaaaccgtttaaacgttacgttttaacggacgggttaacggttaccccgaccgggtaaccggtaccgtacggtacgacgttaccttccgttaccgtcggtccctaccgcgttacccgtcgtaaccgcgaaaacctaacgtacggtacccgtaaccgtaaccgtacgttaaccgtacggtaaccggggttaacgtacggggtcccgggaacggttaccggggaaaccgggtaaggtacgtacggttaaccgttaacgtttacgtaaccggttacgttacgtaccgttacgtcggtaacgtaacgtaacggttacggtacggttaggttaacccgttacgtttcggttaaccggttccgggttaccgggttacccggggtacggggttaaacccgg

SEQ ID NO: 67271 - DNA, 643 bp, Homo sapiens
  misc_feature: GYAE6OF02I836R.49.73.G07.1.454.CMB.1.raw
  modified_base (141)..(141): a, c, t, g, unknown or other
  misc_feature (141)..(141): n is a, c, g, or t
tcagagtcgagagacacgaccggtgctcgatttagctctacgctcagggcacgaccggtgctcgtttagagagagtgtgttgggttgggggtgggtccaggaggcagaactctgggtgtctcaccatggcctggatccctntacttcctccccctctcactctctgcacagactctgacggcctcctatgagctgacacacgccctaccctggtgtctgtcgtcctcgaggacaggaccggcagtactccactgccttcgtggagatgacctattcgaccaaagactaatatcgtacttacgtcggtaaccaggacgaagaacgaccgacggccgaccggtcccttgttcttagattcgtaaatttaacaaagtacgtttaggacgtacgggtcccacggaacgggtacccctaggacgcgttacttccggcgttccggtacctccgacgtccgtaccgacgaccgaactaacgtcgtacgtaccgtcacgtatcgtaggtcggtacggtccgggaagaggacggtacggacgtcgttacgtaacgttactacggtactacgtatcgaagtaccgaaggtacgaggttacggtgtaccgttacttcggtactttacgggtcttaccgggggtaggtaaccggg

SEQ ID NO: 67272 - DNA, 923 bp, Homo sapiens
  misc_feature: GYAE6OF02JCAXJ.49.73.G07.1.454.CMB.1.raw
  modified_base (259)..(259): a, c, t, g, unknown or other
  misc_feature (259)..(259): n is a, c, g, or t
tcagagtcgagagacacgaccggtgctcgattttagctctacgctcagggcacggtaccggtcgctccgttttaggagtacgaggtgtgtttcgggttgggggtgggtccaggaggcagaactcgtagggtgtctcaccatcggcctggattcccgtcttactttcctcccccttcgttctacttcctctcgacgtaacgtagaccttcgtcggtacggttcccttctagtggtacgtcggtcggaaccggtaacgggngtaccccgtaccgggttccgggggtcgggtttctacgggttcgtacccgttccggaaacgggtaccgtacgggacccggtaccgtaacggttaacctaccgtaaccgttcgccctttacggtacgggtaacggtttctccgtaccttaacgtccggaaccgtaaacggctaagttcgtcggtaccgtttacggcgtacgacgtacggtacgacgtaccggactccgaccgttcccgttggttcgtacgtattcgttaaagttacgtaacgttcgttaagggacggtccgggtccttacgggaccggtccgtagccggtacttagtccgtcgtacgtccgtagaccgtagtaccaaccggaacctaaccgtacgttaccgttaacccgtaacgtttaccgacgtaacggttacggtaaacggggttaccggggtaccggtaaccggggcgaacgggggtaaaccgggtaccgggtacggtacgttaaccggtttaaatttacccggttaaaggttacgttaccgggtaactaacggtacccgtttaaccggtaaaaacgttcggttaaaccggggttccgttacggtttaccggtttaccgggttcgggttttaccggggccctttttaacgggggacccggggggtttaaccccgggaaccggg

SEQ ID NO: 67273 - DNA, 788 bp, Homo sapiens
  misc_feature: GYAE6OF02H82Q4.49.73.G07.1.454.CMB.1.raw
tcagagtcgagagacacgaccggtgctcgatttagctctacgctcagggcacgaccggtgctcgatttagtaaagatcgttagggaaaggggaaaggcctgaggaaaacaaaccccagctgggaagcctgagaacacgtagccttcatgagtgtccccaccatggcctggatgatgcttctcctcggactccttgcttatggatcaggtgtggaatctacagactgtggtcgacccaggagccatcgttgtcaggtcgggtcccggggggacagtcacactcacttgtggcttgacgctcgtgctcaacgtcttaccaacgttacggttacctaaccccgtacgactcggtaaccgacgtcaaccgacccccgacggacccgaacggacccgttacccgaaccggtcccgaaacccggactaccgtaacgttaccggttaaacgtaaacgttaaaacaaaaaacgtttacgtaaccgttcctttacgtttcgggttaccggggtttccccgtaggaccttccgtaccgtttctccgttacgggtcccttacccaacgttttcccgggttaaggggaaaccgaaaacgttccctaccggtaccctaccccgtaaccgtaaccgtacccgggaaacccgggggcccgaaaccggtacggtaacggtaacgttacggtaacgtacggttaaacgttcggttaacggttaagtttaacgtttaccggttagtttcgggttacgtacggtttacggttaacggtttcgggtttaggggttccgggtttacggg

SEQ ID NO: 67274 - DNA, 984 bp, Homo sapiens
  misc_feature: GYAE6OF02IF4BZ.49.73.G07.1.454.CMB.1.raw
tcagagtcgagagacacgaccggtgctcgatttagctctacgctcagggcacgaccggtgctcgtttagagagaatgtgttgggtttgggggtgggtccaggaggcagaactctgggtgtctcaccatggcctggatccctctacttcctcccctctcactctctgcacagactctgacggcctcctatgagctagacacacgccctacccgttcggtctcgttgtcgttcctacgaggaacacgggaccggccaagttactacccgaccgtcgtaccgttcggtacgggaagtacgtcgaccttaacgttacggaaccctaaaacgtacgtaaaacgttacgtacggttaccgttttaacggtaaccgggtaacccaaggtaacgaaaggaaccggaccccggaaccgggtaccccgtacccgggttcccccgtttagtttacccgttaggtaacctttaacgttaaacttttaaaaacgttaaaacggtttaacggtttaacgggtacgggtaaccgggtccccgttaaccggggaaaccccggggttacccgttaagggaaccggttaccggtttaactttaccggttcggttaccgggtacccgttaccggaccgtaccgttaaccgggaaccggttaacccggaaaacgttaaacccggttacggttaccccgttaacggtttaacccgtaaaccgtaccgttaccggggttaaggggttaaccggggtaacccggggttacccggggaacggtaacgggggtaaccggggttaaaccgggtaccggggtaaccgtttaacgggttaaacccgtttttaattaccggggttgttaaaccgtaccggtaccttaacggtaacccggaaacggtttaccgggtaacgggttaaccggttacggtaaccccgttttcggttttacggtttaccggttaacggggttttacccgggtacccggggttacggggttaaaccggg

SEQ ID NO: 67275 - DNA, 699 bp, Homo sapiens
  misc_feature: GYAE6OF02JZX8Z.49.73.G07.1.454.CMB.1.raw
  modified_base (120)..(120): a, c, t, g, unknown or other
  misc_feature (120)..(120): n is a, c, g, or t
  modified_base (205)..(205): a, c, t, g, unknown or other
  misc_feature (205)..(205): n is a, c, g, or t
tcagagtcgagagacacgaccggtgctcgatttagctctacgctcagggcacgaccggtgctcgtttagagagagtgtgttggttttgggggtgggtccaggaggcagaactctggggtntctcacagtggcctaggactccctctacttcctcccctctcactctctgcacactctcgtcgacgtcctacctagtgacgtaccncgacgcccaaccgtcggtaccttcgtgtctcttcaggacagacggccaggtactcacctgctctgtagatgctacgttacgctaaaacggcctaaatacgttagtacgttacgttaacggtacccgacggacgtaacgaaggtaaccgccggggtacccctagggtcccccgttgggttacgttaggtacggtaacttaggtaaaccgttaaacgaaccgtacggtaccgtacggaccgggtaccctaccgggtaaggtaccgtccggtaacgtccggtacttacggtcttacggcgtccgtaaggcccggttacgacgggtacctacgtcgtacggctagtaccgacgtacggtacgttacggacggtcaggacgtaacggacgtacgagtactagtacttagttactactacaacgtacgacacgtacacgttaccgtacttacggtactccggtaccgttacgaaccgtccaaccggtcctacgggtaccc

SEQ ID NO: 67276 - DNA, 793 bp, Homo sapiens
  misc_feature: GYAE6OF02JZNH9.49.73.G07.1.454.CMB.1.raw
  modified_base (189)..(189): a, c, t, g, unknown or other
  misc_feature (189)..(189): n is a, c, g, or t
  modified_base (258)..(258): a, c, t, g, unknown or other
  misc_feature (258)..(258): n is a, c, g, or t
  modified_base (304)..(304): a, c, t, g, unknown or other
  misc_feature (304)..(304): n is a, c, g, or t
  modified_base (395)..(395): a, c, t, g, unknown or other
  misc_feature (395)..(395): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtactcactatggcctggatccctctacttctccccctctcactctctgcacaggttctgacgcctcctangagtctgacacacgcccaccgtcggtcgtcagtcgtcccgagacagcggccagactctacttgttgganactacgtacgaaaggtatagtggtacagttgtaccagtacaggaanacgacggccgacggtacccgtgtcgttgggtagtaataagtaagacgtaggtacgtaggaccggtcctacggaggacctccgtagggaccncggtttaagttccgttacggtcgggttacccacccggttacggtacccggttacgggaaacccggggtaaactaaacccgacgggtttaacccgttaacggggtttaaccgaaaccttaccgttaacggtaacggttacgggtaccgtaaccggaacgggtaccgaaagggaacggaaccgggtaagtccggtaaagttaacgtttaggttaaacttcgggtaacctaaggttaacgaacgtaccgtacggtaacccgggttcggggttaaaccgttacggtttaaggttaccgggggttaacccggggtttgggaacccggggtacggtaaaccggacggttaaccgtacccgggtacccgtttaccgggtaacggtccggaacccggttacccggg

SEQ ID NO: 67277 - DNA, 791 bp, Homo sapiens
  misc_feature: GYAE6OF02FFTUV.49.73.G07.1.454.CMB.1.raw
  modified_base (122)..(122): a, c, t, g, unknown or other
  misc_feature (122)..(122): n is a, c, g, or t
  modified_base (146)..(146): a, c, t, g, unknown or other
  misc_feature (146)..(146): n is a, c, g, or t
  modified_base (154)..(154): a, c, t, g, unknown or other
  misc_feature (154)..(154): n is a, c, g, or t
tcagagtcgagagacacgaccggtgctcgatttagctctacgctcagggcacgaccggtgctcgtttagagacgagtgtgttgggtttgggggtgggtccaggaggccagaactctggggtntctcaccatggcctggatcccctntaccttcnccccctctccactctctgcacagactctgacggccctctatcgacgtctagaccaccgacgccctacccgtcggttacgtccttcggttaccgtccctacgaacgggtacccacggaccggtacctacgttactcccgaccgttcggtccgttaccggtgggaattacgcggtactacgtttaccggaaccctaaagtactaaagttctacgtacccgttttacgacggtaccagacgaacgtaccgaccggcggaccgtaccggtcctagttcgtagtaaccttacgttaaactttaagtaaccgttgttacggacggtaccggccttaaccgggaccggttacccgaggtaccgtacctttaccggttcccgtaggtacccgtccgttacccgcgtttccgaaccgaccggtaaccgtaacctacggtaacgttacccgtacgttaccggaacctcgtacggaccgtacggggtccgaccgggtagacggtacgggacgttacgtaccgtacttacgtacgttacgtcgtactaccgtactacgtaccggaacttccggtaagttacggtcttacccgtacgtttcggtaaacccgggtttgtaacccggggttacgggttacccggtaaaccgg

SEQ ID NO: 67278 - DNA, 739 bp, Homo sapiens
  misc_feature: GYAE6OF02HV908.49.73.G07.1.454.CMB.1.raw
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttcctccccctcctcactctctgcacagactctggacggcctctatgagctgacacacgccaccctggtgtctgtcgtcctcgaggacagaccggcagtancacctgctcgngganatgactattcgaaccgtaaaagcaattacgtcgtacttacgtacggtaaccagacgaacgacgccgaagggcccacggtccccgtgttcgtagtactactaagtttaaagtaaacgttcgtttaggaggtacggtacctcgaaccgggccctagacgtaccggttattccgttacgtacggtacctaccgtacgtccgtaaccgaacgggtaacccaaacgtaaaaccgtcgttaccgtaaccgtttaacgaaccctaacgtaccggtaagggtaccgggggtaaccggtacccggggtacgaaacggggtacggggaaccggacggtaccgttaaggtaaaccgtttaacgttacgtaccgttaccgaagttacctaacggtaaccgaacgtaaaccgggtcggtaacgttaggtacccttaacgtttcggtaccggtttacgggtttaacgttcccggggaacgggtaaccgggg

SEQ ID NO: 67279 - DNA, 619 bp, Homo sapiens
  misc_feature: GYAE6OF02GTJ4T.49.73.G07.1.454.CMB.1.raw
  modified_base (332)..(332): a, c, t, g, unknown or other
  misc_feature (332)..(332): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacacgcccaccctcggtgtctggtgtccctacgaggacaggacggccagtatccacctgctctggagatgctattgaccaaagcaatatgtcttacgtggtaccagcagaacgcgacggccacggccctgtcttgntctaatttaataaagtacgtttagacggtacgggccctacgaccgggtaccctggacgcgtacttccgtcgtcggtcctccgagtcctacgtacgccgtaaccaacgacgtccgaacggtttacaacctagtacgtaggttgggaccggtccgggacgacgggaacgggaccggtaacgggtcgtacgtaactttacgttaccgtgttcgtaacgtctactacgagaacgtaggtacggtcgtctactttcgtacggttacgttacggtccgggacggtaacccggg

SEQ ID NO: 67280 - DNA, 703 bp, Homo sapiens
  misc_feature: GYAE6OF02ISLJT.49.73.G07.1.454.CMB.1.raw
  modified_base (272)..(272): a, c, t, g, unknown or other
  misc_feature (272)..(272): n is a, c, g, or t
  modified_base (537)..(537): a, c, t, g, unknown or other
  misc_feature (537)..(537): n is a, c, g, or t
  modified_base (551)..(551): a, c, t, g, unknown or other
  misc_feature (551)..(551): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgacggcctcctatgagctgacacacgacccaccgtggtgtctgttcgtcctacgaggacacggaccggcctagtactccactcgctcgtagganatcgctagtacgaacctaagactaatatcggtacttacgtacggtacgtagacgaaggtaacgaccgacggaccgtaccggtccccgtagttacgttagtacttacttaattaagtaaacgttacgttaggcgtaaccggtcctaaccggaccggtaccgtagacggtacgtacttcgtacgtcgacctaccggactcgtaccgacgcgaaaccacggtgtaacgtccgttacgacctaagcgtagggtacggtcggaccggganagggacgtaaccgngggtactacgtaacgtttacgttaccgacgttacggtactacgttaacgtacgtaaagggtaaccgttaaggtaccgggttaacgtaccgtttaacccgttccggttaacggtttaacccggttacgggttccggggaacccggtaaacggg

SEQ ID NO: 67281 - DNA, 598 bp, Homo sapiens
  misc_feature: GYAE6OF02IZZ8K.49.73.G07.1.454.CMB.1.raw
  modified_base (227)..(227): a, c, t, g, unknown or other
  misc_feature (227)..(227): n is a, c, g, or t
  modified_base (483)..(483): a, c, t, g, unknown or other
  misc_feature (483)..(483): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacacgccacccgtcggtgtctgtgtccctnaggacaggaccggccagtatccacctgcctctggagatgctattgaccaaagcaatatcgtcttacgtggtaccagcagagccaggccacggccctgtctagatctatttaataagtactttagagtacggtctcgacggtaccctagacgtcgtattacctcgtcggcctaccgacgtcctacgacgacgtaaccgaaacgtaggtacctaacggttacgaacctagttacgaggttacgggacggttccggganaagggacggaacgggacgtcgtagtaaccttagtacttgtactagtactacgtacgtaaggacctaaggtagtacggcttacttcgttagtcgtacggttccggacggtaaccgg

SEQ ID NO: 67282 - DNA, 856 bp, Homo sapiens
  misc_feature: GYAE6OF02F3H5B.49.73.G07.1.454.CMB.1.raw
  modified_base (219)..(219): a, c, t, g, unknown or other
  misc_feature (219)..(219): n is a, c, g, or t
tcagagtcgagagacacgaccggtgctcgatttagctctacgctcagggcacgaccggtgctcgtttagagagagtgtgttggggtttcgggggtgggtccagggaggcagaaccctgggtgtctcaccatggcctggatcctctacttcctccccctcctcactctctgcacagactctgaggccttcctatgagctgatacagccaaccctcgggtntctgtcgtcctcgaggacaggaccgccagtatccaccgtgtcctcgtggagattagctaagttcgaaccgtaaaagaccgtaaatacttagtcctttaacgtacggtaccaacgtacgaacgtaaacgacccgacggaccgaccggtacccccgttggtttaccgtttacggtaacgttaccgttaaacgtttttaaaattaaaacggttaaagttttaacgggtaacgggtaaccggggttcccgttaacgggtaacccggggtaaccccgttaacgggtacgtaaccgttaccggtttacgtttaccgttccggtcccggtttacccgtaaccgtccggttaccgacggacccggtaacccgaaaacgtcggtacccgttaacgtcgtaaaacccgtacgttagtacggtacggtcgggttacccggggaacgaacgggaaaccggtaccgggtaacggtaccgttacgttaaccgtttaacgttaccggtttacgtacccggtaacgttcctaaccggtacgaaccggtacggttaaacgttaacgggttaaccgtaccgtttaaccgttcggtttaaccgggttaaccgtttaccggggttaccggggtaaccggtaacggggttaaacccgg

SEQ ID NO: 67283 - DNA, 882 bp, Homo sapiens
  misc_feature: GYAE6OF02HFAZZ.49.73.G07.1.454.CMB.1.raw
  modified_base (172)..(172): a, c, t, g, unknown or other
  misc_feature (172)..(172): n is a, c, g, or t
  modified_base (280)..(280): a, c, t, g, unknown or other
  misc_feature (280)..(280): n is a, c, g, or t
tcagagtcgagagacacgaccggtgctcgatttagctctacgctcagggcacgaccggtgctcgtttagagagagtggtgttgggtttgggggtgggtccaggaggcagaactctagggtgtctcacatggcctggatccctctacttctccccctcctcactctcgtgcanagactctgaggcctccgtatgagtctgacacgacgcccgacccgtggtcgtctgtcgtcctacgaggacgacggaccgccaaggtctacctacctgtccctgtggacngcgactagtacgaacccaaagaccaattacgtgttaccttaacggtcggaccgtaggacgaggaaccaccggacgaccggtaccgtccccgttgttaccgtgtaacttacttaaattaacgttaaacgtaccggttttaggacgggtaccgggtacccgtaaccgggtaccgggtaacccgttaggaccggttagtttaaccccgtttgtttcccgggttaacccggtcccgttaccccgggtcggtaccctacgggtacccggaaacccgtaaaccgaaacggttaaccgtttaacccggtaacggtttaacccgaacccggttaaacgttaccgggttaacgggggtacggggttaaccccggggggtcccgggtaacggggaaccgggggtaaccggggtaaccggggtacggggttaaccgttaacgggttaaaccgtttaacggtttaaccggtaaccggttacgttaccgttaccgacgttaaccggtaacggtaacggttaccgggtaacgggtttaccgttacccgttttacggtttaccgggttagttcccgggtttaacggggtttaccccgggagggggttaaaccccggg

SEQ ID NO: 67284 - DNA, 738 bp, Homo sapiens
  misc_feature: GYAE6OF02HF9FA.49.73.G07.1.454.CMB.1.raw
  modified_base (140)..(140): a, c, t, g, unknown or other
  misc_feature (140)..(140): n is a, c, g, or t
tcagagtcgagagacacgaccggtgctcgatttagctctacgctcaggggcacgaccggtgctcgtttagagagagtgtgtgggtttggggtggtccaggaggcagaactctgggtgtctcaccatggcctggatccctntacttctccccctctcactctctgcacagactctaggacgcctctagtgagctagacactacgcccacccgtggttgtctagtcgtaccctagaacggacctaacggccggtacctaaaggttctcctacccgtggtaccctacggtaggacggtaattccggactaacgttaccggaaaccaaacggtacctaaagttacgtacgttaccttaacggtacgggtaaccaggaccgaaggaccgaccgacggacccgtacggtccccttaggtacttacgaacttacgtaatttaaacgtaaacgttctttaagggaacggtacgggtaccctacggtaaccgggtaccctaggacgtcgttaattccgtacggtacgtctacgacgtacgtacgaacgtaccgaaacgtacgtaccgtaccggttacgtacgaacctacgtacgtaggtacgggtaccgtacgggaactaagggaacggacggtaacggtctaacgtaagttctaacgtcgtaacgagtacaaggttcgaaagacgttaacggtacgtacgtaccttacggttagtcggttacgtaccgggtacgggaggttaaccg

SEQ ID NO: 67285 - DNA, 878 bp, Homo sapiens
  misc_feature: GYAE6OF02FIOVB.49.73.G07.1.454.CMB.1.raw
  modified_base (143)..(143): a, c, t, g, unknown or other
  misc_feature (143)..(143): n is a, c, g, or t
  modified_base (258)..(258): a, c, t, g, unknown or other
  misc_feature (258)..(258): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctntacttctccccctctcactctctgcacagactctgaggcctcctatgagctgacacagccaccctggtgtctggtctcctgaggacaggcggctagtactccactgctcgtgganagtcgactagtttcgaaccaaaagacctaaaattcgttcgtaccctttaacggtaccggtaaccaggacgaaacggaacggcccgaacgggtccccgaaccgggttcccccttaggttccgttacggtaactaccgttaaagttttaacgtaaaaacggttcgttttaggaaacgggtaccggggtccctaaccggggtaaaccgggtaccccgtaggtaaccgtacgtttaacgttttcccgtacgtccgggtccgttaccgtaacgttccgtaaccgaccggtacccgaaaccgtaaacgtacggttaccgtaacggttaccgtaaccgtacgttacggtaagggttaccggggtacccggttaccggggaacggtaacgggtaacgggggtaaccggtaccggggttaccgtaaccggtttaaacccgttaacgtttttaccgtaccgggttaaccgtaaccggttaacccgttacgtaacccgggttaacggaaaccggttaaacggggttaaccgggttaccgggttaacccgttaaccgtttttaccggggttaaccgggtttaaccgggtttacccggggtttaccggggggtaaacccggggtaacccgggg

SEQ ID NO: 67286 - DNA, 685 bp, Homo sapiens
  misc_feature: GYAE6OF02IG0ZR.49.73.G07.1.454.CMB.1.raw
  modified_base (116)..(116): a, c, t, g, unknown or other
  misc_feature (116)..(116): n is a, c, g, or t
  modified_base (138)..(138): a, c, t, g, unknown or other
  misc_feature (138)..(138): n is a, c, g, or t
  modified_base (203)..(203): a, c, t, g, unknown or other
  misc_feature (203)..(203): n is a, c, g, or t
  modified_base (219)..(219): a, c, t, g, unknown or other
  misc_feature (219)..(219): n is a, c, g, or t
  modified_base (498)..(498): a, c, t, g, unknown or other
  misc_feature (498)..(498): n is a, c, g, or t
  modified_base (533)..(533): a, c, t, g, unknown or other
  misc_feature (533)..(533): n is a, c, g, or t
  modified_base (562)..(562): a, c, t, g, unknown or other
  misc_feature (562)..(562): n is a, c, g, or t
  modified_base (580)..(580): a, c, t, g, unknown or other
  misc_feature (580)..(580): n is a, c, g, or t
  modified_base (590)..(590): a, c, t, g, unknown or other
  misc_feature (590)..(590): n is a, c, g, or t
  modified_base (618)..(618): a, c, t, g, unknown or other
  misc_feature (618)..(618): n is a, c, g, or t
tcagagtcgagagacacgaccggtgctcgatttagctctacgctcagggcacgaccggtgctcgtttagagagagtgtgttgggtttggggtggtccaggagcagaactctgggtntctcaccatgcctggatccctntacttctccccctctcgactctctgacacagacctctgacggccctctagtgacgctgaccacgnggcccacccgtgggtntccgtggtcgtccctacgaggaccaggaccggcctaaaggttacctccgtacccgtgtccttcggtagggaacgtagttcggccttaacgttacggaacccaaaaaggccttaaaagttcgtacggttaccgtttaaccgtacgggtaaccacggacgaaacggtacgccggacggacccgtaccgggtccccttagttccgttagacttaccgtaagttttaactaaaggttctttacggaacggtccgggttacccacgggtaaccgggtcctaggngtaaccgtctttcgctcggtactccgagtcccgtnacgcaactacgactcgacgttccgaactncgtaagtggacgcggacnggacgggacngtcgagtacttaactcgtcgtataccgngtacctagaagtactacggtagtccgacctttcgttacggtcgtcggtaccgtcggacggtaaccgg

SEQ ID NO: 67287 - DNA, 659 bp, Homo sapiens
  misc_feature: GYAE6OF02GS8RG.49.73.G07.1.454.CMB.1.raw
  modified_base (142)..(142): a, c, t, g, unknown or other
  misc_feature (142)..(142): n is a, c, g, or t
  modified_base (526)..(526): a, c, t, g, unknown or other
  misc_feature (526)..(526): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctcctcactctctgcacagactctgaggcctcctatgagctgacacagccaccctggtgtctgtgtcctcaggacaggaccggccagtactcacctgctcgtggagatgactagttcgaccaaaggcaattatgtccttacgtcggtacccaggcgaaggaacgccgaacggccacggccccttgtcttagactctaatttaagtaaagtacgtttaggaacggtacgggtcccttacggaaccgggtacccctaggacgtccgtaacttccgtacgtacggcctaccgagtcctacgacgtaccgaaactaaacgacgttaccgtaacggttacgaaccctagtacctagggtacgggacggttccgggganaacgggtacgggacgtacgggtctaggtaacttagttacgtgtacctagtaccgaataccgaagtaacgtaggttacgtacggtacttaccgttcgttacggtacggttacggttcgggtacgggtaaccggg

SEQ ID NO: 67288 - DNA, 830 bp, Homo sapiens
  misc_feature: GYAE6OF02H5KZB.49.73.G07.1.454.CMB.1.raw
tcagagtcgagagacacgaccggtgctcgatttagctctacgctcagggcacgaccggtgctcgtttagagagagtgtgttgggtttgggggtggtccaggaggcagaactctgggtgtctcaccatggcctggatccctctacttctccccctctcactctctgcacaggctctggagccttcctatgagctgacacgacgtccacccgtggtgtctgtcgtcctagaggacaggaccggaccaaggtactccaccgtgaccttcgtggaccgtagtacgactaagttaccgaaacctaaaaactattaagttcgtacctttaacgtacggtaaccaggtaccgaaggaccggtaccgacggacccgtacccgggtccccgttgttccgtttaagggtcgttaaaattttttaaacgaaaacgtttcgtttacggaaacggttccggacccccgtttacggaaacccgggtccccgtaggtacgtcggttaacctttccggtcccgtcgggtaccctacgtacgtccgtaaccgggtaagggaaaccctaaacggtacgttacccgtaaacccgtttaacgaaccccgttaacgttaacgtaacggggttacggtaaccgggttacccgggaaacgaacggggttaaccgggaaccgggtaggttaccggttaaccggttaaactttaccggttaacgtaccggttaccggtacgttaccggaaccgtacgaccgacggtacgacggtttacgacgtttaacgtacgttaccggttaccggtttaacggtacggggtaccgggtacgggttaaccgtccggtaacccgg

SEQ ID NO: 67289 - DNA, 679 bp, Homo sapiens
  misc_feature: GYAE6OF02IWX15.49.73.G07.1.454.CMB.1.raw
  modified_base (353)..(353): a, c, t, g, unknown or other
  misc_feature (353)..(353): n is a, c, g, or t
  modified_base (567)..(567): a, c, t, g, unknown or other
  misc_feature (567)..(567): n is a, c, g, or t
  modified_base (621)..(621): a, c, t, g, unknown or other
  misc_feature (621)..(621): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgacacacgactcgtgacggccttcctagtgagtctgaccacacgcccacccgtcggtgtcgtgtcgttccctcgaaggaccaacggccggcagtactccaccgtcgcttccggtaggacgagtcgaccttaagttccgaaccaaagacctaaattacgtacgttacgttaacgtcgggttaacccngtacgaaggacggaccggacgaccgaccggtcccctagttcgtagacttataatttaaagtaaacgttgtttaggaacgtcggtacccacgggaacccggtaccctagccgacgttactttcgtcgtcggtacctaccgcgtcaccgagaccgaacgtaaccgtcgtaccgtacgtaccgtaacctagtacgtcgggtacgacgggtccggganagggacgacggacgcgtacgtaatttaccttacgtagtacgactacacgtacgnggtaactgggttggacgtactccttgtacgttcggtacggttacggacgggtaaccgg

SEQ ID NO: 67290 - DNA, 815 bp, Homo sapiens
  misc_feature: GYAE6OF02HHI5R.49.73.G07.1.454.CMB.1.raw
  modified_base (93)..(93): a, c, t, g, unknown or other
  misc_feature (93)..(93): n is a, c, g, or t
  modified_base (118)..(118): a, c, t, g, unknown or other
  misc_feature (118)..(118): n is a, c, g, or t
  modified_base (141)..(141): a, c, t, g, unknown or other
  misc_feature (141)..(141): n is a, c, g, or t
tcagagtcgagagacacgaccggtgctcgatttagctctacgctcagggcacgaccggtgctcgtttagagagagtcgtgttgggtttggggnggtccaggaggcagaactctgggtntctcaccatggcctggatccctntacttctcccctctcgactctctgacacagactcgtgacggtcctcatgagctgactacgagccctaccgtcggtgtcgtgtgtcctgagtcagaccggccaggtactccgacctgccgtcgtaggacgtacgtacgtacgtacttacgaaccgtaaacgtacgtaacgtacgtacgttaccgttacggtacggtaccgacggtaccgtaacggtacggtaccgtaccggtaccgtaccggttaccccgttaggttaccgttacgtaccgtttacgttaaacgtttaaacgtaacggttacgttaacgggacggtaccgggtacccgtacggtacccgggtaccgttacgggtaccgttacgttaccgttccgtaccggttaccggtaccgtacccgtacgtacccgttaacggaaccggtaccgtaaaccgttaaccggtaacggttaaccgttacggttaccgtaaccgttacggtaccggttaacggtccgggtaccggtaccggtacggtaacgggtaaccgggtaccggtaccggttacgtacggttaccgttaacgttacgtacgtaccgtacgtacgtaaccgttacgtaacggtacggttacggtaccggttacgtccgtttacgttacggtaccggttaacggtcggtaccgggtaccgggtacg

SEQ ID NO: 67291 - DNA, 640 bp, Homo sapiens
  misc_feature: GYAE6OF02J244C.49.73.G07.1.454.CMB.1.raw
  modified_base (217)..(217): a, c, t, g, unknown or other
  misc_feature (217)..(217): n is a, c, g, or t
  modified_base (311)..(311): a, c, t, g, unknown or other
  misc_feature (311)..(311): n is a, c, g, or t
tcagagtcgagagacacgaccggtgctcgatttagctctacgctcagggcacgaccggtgctcgtttagagagagtgtgttgggttgggggtggtcaggaggcagaactctgggtgtctcaccatggcctggatccctctacttctcccctctcactctctgcacagactctgacggccttcctagtcgagctagacacacggcctaccgttcggtntctgtcgtcctacgaggacacggacgccagtactccacctgctcgtggagatcgactagtcgaccaaagctaatcgtgaccttacgcgtaaccngacgagaacgccgacggccgtacggtcccttagtccttagaactcttaattaagtaacggtactttaggacggtaccgggcccttaacggaccggtacctaggacgtctacgttcgtcgtacggacctacgctactcgacggactaacaacgtacgtcgtaacggttacacctacgtccgtaggtcgggtacgaccgggactagggaccggacggtacggtctaacggtacttacgttaacgtcgtaccagtacaacgtacgaacgtacgtagttacggacgtccgtttaacgttcgtacggttcgtaacggttccgggacggtaccgg

SEQ ID NO: 67292 - DNA, 722 bp, Homo sapiens
  misc_feature: GYAE6OF02IFJX2.49.73.G07.1.454.CMB.1.raw
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
tcagagtcgagagacacgaccggtgctcgatttagctctacgctcagggcacgaccggtgctcgtttagagagagtgtgttgggtttgggggtgggtccaggaggccagaactctgggtgtctcaccatggcctggatccctctacttctcccccctctcactctctgcacgagactctgacggccttcctatgagctgacacacgcccgtacccgtcgggttgtcctaggttctccgtacgacggacagaccggctagtactcacgtgcttcgaganatcgctagttcgacaaagactaatntacgtacttacgtcggtaccagtacgaacgaacgtccgacggaccgacccggtcccgtgttcgtagtacttacgttaactttaaagtaacgtagtttaggaccggtacgtccgtacggaaccgggtacccctggaccgggtcgttaacgttccgtcggtaccggtaccgtccgtaacggtccgtaagtaccggaccgtaacgtacgacgttacgtacggttaccaactgtacggacggttcggacggtacccggagtaacgggtacgacgggtcgtaccgttaataccgtttaacgtaacgttccgtaagtaccgtacgtacgtaacgtaccgtaagggttacgtaaccggttgtacccgttttacgtacgttttaccgggttacgtaaccggggttccgggaaaccgggttaaaccgg

SEQ ID NO: 67293 - DNA, 204 bp, Homo sapiens
  misc_feature: GYAE6OF02FU9QX.49.73.G07.1.454.CMB.1.raw
  modified_base (196)..(204): a, c, t, g, unknown or other
  misc_feature (196)..(204): n is a, c, g, or t
tcagagtcgagagacacgaccggtgctcgatttagctctacgctcagggcacgaccggtgctcgatttagctctacgctcaggcacgaccggtgctcgatttagtcacgcgagaaagggaagggggctggccctgacgtgtttctgttcccaccctcctctctctcgactctgagcgggctggcaaggcgcatagnnnnnnnnn

SEQ ID NO: 67294 - DNA, 695 bp, Homo sapiens
  misc_feature: GYAE6OF02IAJ8W.49.73.G07.1.454.CMB.1.raw
  modified_base (142)..(142): a, c, t, g, unknown or other
  misc_feature (142)..(142): n is a, c, g, or t
  modified_base (247)..(247): a, c, t, g, unknown or other
  misc_feature (247)..(247): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgaggcctcctatgagctgacacagcccaccctggtgtctgtcgtcctacgaggacagaccggcctagtacncgacctgcctgtaggatagtgactattgacctaaagctaatatcgacttacgtacggaacctggacaacggaacgacccgacgggaccctaaccgggcccccttgttaccgttggtaacttacgtaaattttaaacgaaaacgttcgttttagggaggtaacgggtaccctacgaaccgggaccccttaggacgtcgtacttactaccggtcggtacctaccaggtcctaacggacgtaccgaaacaacgtaacgtacgtacgtttaacgaacctcgttaaccgtaggttgggtaacggtccgggagtaacgggacgggtaaccgtgggtaccgttacgttaacgttaacgttacgtacgtaccgagtacctaacgttggaacgtaacgttacggtacgttcgacttactcggttttcgaggtttacggtccgggtaacgggtaacgg

SEQ ID NO: 67295 - DNA, 647 bp, Homo sapiens
  misc_feature: GYAE6OF02I7QAD.49.73.G07.1.454.CMB.1.raw
  modified_base (165)..(165): a, c, t, g, unknown or other
  misc_feature (165)..(165): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctcctcactctcngcacagactctgaggcctcctatgagctgacacagccacccgtcggtgtctgtgtcctcaggacaggccggaccagtactcacctgctactaggagatgctattgaccaaagctaatatacgactttacgaggtacacgcagaagccagccacggccctgtctgatctagttataaacgtctttagagacgggcctacgacgggtaacccctgacgtacgtacttaccgtcgtcggacgtccaacgtccgttacaggtaccgaaacctaactaacggtacgtaaccgtttggaacctaacgtcaacggttacgggacgtaccgggacgttacggaacggtacggtacgacgttacggaaacgttacgtttaaatacggtaaccgacgttaccgataccggtaaagacgtaacgggttacgtacgggaccttaccgttacggttaccggttacgtaacggtttaccgggacgggaaacccggg

SEQ ID NO: 67296 - DNA, 618 bp, Homo sapiens
  misc_feature: GYAE6OF02IK3QN.49.73.G07.1.454.CMB.1.raw
  modified_base (216)..(216): a, c, t, g, unknown or other
  misc_feature (216)..(216): n is a, c, g, or t
  modified_base (540)..(540): a, c, t, g, unknown or other
  misc_feature (540)..(540): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacggcctcctatgagctgacacacgcccacccttcggtntctgtcgtcctcgaggacagaccggccagtactcacctgctctggagatgctattgaccaaagctaatagtgtctttactcggtaccgagacaagaacgccgacggccacggtcccctgttctagatactatttaataaagtctttagagtacggacctacgaccggtaccctagagcgtacttccttcgtcgtctaccgacgtcctacgacgtaccgaactaacgtacgtacctacggttaccaccctagtccgtaaggtcgggacggtccgggagacggacgggacgaggtcctagaacgttacttactcgttacacgttanacgttacaaggtaaccgtagttcggtagtaccgttctttccgttaggttccgttacggttccggggacgggtaaccgg

SEQ ID NO: 67297 - DNA, 748 bp, Homo sapiens
  misc_feature: GYAE6OF02FX89B.49.73.G07.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (309)..(309): a, c, t, g, unknown or other
  misc_feature (309)..(309): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatgagctgacacngcccacctcggtgtctgtgtcctcaggacaggaccggccagtatccactgctcgtgganatgactagttcgaccaaagtcaaagttatcgtactttacgtcggtaacccnggtaccaacggaacgcccgaaggtacccaaccgggtcccctttggttaccgttagacttactaattttaagtaaacgttacgtttaggaaggtacggggtcccttacggaaccgggtacccctaggaacgtccgttaatttcctagtcggtccttaccgaagtcctacgacgaaccgtaactaaccgtacgtaccgtaacgtttccgaaaccgtacgttacgtaacgggttacggtaaccgggttccggggaacgagggggtaaaccgggtacgggtacgtaaccggttacgttaaaccgttaacgtttaccgtacggttaccgtaagtttaccgaacgtaccgtaaaggtaaccggttagggtttaaccggttacggaccctttaacgtttccgtttaggttacccgggttacggtttaccggggacggtaaccgggg

SEQ ID NO: 67298 - DNA, 641 bp, Homo sapiens
  misc_feature: GYAE6OF02JCDIZ.49.73.G07.1.454.CMB.1.raw
  modified_base (357)..(357): a, c, t, g, unknown or other
  misc_feature (357)..(357): n is a, c, g, or t
tcagagtcgagagacacgaccggtgctcgatttagctctacgctcagggcacgaccggtgctcgtttagagagagtgtgttggggtttgggggtgggtccaggaggcagaactctgggtgtctcaccatggcctggatccctctacttctccccctctcactctctgcacagactctgaggcctcctatgagctgacacagccacccgtcggtgtctgtcgtcctcgaggacagacggccagtactcacctgctcgtggagatgctattcgaccaaaagcctaaatatgtacttacgtacggtaaccagaccgaaggaacgccgaggcctacggccctgttactgatctaatttaanaaacgtctttaggacggtaaggccctacgaacgggacccctaggacgacgtattctcgtacgtcgtcctagtctacgacgacgaacaacgtacgtacgacgtacgaaccatacgaggtacggacggtccgggacaacgggaacggacgtacggcgtacgtaacgttaactacgtaggtaccgtaagtacgtacgtaccgaagtaacggtaacgttaacggtacggacctttaccgttacggttacggtaccgggttaacgtttaccggggacgggtaaaccggg

SEQ ID NO: 67299 - DNA, 878 bp, Homo sapiens
  misc_feature: GYAE6OF02HM0LV.49.73.G07.1.454.CMB.1.raw
  modified_base (300)..(300): a, c, t, g, unknown or other
  misc_feature (300)..(300): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctctcactctctgctacagactctggacgccctcctaagtcgagtctacggacactacggcccctacccgttcgggttcgtacttcggttccgttacccacggtaaacgggaccaacgggtaccggcctaacgtactccgtaccgngttaccgtcgtaggaattgacgtaccctaagttcggaaaccctaaaaggtactaacgttacgtaccgttaccgttaccgtacggtaaacccgaggaaccgtaaaggaccgaccccggtacgggaacccctcccgggttccccttaacgggttacgtttaacgtaacgtttaacgttaaagtttaaacgtaaacgtttacgtaacggggtaaccggtccggttacccgtaccggggaacccggttaccgtaggtacggttaacgttaccttttccgtccgtaaccgggtctacccgtaaggttccgccggtaacggaacccgttactaaaccggttacgtaccgttaacgtacccgtaacgtaacccggttgggttaccgggtaccggtaccgggtaccgggtaaacggtaacggaaccggggtacggaccgggttagtacccgttaaacgggtttaccttacggtaacggttaccgttaacgacgttacgtaaccggtaacgtacgtaaacggttcggtaaccgttcgtaccgttgttaccggttaccgggttttacggaccggggaccgtaacgggg

SEQ ID NO: 67300 - DNA, 794 bp, Homo sapiens
  misc_feature: GYAE6OF02H9VL5.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctgagcctctatgagctgacacacgccacccgtggtgtctgtcgtcctcaggacagaccggccagtactcacctggccttcgtaggagtagtcgctaagttaccgaacctaaaagactaaattacgtacgttacctttaacgtcggtaacctaaggaccgaaggaaccggacccgaacgggccccgtaccggtacccccgttaggttcctttaggaacttaacctaaagtttttaaacgtaaaacggttcgttttaggaaccgggtaccggtacccgttaacggaacccggggtaccccttagggaacgtaccgttaacgtttcccgttcggtaccggtcccgtaccgtaacgtaccgttacgaacgaccgaaaccgtaacgtacgttacccgtaacggtttaccgaacccgttagtacccggtaagggtaccggggtaaccggttaccgggaacgtaacggggtaacggacgggtaaccggtcgtaacggtaacctttaaacgttactacggtacctacgtacgtaacgtacggtacgtaacgtacggttacggtacggacccgtttactttaccggtcggttaccggttaacggttccggggaacggtaacccggg

SEQ ID NO: 67301 - DNA, 692 bp, Homo sapiens
  misc_feature: GYAE6OF02HL6HR.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgacgcctcctagtgagctagaccacacgccctaccgtcggtcgtcgtcgtccgtcctcgaggacacggaccggacctagtactccgtaccgtcgtccgtcgtagggagtatcgactacgttacgactaaacgactaagtactcgtactttaccgtacggtaccacgacgaacggaacgtccggaccggccgtaccgggtcccctaggttcttcgtaattactaatttaacgtaacgttacgtttaggaacggtcgtaccgcggaccggtaccgtagacggtcgtacgttcgtaccgtacgtccgtacgtacgtccgtacgaacgaccgtaaaccacgtaccgttaccgtacgttacgaacgtacgtcggagggtacgtcgggtaccggagacggacggtacgacgtcgtacgtacttacgtacggtactacgacgtacacgttacgacgtacgaacggttcggcgttaaccctttcgtacggttcgttaacggttccggttacgggacggtaacgg

SEQ ID NO: 67302 - DNA, 641 bp, Homo sapiens
  misc_feature: GYAE6OF02F4OMP.49.73.G07.1.454.CMB.1.raw
  modified_base (93)..(93): a, c, t, g, unknown or other
  misc_feature (93)..(93): n is a, c, g, or t
  modified_base (142)..(142): a, c, t, g, unknown or other
  misc_feature (142)..(142): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
tcagagtcgagagacacgaccggtgctcgatttagctctacgctcaggggcacgaccggtgctcgtttagagagagtgtgttgggtttggggngggtccaggaggcagaactctgggtgtctcaccatggcctggatccctntaccttcctccccctcctcactctctgcacagactctgaggcctctatgagctgacacagcccaccctcggtgtctgtcgtcctcgaggacaggaccggccagtatccactgctctggagatgcattgaccaaagcaatntncttacnggtaccagcagacncgacgccgacgccctgtctgatactatttataaatcgtttagacggacggtcctacggaccgggtacccctagacgacggtattccgtcgtcggcctccgagtctacgacgaccgaacaacgtacgtacctacggttacaaccgtataccgaggtacggtacggtaccgggagaacgggaccggacgggacggtaccgtagttaaccgttaagtttaccgtacgtaccgtaacgttactaaggtaccgaacgtaaccggttaggtaccgggttaccgaacgtttcgtttacggttacggttacgttaaccgggttccggggaacgggtaacccgggg

SEQ ID NO: 67303 - DNA, 627 bp, Homo sapiens
  misc_feature: GYAE6OF02F6HWM.49.73.G07.1.454.CMB.1.raw
  modified_base (191)..(191): a, c, t, g, unknown or other
  misc_feature (191)..(191): n is a, c, g, or t
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (479)..(479): a, c, t, g, unknown or other
  misc_feature (479)..(479): n is a, c, g, or t
  modified_base (575)..(575): a, c, t, g, unknown or other
  misc_feature (575)..(575): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacagactctgaggcctcctatganctgacacagcccacctggtntctgtcgtcctgaggacacgaccgcagtacncactgctcgnganagtcgntacttcgaccaaagcaaatactcgtacttacgtacggtaaccagacaagaacgccgacggccgaccggtcccttgtccgttagacttacgtactttaaataaacgtctttaggaacggtacggtcctacggaccggtacccctggaccgtcgtacgtttccgcggtacgtcctaacgacgtccacgtacgactaaccaacgtacggacctaggtaacncgacgtacgtaggtcggtacgggtccgggacaagggtaacggacggtacgtcgtagtaacttactacgtcgtaactagtccaagttcgaaggtacnggttagtcgtacttcggtacgttcggtagttaccggttgggaccggtaacgg

SEQ ID NO: 67304 - DNA, 761 bp, Homo sapiens
  misc_feature: GYAE6OF02HZOT7.49.73.G07.1.454.CMB.1.raw
  modified_base (119)..(119): a, c, t, g, unknown or other
  misc_feature (119)..(119): n is a, c, g, or t
  modified_base (216)..(216): a, c, t, g, unknown or other
  misc_feature (216)..(216): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggctggatcctctacttctcccctctcactctctgcacagactcgtgacggtcctcctagtgagctcgacacacgcctacccgtggtntccgttgtcgtcctacgacggacaggaccggcctaagttactcgacctgctacgtaggagtacgtgacgtatacgaaccaaaacgtacaaatatcgttacttaacgtacggttaaccagaacgaacggtaaacgaccgtaacggacccgtaaccgggtccccgttcggttccttacgtaacttaaccgttaaagttttaaacgtaaaacgttacgttttacggaacggtaacggtcccgtaccggtacgggtaccctaggaccgtacggtaacgttccttccggtaacgtccgtaccgtagtcccgtaagacggaccgtaactaaaaccgaggttaccgtaacgttacgaaaccgtacgtaacgtacggttacggtaacgggtcccgggtaagaaacgggacgggttaacggacggtacgtacgtaaacttaacgtttacggtaagtcgtaacgtacgtactaacgtataaccggtagtaacggttacggtacgtaccgttcggtacccggtaacggtttacggtaccgggtacgggtaaccggg

SEQ ID NO: 67305 - DNA, 862 bp, Homo sapiens
  misc_feature: GYAE6OF02HK07M.49.73.G07.1.454.CMB.1.raw
  modified_base (142)..(142): a, c, t, g, unknown or other
  misc_feature (142)..(142): n is a, c, g, or t
  modified_base (176)..(176): a, c, t, g, unknown or other
  misc_feature (176)..(176): n is a, c, g, or t
tcagagtcgagagacacgaccggtgctcgatttagctctacgctcagggcacgaccggtgctcgtttagagagagtgtgttcgggtttgggggtggtccaggaggcagaactctgggtgtctcaccatggcctggatccctntacttcctccccctctcactctctgcacagctcngagcctctatgacgctagaccacagtaccccaccgttggtcgtcctaggttccgtccctagaagggaccaagggtaccggccaaggttactaccgaccgtggcctcggtgggaactacttggaccttaattcgaaccccgtaaaggtacctaaagtttagtaccgttacgtttaacccggttacgggtaaacccgacggtacaaaacgggaacggaaccgggaccgggaccctaacccggggtccccttaggttccgttttaaggacctttaaccgttaagttttaaaagtaaccgggttaccggttttaggaaaacgggggttcccggggtcccttaacccgggtaacccggggtaccccctttaagggggaaacccgttccgttttaacggtccgtttacccggtgggtaaccctcccggtacgtttccgtaacgaccgggaacccgtaaacgaccgttaccggtaacccgttacggttaaccgaacccgttagtcccggttaagggtacgggtaccgggtaccgggacggtaacggggtaacggaccgggtagggtaccttaacggttaaccgttaggttaccgtacgttcgaaccgttacggaactaccggaggtaacgtcggtacgtccggttaattccggttacacggttcctaaacggttcggttccgggaaaccgggg

SEQ ID NO: 67306 - DNA, 664 bp, Homo sapiens
  misc_feature: GYAE6OF02F60QS.49.73.G07.1.454.CMB.1.raw
  modified_base (142)..(142): a, c, t, g, unknown or other
  misc_feature (142)..(142): n is a, c, g, or t
  modified_base (243)..(243): a, c, t, g, unknown or other
  misc_feature (243)..(243): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgacggtcctctatgagctgacacagttccaccttggtgtctgtgtcctcgagacagacggcagtacncacctgtcctcgtggagatgactattgaccaaaacgactaaattatcgtacttaacgtacggtaaccaggaccgaacgaacggaccaacggaccgaccggtaccccttcggttacttacggtaactacttaaagtttaaactaaaagttacgttttaaggaacggtacggtaccgtacggaacggtacccctgaacgtacggtacttaccgtcgtacgccttaaccacgcgtacgacgaccgaacaacgtacgtaccgtacgtacgtaacctatacgagtacgacggtccggacgaaggaacggacgggaagcgtaagtaacttaacgttacgtacgtctacgtacaagtacgaacgtacgtaagtaaggtcgtaacgtcgtttaggttaccgtagtttacggtacggtacggtaaccggg

SEQ ID NO: 67307 - DNA, 696 bp, Homo sapiens
  misc_feature: GYAE6OF02GQW6I.49.73.G07.1.454.CMB.1.raw
  modified_base (119)..(119): a, c, t, g, unknown or other
  misc_feature (119)..(119): n is a, c, g, or t
  modified_base (142)..(142): a, c, t, g, unknown or other
  misc_feature (142)..(142): n is a, c, g, or t
  modified_base (285)..(285): a, c, t, g, unknown or other
  misc_feature (285)..(285): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctntacttctccccctctcactctctgcacagactcgtaggacggcccttcctaatggagtcctagaccacacgcccacccttgggtgtcctggtctcccacgaggaccaggaccggtccaggttactccaccgtgtctcgtgganatcgctattcgaccaaagcaagtagtcgtacttacgtacggtaaccagacgaacgacggaccgacggtacccgaccgggtccccttaggttcttcggaacttctaacttttaataaaagtaccgttttaggaacggtacggggtccttacggacggggtaccccctggaacgcgtacgtttcctcggtcggtccgtccgacgtaccgtacgacgaacggtaacaacgtacgtccgtacggttacaaacctcgtacgtacggtagggaccggttaccgggacgtaacgggacgggcgtaaacggtcgtacgtaaacgtttacttacgtacgtacggtacgtctaatccgaaagttaccgaaggttaacgtcggaccttacgtcgtcggttagtcggttcgggacggtaacgg

SEQ ID NO: 67308 - DNA, 219 bp, Homo sapiens
  misc_feature: GYAE6OF02J2QA3.49.73.G07.1.454.CMB.1.raw
  modified_base (163)..(163): a, c, t, g, unknown or other
  misc_feature (163)..(163): n is a, c, g, or t
  modified_base (168)..(219): a, c, t, g, unknown or other
  misc_feature (168)..(219): n is a, c, g, or t
tcagagtcgagagacacgaccggtgctcgatttagctctacgctcaggggcacgaccgggtgcttcgatttagtcacgcgtagaaggggaagggggctggccctgacgtgttcctggttcccaccctctctcctctcgacctctagcgcgggctggcaaggcncatgnnnnnnnnnnnnnnnnnnnnnnnnnnnnnnnnnnnnnnnnnnnnnnnnnnnn

SEQ ID NO: 67309 - DNA, 903 bp, Homo sapiens
  misc_feature: GYAE6OF02HPGKE.49.73.G07.1.454.CMB.1.raw
  modified_base (230)..(230): a, c, t, g, unknown or other
  misc_feature (230)..(230): n is a, c, g, or t
tcagagtcgagagacacgaccggtgctcgatttagctctacgctcagggcacgaccggtgctcgtttagagagagtgtgttggggtttgggggtgggtccaggaggcagaactctgggtgtctcaccatggcctggactccctctacttcctccccctctcactctctagccacagactcgtagacgtcctactagtgagtctagaccacgacgccctacccgttgggtntcgttgtacgtacctacgacgggtaccaagggtacccggactaacgttacctccgtaccgtggtaccttcggtagggacgtaccttggacttaacgttacggaaaacccgaaagtacctaaagttacgtacggttaaccttttaacgggacggtaaccgaaggtaaccgaaggaaccgacccggaacggtcccggtaacccggtcccgtttagttacccgttaaggtacttaaacttaacggtttaaaactaaacgggtttacgttaacgggaacggggaccgggtacccctaacggggacccggggttaccctaggtaaaccggtcggttactttacgaccgggttacgaccttaccggacgttaccgaccgtaacggaaccggtaaactaaccggtacgttaacccggtcgttaacgaacctacgggtaaggttaccgggtacgggaccgggtaccggaaacgggtaacgggtaccgggaaccgggtacggttaaccggtaaccgtttaaacgttaacgtttacccggagtttaacccgttacgtacgttaacctaaacgggtaacagggtttaaccggtacgggttaacccgttacctttaaccgggtttcggtaaaccgggttttaccgggttaaaccggggtttccgggaaacggggttaaaccccgg

SEQ ID NO: 67310 - DNA, 600 bp, Homo sapiens
  misc_feature: GYAE6OF02FNEPO.49.73.G07.1.454.CMB.1.raw
  modified_base (142)..(142): a, c, t, g, unknown or other
  misc_feature (142)..(142): n is a, c, g, or t
  modified_base (258)..(258): a, c, t, g, unknown or other
  misc_feature (258)..(258): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctcccctctcactctctgcacagactctgaggcctcctatcgagctgacacagcccacccgtgtgtctgtgtcctcaggacaggacggccagtatccaactgcttctgganatgcattcgaccaaagcaagtatcgtcttacgtggtaccagacgaagaacgccgaggccacggccctgtcttagatctaatttataaagtctttagacggacggcctcgaacgggtccctagacgtcgtacttctacgtcggctccgacggcctacgacgcgaacaacgacgtacgtacgttagactacgtcgaacggtggaacggtccgggaacacgggacggaggacgtgtacgtaccttatacttcgggtactacggttacacacggtaacgaaggtagtaacggttcggaccttaccgggttagttccggtacggtacggttcgggacggtaaccggg

SEQ ID NO: 67311 - DNA, 660 bp, Homo sapiens
  misc_feature: GYAE6OF02IXAEM.49.73.G07.1.454.CMB.1.raw
  modified_base (142)..(142): a, c, t, g, unknown or other
  misc_feature (142)..(142): n is a, c, g, or t
  modified_base (242)..(242): a, c, t, g, unknown or other
  misc_feature (242)..(242): n is a, c, g, or t
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (328)..(328): a, c, t, g, unknown or other
  misc_feature (328)..(328): n is a, c, g, or t
  modified_base (579)..(579): a, c, t, g, unknown or other
  misc_feature (579)..(579): n is a, c, g, or t
  modified_base (591)..(591): a, c, t, g, unknown or other
  misc_feature (591)..(591): n is a, c, g, or t
  modified_base (599)..(599): a, c, t, g, unknown or other
  misc_feature (599)..(599): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctagaggccctcctaagtgagctagaccacgacgcccacccgtcggtgtcttggtctccctgaggacnggaccggtccagtactccacctgctcgtgagtngactntcgaacaagnaatntgttaccttagtacggtaccaggacgaacggacnccgtacggccgaccgtccccttagtctagtatctaagtttactaagtcttaggacggtcggtacctcggaaccgtacccgtagaccgtaccttacgttccttcggtcgtaccctacgcgtcctacgaacggaccgaaactaacggtacgttacgtaccgtagtaccgtagttacggaggttacgggtaccggtcgggaacggttacgggaacggtaccgggtacgtacggtacgtacctttacttacggtntacgtagtaccntaaccggntaacgtggtacgtgttaccgttacttcggttacggttcggtaggttccgggaccgtaacgg

SEQ ID NO: 67312 - DNA, 695 bp, Homo sapiens
  misc_feature: GYAE6OF02GUCQ4.49.73.G07.1.454.CMB.1.raw
  modified_base (142)..(142): a, c, t, g, unknown or other
  misc_feature (142)..(142): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgagcctcctatgagctgacacagcccacccgtggtgtctggtgtcctcaggacaggacggccagtatcacctgctctggagatgcattcgaccaaagcaatatagctttaacgcggtaccagcaagaacgccaggccacggcccctgtcttgactcgtatttaataaagtactttgacggtacgggcccttacggaccgggtacccctgacgcgtaacttctcgtcggtctaccgtgtcctcgtacgaccgaactaaaccgagtacccgtaccggtttagtaaccctagttaaccggtaggttaccggggtaacggttccccgggggagtaacggggtaacgggaacccgggtaacggggtaccgttacgggttaactttaacggtttaaccgttacggttaccgttaagttacgtacgtaccgtaacgggaaccgttaaggttacggtcggtaaccgttaccgttttcggttaccggtttacggttaacggtttaccgggggaccggttaaaccgggg

SEQ ID NO: 67313 - DNA, 758 bp, Homo sapiens
  misc_feature: GYAE6OF02GKVZM.49.73.G07.1.454.CMB.1.raw
  modified_base (206)..(206): a, c, t, g, unknown or other
  misc_feature (206)..(206): n is a, c, g, or t
  modified_base (271)..(271): a, c, t, g, unknown or other
  misc_feature (271)..(271): n is a, c, g, or t
  modified_base (742)..(742): a, c, t, g, unknown or other
  misc_feature (742)..(742): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctcccctctcactctctgcacagactcgtggacggccttcctatgagcgtacgacacncgcccacccgtcggtgtctgtcgtccagacgagacggacgctagtacacacgtcgtctcgtgganatgctagttcaacaaacgctaaacttagtcgttacttaggtcgtaacagacgaaaggacgccgacggccgtaccgtcccgttagtcctatacgttacttaaagtttaaacaacgttacttagggaaccggtcggtacctacggaccggtacccgtaggacggtacgtacttacgtacgccggttcaaccgtccgcgacgacggacctaacgtaaccgtcttaccgggaccgttaccgaacgtacgtacggtacgggtacgggtccggtaaccggggacgaacgggggaccgttaagggaccgttaccgttagtaaaccgttttacttaaacccgggttcgtaaccggtttaacctcgaaaacgtttacccgggtaaacgttacgggaacgggttttaccggtccggttaacccggttccgtttttacggttacccggggttaaacgtttcccgggggttaaacccgggggnggttaaaaccccgggg

SEQ ID NO: 67314 - DNA, 851 bp, Homo sapiens
  misc_feature: GYAE6OF02JWAD9.49.73.G07.1.454.CMB.1.raw
  modified_base (122)..(122): a, c, t, g, unknown or other
  misc_feature (122)..(122): n is a, c, g, or t
  modified_base (146)..(146): a, c, t, g, unknown or other
  misc_feature (146)..(146): n is a, c, g, or t
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
  modified_base (828)..(828): a, c, t, g, unknown or other
  misc_feature (828)..(828): n is a, c, g, or t
tcagagtcgagagacacgaccggtgctcgatttagctctacgctcagggcacgaccggtgctcgtttagagagagtgtggttggggtttcgggggtgggtccaggaggcagactcgtgggtntctcaccatggcctggactccctntaccttcctccccctctcacttctctgaccacagtacttcgtaggacggtccttctatggacgtctagacctacgaccggtccctacccggttcggtnttacttacggtcctacctacggacggacacggaccggtacctaggttctaccgacgtcgctacggtggaagttcncggttactcgttaacggaacctaatacgttaattacttcgtttaaccgtttacgtccggttaacacggaacgtaacggtaaccgtaacccgggcgtaccccggtaaccgggtttccccgtttaggttttaccggtacgggtttaaatttaaaccgttttaaacggggtaaaccgtttaggttaccggggaaaccggttccccgggttacccccgttaaggggacccccggggtaccgttaggtaaacggtccttagttttacccgccgggtttacgacctttccggacggtaccgtacgggtaaccgaactaccgttacgtacccgtacgttaccgactacggacggttacgtaccgggtacggttaccggacgttaaccggggacgggttacggtacggtaccgttaacgttaccgttaacgtccgtaacgtaccggtcgtaccgaactacggacttaacgggcttaacgggtcttaggtacgttacggtaaccgtggttaacccggnggtaaccggttagacccgtacgg

SEQ ID NO: 67315 - DNA, 918 bp, Homo sapiens
  misc_feature: GYAE6OF02GUSA3.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctctcactctctgcacgagactctgaggccctcctatgacgctgacacagcccaccctggtgtctgtcgtcctcgaggacagacggccaagtactcaacctgctcgtggatatgcattgaccaaagcaagttatcgtactttactcggttaaccagactaacgaaacggtccccgagggacccgaacggtcccccgtgttaccgttaggaacttccgtaactttttaagtaaacgttacttttagggaacggaccgggtacccgttaccgaaccgggtacccccgtaggacggtcgttaacgtttcccttacggtcgggtccctacccgtaggaccgttcgaaccgggtaccgtaaacccggaaaccgtacggttaacccggtaaccggttttacccgaaacccgtaaaccggtttaacccgtaacgggggttaacggggttacccgggtttaacccccggggggtaaccgtaaaccgggggtaaacgggggaaaccccgggtaacgggggtaacccgttttaccggggtaaaacccggtttaaccggtttttaaacccggtttaaccggtttaccccgggttaaaccggttaccgaaaccccgtttttaacggaaaccgggttaaacggtttaacccgggggttaacggttttccccgggggtaaaccttttaaccccgggttttcccggtttaaacccgggtttttaacccgggtttaacggggttttacccccgggggacggggttaaaaaccccccggggg

SEQ ID NO: 67316 - DNA, 917 bp, Homo sapiens
  misc_feature: GYAE6OF02JJ1E4.49.73.G07.1.454.CMB.1.raw
  modified_base (183)..(183): a, c, t, g, unknown or other
  misc_feature (183)..(183): n is a, c, g, or t
tcagagtcgagagacacgaccggtgctcgatttagctctacgctcagggcacgaccggtgctcgtttagagagagtgtgttgggtttgggggtgggtccagggagcagaactcgtgggtgtcctcacagtcggccgtggactccctctacttcctcccctctcactctctcgcacagtactcnggacgtcctcgtatgacgtctacgacacgcgcctccgtcggtcgttctgtcgtccgtacgacgacgacggaccgaccgtagtctacctacgtcgcgtacgtggaacgtagtcgtacttaacgttccggaaactaaaacgtactaaacgttacgttaccggtaaccttttaaccggtaccggtaaccgaacggttaaccgaaaacgggtaaaccgtcccgggtaaccgggacccggtacccggttacccccgtttcggttaaccgtttacggtaaattaacgttaaaacgtttttaaaccgtaaaacggtttacgtttaacgggtaacggggttaacccgggtcccgttaaccgggaaaccccgggttaccggtaaccgtaccggggtacctttacccggtttaccgtaccggttccgtaacccgttacccgtaccggaccgttacccggtaaccggtaaccgtaaacccgaacggttaccgttaacccgggtacccgtttaaccggaaaccccgttaacggtttacggtaccgggggttaaaccggttcccgggtaaaccgggggtaccgtaaaacgggtcccgggtaaacggtaaccgggttcttaaacgggtaaccgttttaaaccggttcgtaaccgttcggtaaccttacgacgtacgtaacgtaacggtacggttacggccgttaacgtcgttacggtcgtaaggtttaccggtacgggtagtacccgg

SEQ ID NO: 67317 - DNA, 880 bp, Homo sapiens
  misc_feature: GYAE6OF02GWWFG.49.73.G07.1.454.CMB.1.raw
  modified_base (225)..(225): a, c, t, g, unknown or other
  misc_feature (225)..(225): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgagcctcctatgagctgacacagccacccgtggtcgtctagtcgtcctanaggacaggacggccagtatcacctgcctcgtggagattgctagttcgaccaaagcaaatagttagactttaacgtcgggtaacccagtaccgaacggaaacgaccccgtaagggaccccaaggggtccccccttacgggtttaccgtttcggtaaccttaccgttaaacttttttaaaccggtaaaaacggttacccgtttttaacggggaacggtaacggggggtacccccttaccgggtaacccgggggtaaaccccccgttaagggtaacgggcccgggttaaacttttcccggttacccgggttacgggtacccgtttacccgaaacgggttccccgttacgtaaacgggttaccgaaaccgtaaacctaaggttacccgttaaccggttttaccggaaaaccctacgttaaccggaaacgggttccggggacggggttacccggggaacgaacgggtaacggggtaaccgaaccggggtaccgttaacggtaccgtttaaacgtttaacggttacgttacccggtacgttaccgaacttaccggtaacgggtaaccgttaacgggtaacgggttacggttaaccccgttaccgtttacgtttaccggtacccggttttacgggttcccggggttacggggtaacccgggg

SEQ ID NO: 67318 - DNA, 754 bp, Homo sapiens
  misc_feature: GYAE6OF02GG6OG.49.73.G07.1.454.CMB.1.raw
  modified_base (119)..(119): a, c, t, g, unknown or other
  misc_feature (119)..(119): n is a, c, g, or t
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (284)..(284): a, c, t, g, unknown or other
  misc_feature (284)..(284): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttcctccccctctcactctctgcacagactctgacggcctactatgacgctgaacacgagcccacccgtgggtntcgtgttcgtccgtanagggaacacggaccggtacctagtactccaccgtgctcgtaggacgtangctaacgttcgaaccgaaaacgtacgtaaagtagtcgtacgtttaaccgtacgggtaacccaacggcgaaacggaaccggacggaaccgggacccgtaccgggtcccccttaggttccgtacgtaacgttaccttaaagtttaaacttaaacgggttacctttagggaaacggtcggggtacccgttacggaaccggtaccccgtaggaccgtcggtaacctttcgtcgtcggaccctcgtacgcgtacagacctaacgaacgtaccgtactacggtacgtaacctgtacggtacggtaggacggtcccggagggtaacggaacgggacgggaacgttacccgtagttaacccgttaagttccggtaagttaccggtactacctaagtaccggaacggtaagttaacggtcgggttcggtaacctttcgtcggttcggttacgttacgggttccggggaacgtaaccggg

SEQ ID NO: 67319 - DNA, 706 bp, Homo sapiens
  misc_feature: GYAE6OF02JWHNA.49.73.G07.1.454.CMB.1.raw
  modified_base (120)..(120): a, c, t, g, unknown or other
  misc_feature (120)..(120): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
  modified_base (613)..(613): a, c, t, g, unknown or other
  misc_feature (613)..(613): n is a, c, g, or t
tcagagtcgagagacacgaccggtgctcgatttagctctacgctcagggcacgaccggtgctcgtttagagagagtgtgttgggtttgggggtgggtccaggaggcagaactcgtgggtntctcaccatggcctggatccctctacttcctccccctctcactctctgcactagactctgagcctctatgcgtctcgacacacgccaccgtggtcgtctgtctcctacgacgacgtacggaccgcctagtactcacctgcctagtggancncgatacgttcgaaccaagtactaatgtctaccgttacgtacggtaaccnggtaccgaagaaccnccgggacgtcccgtacccgggtccctttggtcttatacttagtttaaacttaaacggagttactagggacgtaccgggtctaaccgggaccggtactgacgccttagtttcgccgtccgtacctcgcgtaccgtacgacgtaacctacgaaaccgttgccgttaaccgtacgtacgtacacggtacgggtcgttaaccgggccgggaacgtgggaccgggtaacgggacggtaccggtacgttagttaacgttacggtaccggtatccgtaacggttnaccggtaaggtacgttacggttacgggttccgttccgttacggttttccggttacggttacccggtttaggtacccgggtaaccggtaacggg

SEQ ID NO: 67320 - DNA, 699 bp, Homo sapiens
  misc_feature: GYAE6OF02GYA4S.49.73.G07.1.454.CMB.1.raw
  modified_base (274)..(274): a, c, t, g, unknown or other
  misc_feature (274)..(274): n is a, c, g, or t
tcagagtcgagagacacgaccggtgctcgatttagctctacgctcagggcacgaccggtgctcgtttagagagagtgtgttgggtttgggggtgggtccaggaggcagaactcgtgggtgtctcaccatggcctggatccctctacttcctccccctcctcactctctcgcacagactctgacgcctcctatgacgtctgacactacgcccaccctcggtctcttgtcgtccctgaggacagacgcaagtatcacctgctcgtggactagtcgngtattcgacaaacgtacaaatagtcgtaccgttacgtacggtaaccgagacgaacgaacgaccgacggaccgtaccggccccgtagttccttacggatactaactttaataaacgttacgtttagaacgggtacggtaccgtacgaccgggtaaccccgtaggaacgtaccgtaacgtttcctaacggtccggtaccttaccgacgaccgttcgaacggaccaaacgaacctaggtcctaaaccggttgaaccgtaactacgtaggtacggaccgggtacgggcgaacgggacgggaacggtacgtacggtaactacgttaacgttactggtactaaccgtataacacggtaaacgtacgtagggttaacgtcggaccttacgttacggttcgttaaccggttaggtaccggaccggggtaacgg

SEQ ID NO: 67321 - DNA, 757 bp, Homo sapiens
  misc_feature: GYAE6OF02JZRLA.49.73.G07.1.454.CMB.1.raw
  modified_base (147)..(147): a, c, t, g, unknown or other
  misc_feature (147)..(147): n is a, c, g, or t
  modified_base (659)..(659): a, c, t, g, unknown or other
  misc_feature (659)..(659): n is a, c, g, or t
tcagagtcgagagacacgaccggtgctcgatttagctctacgctcagggcacgaccggtgctcgtttagagagagtgtgttgggggtttgggggtggggtccagggaggcagaactctggggtgtctcaccatggcctggatccctntacttcctccccctcctcacctctctgacacagactctggacggcctcctatgagctagaccacacgcccacccggttggtgtctgttacgtcctcggagacgacggtacggcctaagtctaccaccgtgacctcggtaggagtacttggcttacgttacgaaccgtaaagtactaaacttcggtacgttccggtttaacggtacggaaccacggtaacgaaaccggtacggtacccggtaaccgggcccgaacccgggttccccgttaggtacccgtttaggtaaaccttaacggttaaagtttaaacgtaaaccggtacgtttacgggaacgggtaccgggtccgtaaccggaaccggtaccccgtgaacggtaccttagttccgtaagggtccgtcttaccgacgttccacgacgactaacacggtacgactacggtactacgtacgtaggtacggtacgggacggtacggcgaagggacggacgaacgtgtacctattacgttaccgngtaacgttcgtagtaccgtacggtacgtacggtacgtacgggtacttaccggtacgtttaggtaccggttccggtagggtaccggggcgtaacccggg

SEQ ID NO: 67322 - DNA, 775 bp, Homo sapiens
  misc_feature: GYAE6OF02G4H4N.49.73.G07.1.454.CMB.1.raw
  modified_base (693)..(693): a, c, t, g, unknown or other
  misc_feature (693)..(693): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttcctccccctcctcactctctgcacagactctggacggcctcctatgagctgaccacacgccctacccgtggtcgtcgtgtcgtccgtacgaaggactacggaccgaccgtaagtactaccaccgtcgtaccgttcggttaggagtacgtaggcttacgttacgaaccgaaatacaaattagttacgttacctttaacggtacggttaacccgaggaaccaaagggaaacccggccccggaccgggtacccgtaaccccggggtcccctttcggttacgtttccggtaactttaacctttagtttaaaaacgttaacgtttaccggtttacggaaggtacccggggtaccgttaaccggacccgggtaacccctagggtacgtacttaccgtttccgttaccggtaccgtcccgtaccacggttaccacggtaacgacccgtaaacaaccgtacgtccgtacgttcgaaacctgacgtcggggtaacgtcggggccgaggacggaaggtacggaacggtcttactttacgtattacgtcgaacgttntcctagtcgtaaacgacggtttagccgtacgtacctttacggtcgtttaaggacggttacggggttccggtaagggtaaccg

SEQ ID NO: 67323 - DNA, 677 bp, Homo sapiens
  misc_feature: GYAE6OF02I0LDS.49.73.G07.1.454.CMB.1.raw
  modified_base (194)..(194): a, c, t, g, unknown or other
  misc_feature (194)..(194): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (450)..(450): a, c, t, g, unknown or other
  misc_feature (450)..(450): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccctctcactctctgcacagactctgacggtccctctatggacncgtcgacacacgcccaccgtcggtgtctgtctcctgagacagaccgcctagtactcactgctcgnganacgtcgctagttcgaccaaacgtacaagttacgtcgtacttacgtacggtaccgtacgacgaaggaacgtccgtaacggccgaccggtccccgttagtccttatacgtacttaattaacgttaaacgtacggtttacgacggtacggtcgtacgaccggtacccgtaaggtacggtactacgttccgngtccgcctacgcgtactacgacacgaatacctaggtccgtacgtacgactactcggtacggtcgtaccggtcggacgaaggtacggtacggacgttaccgtacgtacctttaacggtcgtacgtacgttaacgtaccgaacgttaccggaagtaccgttaggtaacgttcccgtaacgtacgtttacgtacggttccggtaaacggtccgggtaaccggtaaccggg

SEQ ID NO: 67324 - DNA, 349 bp, Homo sapiens
  misc_feature: GYAE6OF02FJFMF.49.73.G07.1.454.CMB.1.raw
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (309)..(349): a, c, t, g, unknown or other
  misc_feature (309)..(349): n is a, c, g, or t
tcagagtcgagagacacgaccggtgctcgatttagctctacgctcagggcacgaccggtgctcgatttagctctacgctcagggcacgaccggtgctcgatttagctctacgctcagggtcgacgaccggtgctcgatttacgagagtagtggtgttgggtttggggggaacgaggaagacgtcgacggtcccccccaggacgttcgaggtagcgtcgggtccacacgccggccctgggctgcccgtggtcgaaggacctacttcctctctacgactcctgaggnggctggcaaggcgcagtagntncnnnnnnnnnnnnnnnnnnnnnnnnnnnnnnnnnnnnnnnnn

SEQ ID NO: 67325 - DNA, 728 bp, Homo sapiens
  misc_feature: GYAE6OF02JGHHX.49.73.G07.1.454.CMB.1.raw
  modified_base (119)..(119): a, c, t, g, unknown or other
  misc_feature (119)..(119): n is a, c, g, or t
  modified_base (151)..(151): a, c, t, g, unknown or other
  misc_feature (151)..(151): n is a, c, g, or t
tcagagtcgagagacacgaccggtgctcgatttagctctacgctcagggcacgaccggtgctcgtttagagagagtgtgttgggtttgggggtggtccagggaggcagaactctgggtntctcaccatggcctggactccctctacttccnccccctactcactctactgcacagactcgtagcggtcctcctatggacgtcctaggaccacacgcctacccgtgggtctcgtggtcgttcctacgaggtaccaggaccggcctagtacctccaccgtgccttcgtaggagtacgtcgacacgtttcgaccgtaagactaagtacgtcgtacttacgtcgtaccagccaagtaccgccgtaaggccacgtacccttggtacttcggaatacttagttaacgtaaaggtctttacgacggtaacggttcccagggtacccggaccgtagacgtcgttacgttacctgtaacgctacgtacgccgttacgaaccgcgaaacgtaaccgtcgttacccgtagtaccggtaactacgtacccggtagggaccggttaccggaccgggacggaagaaccggggaactacgggaaccgtcgtaaccgttacgttaaccgtcggtactaaccggttcgacgtaacgtacggtaccggtaagtacccggtaaggttacccttacgtttaccgttaacggttaacggttacccggttaagggtaccccgggaaacgg

SEQ ID NO: 67326 - DNA, 737 bp, Homo sapiens
  misc_feature: GYAE6OF02I6RHX.49.73.G07.1.454.CMB.1.raw
  modified_base (142)..(142): a, c, t, g, unknown or other
  misc_feature (142)..(142): n is a, c, g, or t
  modified_base (165)..(165): a, c, t, g, unknown or other
  misc_feature (165)..(165): n is a, c, g, or t
  modified_base (169)..(169): a, c, t, g, unknown or other
  misc_feature (169)..(169): n is a, c, g, or t
  modified_base (198)..(198): a, c, t, g, unknown or other
  misc_feature (198)..(198): n is a, c, g, or t
  modified_base (573)..(573): a, c, t, g, unknown or other
  misc_feature (573)..(573): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctcngcanagactctgagcctcctatgagctgaccanacgcccacccgttggtgtacctggtcgtccctacgaaggaccacggaccgggtcctaaggttactccgaaccttgacctacgtaggagatggactagttacggaacctaaagactaaattaagtcgtaactttacggtacgtaaccagtacgaacggaacgaccgacggccgtaaccgtcccgttgtcgttacgattacgtaaagtttaaactaaacgttacttagggacgtacggtcccgtaacggtacggaacccgtggtaaccgtcgtaactttccgacgttaccgtacgtaccgaacggtcctacgacgacgtaacaacgtacggtactacgttacaacgtatacgtacgggtacggtacgtaccgggtanaacgggtaacggacggtaacgaccttaacgttaagttaaccttacggtacgtaacgttacttacgacgttaacggaacggtaccggtaaaaggttacggtaacgttacgtacgtttacgttacggtaaccggtttacgggttaccgggaagggttaacccgggg

SEQ ID NO: 67327 - DNA, 714 bp, Homo sapiens
  misc_feature: GYAE6OF02GREYZ.49.73.G07.1.454.CMB.1.raw
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctcccccctctcactctctgcacagactctgaggcctctatgagctgacacacgcccacccgtcggtgtctgtcgtcctgaggacaggccgccagtactccaccgtgcctcgtggacgtatgactattcgaccaaagacaattagtcgtaccttacgtacggtaccagacgaaggaacgccgacggccgaccggtcccccttgtccgttagactacttaagtttaataaacgtcgtttagacggacgggtcctacggaccgggtaccccagacgtaccgtattccgtcgtcggtacctccgacgtcgtccgaacggaccgaaccaaaccgtcgtacctaccggttaccgaacccgtacgtaccgtacgggtacggtaccgggtccgggacgtaacggggacggaaccgtagggaccgttagtaaccgttaagtttaccgttagtaccgtaagttaccgacgttaacgtaaacgtaacggttaacgggttacggtaaccggtacgttaccgtttaccgggtttaccggttacgggtttaccggttaccggggaacgggttaacccggg

SEQ ID NO: 67328 - DNA, 837 bp, Homo sapiens
  misc_feature: GYAE6OF02FKY7B.49.73.G07.1.454.CMB.1.raw
  modified_base (142)..(142): a, c, t, g, unknown or other
  misc_feature (142)..(142): n is a, c, g, or t
  modified_base (191)..(191): a, c, t, g, unknown or other
  misc_feature (191)..(191): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctntacttctccccctctcactctctgcacagactctgagcctctatgacgntcgacacacgccacccgtcggtagttctgttacgtccctgaggacaacggaccggccaagttctaccaccgtgctactggagtatgactatttcgacctaaagacgaactaagtgtctttaacgtacggttaccgagactaagaacgccgaacggccaccgggccccttgtacttgtacctatatttaaacgtaagttacgtttacggaaggtacggtacccttaccggaaaccgggtaccccgtttaggaaccggtaccgttaaccgtttccttacggttacgtacctaccccgaacggttccgtaacgttaaccggaaccggtaaaccctaaacgtaacggtttaacccggtaaacggttttaaccgaacccgtaacgttacgtacgggtaacgggttacgggtaacccggggtccgaaagggtaaacccggggttaaccggtagggtaacccggttacggttaaacccgttttaaaccgttttacggtacgttaaacccgtttgggtaacccgtaagttaacccggaaacgtaaacggttaacggtttaaccggtttaccgggaaccgtttaccgtttacccggtttacgggttttaccggttttaacgggtttcccgggggaacgggtttaaaccccggggg

SEQ ID NO: 67329 - DNA, 796 bp, Homo sapiens
  misc_feature: GYAE6OF02HL6L9.49.73.G07.1.454.CMB.1.raw
  modified_base (118)..(118): a, c, t, g, unknown or other
  misc_feature (118)..(118): n is a, c, g, or t
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
tcagagtcgagagacacgaccggtgctcgatttagctctacgctcagggcacgaccggtgctcgtttagagagagtgtgttgggtttgggggtggtccaggaggcagaactctgggtntctcaccatggcctggatccctctacttcctccccctctcactctctgcacagactctgacgcctcctagtgacgctgacacacgcccacctcggtntcgtgtcgtcctcgaggacaggccgccagtactccacgtnctcgnggagtacngctacgttcgaacccgaaagactaaacttagtccgttacctttaacggtacggtacccaaggaccaaggaacctccggaacgggtaccctaccgggtccccttggttaccgttacgtacttaacgtttaaagttttaaagtaaaaccggtggttttaaggacggggtaccgggtccttaccgggaaaccgggtccctagacggtacttacgttcctcggttaccgaccttccgaacgtctacggacgtaccgaaccgtaaacgtccgtaacccgtacggtaccgttaacccaggttaaccggaggggttaccgggtacgggtacccgggtaacgaaacgggggtacccgggtaacggtaacccgggttagtaccgtttaaacgggtttaccgtttaaccggtacgttcggtaaccgttacgttaaccgggtaaccgtaacggtaaaccggttcggtaggttacccggtaaccgtttcggtttccggtacggttaggtttaacccgggtacccggggagggtaaccccg

SEQ ID NO: 67330 - DNA, 814 bp, Homo sapiens
  misc_feature: GYAE6OF02FPO8A.49.73.G07.1.454.CMB.1.raw
  modified_base (111)..(111): a, c, t, g, unknown or other
  misc_feature (111)..(111): n is a, c, g, or t
  modified_base (117)..(117): a, c, t, g, unknown or other
  misc_feature (117)..(117): n is a, c, g, or t
  modified_base (141)..(141): a, c, t, g, unknown or other
  misc_feature (141)..(141): n is a, c, g, or t
  modified_base (159)..(159): a, c, t, g, unknown or other
  misc_feature (159)..(159): n is a, c, g, or t
  modified_base (174)..(174): a, c, t, g, unknown or other
  misc_feature (174)..(174): n is a, c, g, or t
tcagagtcgagagacacgaccggtgctcgatttagctctacgctcagggcacgaccggtgctcgtttagagagagtgtgttgggttgggggtggtccaggaggcagaactntgggtntcttcaccatggcctggatccctntacgttctaccccctctnacgttctctgccaangactctgacgccctctagtcgagctacgactacgacggccctaacccgtgggttcttactaggttccgtcctagaaaggggtccccaaaggaaccgggttccccgtaaagtttaccgtaccgtaacccgtttcggaaccgttcgggtttacgggaacgtactttacgggacctacgtttaaccgaacccgaaaaggtcctaaaagttcgttccgttaaccttaacggtcggtaaccccgtaggaccgtaaggaacccgaccggtaacggtacccgacgggccccttttggtaccgtttacgtattaacgtttaaagtttaaacgtaaacgtttccgggtttagaaaccggttaccgggcccttaacggaccgggtaaccccttggaaccgtttcgttaacgtccgttcgtcgggtaccctcgtacgggttcacgtacggttacccaaacgtaaccttacgttaccgtaccgtacggtaacctacggttacggacggttagccgggttacggacttagggacgggacgtacgcgtttagacttaccgagttcgtatacgtactcggtaacgaacgtacgtaagtccgttactaccggtatttccggtacgttacggttcgggttaccggaggttaacccgg

SEQ ID NO: 67331 - DNA, 788 bp, Homo sapiens
  misc_feature: GYAE6OF02HE8B9.49.73.G07.1.454.CMB.1.raw
  modified_base (121)..(121): a, c, t, g, unknown or other
  misc_feature (121)..(121): n is a, c, g, or t
  modified_base (144)..(144): a, c, t, g, unknown or other
  misc_feature (144)..(144): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (718)..(718): a, c, t, g, unknown or other
  misc_feature (718)..(718): n is a, c, g, or t
  modified_base (753)..(753): a, c, t, g, unknown or other
  misc_feature (753)..(753): n is a, c, g, or t
tcagagtcgagagacacgaccggtgctcgatttagctctacgctcagggcacgaccggtgctcgtttagagagagtgtgttggggtttcgggggtgggtccaggaggcagaactctgggtntctcaccatggcctggatccctntacttcctcccctctcactctctgcacagactctgacggcctctatgacgctacgacacacgccctacccgtggtntctggtctcccngaggaccgaggaccggctaagtactccacctgcttcggtaggagatggactacgtacggtaaccaaaggtccaaattacgtacgtaccgtttaaccgtaacggtaaccgtaaggtaccgaaaacgggtaccggtaccgaccgggtacccgtaccggggttccccttggtttaccgttagacgtttacgttaaacgtttttaaacgtaaacgttaccggtttagggaacgggtaccgggtaccgtaccggaaccgggggtacccgtacgggtacggtaccggttacctttccggtaccggtacgggtcccttaccgggaacttccgtacgaaccggaccgaaactaacggtacggtaccgtacggtaccgtaacgtacgttaccggtacgggtaggggtaccgggtacccgggaggtaacgggaacgggacgacggtacggttagtaaccgtttaccttaggtcgaccgtacacgtactacggtaanaaccgtggtaacgggtcgtaccttggttccggttnttaaccggggttcggttaccgggacggtaacccgg

SEQ ID NO: 67332 - DNA, 602 bp, Homo sapiens
  misc_feature: GYAE6OF02GGAIA.49.73.G07.1.454.CMB.1.raw
  modified_base (141)..(141): a, c, t, g, unknown or other
  misc_feature (141)..(141): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
  modified_base (476)..(476): a, c, t, g, unknown or other
  misc_feature (476)..(476): n is a, c, g, or t
  modified_base (519)..(519): a, c, t, g, unknown or other
  misc_feature (519)..(519): n is a, c, g, or t
tcagagtcgagagacacgaccggtgctcgatttagctctacgctcagggcacgaccggtgctcgtttagagagagtgtgttgggtttgggggtggtccaggaggcagaactctgggtgtctcaccatggcctggatccctntacttctccccctctcactctctgcacagactctgaggcctctatgagctgacacagcccacccgtggtgtctgttgtccctcgaggacagggaccggcctaggtatccaccttgcctcgtggacgtatcgctattcgacctaaagcaatacgtgcttactggtaccagcgagaacgtccgacggccacggtcccctgtacgtttgacttctaatttagtaaagtacgtttgaggacgggcctacgacggacccctgagcgtattctcnggtcctacngtctcgagtcgacaacngttacacgttcgaacntacgtagtcggacgtccgggacgngggtaacggcgaggaccttcggaacttacgtacgtacgttacncgtactacggtacaaggtaccgtaggtaacgttcggtaactcgttaggttcgtaacggtttcggtccgggtagggtaaccggg

SEQ ID NO: 67333 - DNA, 757 bp, Homo sapiens
  misc_feature: GYAE6OF02G9HZK.49.73.G07.1.454.CMB.1.raw
  modified_base (624)..(624): a, c, t, g, unknown or other
  misc_feature (624)..(624): n is a, c, g, or t
tcagagtcgagagacacgaccggtgctcgatttagctctacgctcagggtcacgaccggtgctcgtttagagagagtgtgttgggtttggggtgggtccaggagcagaactcgtgggtgtctcaccatggccctggactccctctacttcgtcccctcctcactctctgcacagtactcgtgaggcctcctagtggagtctacgacacgacgtccctacccgttgggtcgtctggtcgtcctcgaggacaggaccgctacgtcttaccgacctcggtcctcgtagggtactacgtcgtaccgtacgtttacggaacccctaaagtacgtaattaacgtccgttaaccgtttaccggtccgggtaaacctacggtaacgaacggtaaccggtaccggaaccgggtccccgaaccggttacccccgttggttacgttctaacgttacttaacgtttaaagtaaacgttcgttaggacggtaaccggtaccgtacggaccggtacccgtagtacggtacgtactttcgcgtcggtacctccgtactcgtacgacggtacaaccacgtacgtacggtacgtacgactcgtacgacgtggtaccgcgggtacagggtacgcggtaccgngtaccgttagtaccgttacgtcgtaccttagaccgtctaacggtacggtaaacggtaacggttacgttaccgtacgttaacccggttccgttaccggacggttttaccggttaccgggacgggttaacccggg

SEQ ID NO: 67334 - DNA, 788 bp, Homo sapiens
  misc_feature: GYAE6OF02GH59V.49.73.G07.1.454.CMB.1.raw
  modified_base (283)..(283): a, c, t, g, unknown or other
  misc_feature (283)..(283): n is a, c, g, or t
tcagagtcgagagacacgaccggtgctcgatttagctctacgctcagggcacgaccgatgctcgtttagagagagtgtgttgggtttgggggtgggtccagggaggcagaactctgggtgtctcacataggcctggactccctctacttcctccccctcctcactctctgcacagactctagagcctcctaatgagctagacacacgccgaccttggtcgtcgtgtcgtcctagacggacacggaccggtccaagtactaccaccgtggcctacgtggaagtntacgactaagttacgaacctaaagactaattagtcgtactttacgtacggtaccagaacagaacgtaccgacggaccgtaccggcccttagtaccgttagtaactaacgttaaacgttttaacgaaaacgtttacgttacggtaacgggaaccggtcctaaccgggaaccgggtaaccccgttaggaccggttaacgttaaccgttccgttaccgggtaccgtacccgtaccgtaaccggttacaccggtaaccggaaccgtaaacccgaacggttaccgttacccgtaacgggtttaaccaaaccgttacgtacggtaacgggtggtaaaccgggccgggtaacggaagggtaaccgggaccgtacggtaaccgttagtaaacttacgttacgtacgtacgtacgtacgtaacgtaccggtaactaacgggagtttaccggacggttaacctttccggttacggtttacgggtaaccggtttacgggtaccgggtaacccgggg

SEQ ID NO: 67335 - DNA, 722 bp, Homo sapiens
  misc_feature: GYAE6OF02GPZA6.49.73.G07.1.454.CMB.1.raw
  modified_base (311)..(311): a, c, t, g, unknown or other
  misc_feature (311)..(311): n is a, c, g, or t
  modified_base (655)..(655): a, c, t, g, unknown or other
  misc_feature (655)..(655): n is a, c, g, or t
tcagagtcgagagacacgaccggtgctcgatttagctctacgctcagggcacgaccggtgctcgtttagagagagtgtgtgggtttgggggtgggtccaggaggcagaactctgggtgtctcaccatggcctggactccctctacttcctccccctcctcactcctctcgcacacgactctgacggccctcctatgacgctcgaccacgacgccctacccgtcggtgtccgtgtcggtcctcgacgacacggaccgccagtactcgacctgtctcgtaggtcgatacgactagttcgaactaagactaatntacgctttaacggtacggtaccagacgacgtacggacgacggccgtaaccggtcccgttgttaccggttaggttacgtaaagttttaacgtaaacgttacgttacggaacggtaccggtcccgttacggaaccgggtaaccctggtacgtacgtcgtttacctcgtaccgtccgtaccgtacgtaccgtaacgggtaaccggaacgtaacccgttagaccgtttacccgtagaccctaagtcgtagggtacggtccggacccgtacggtaacgggacgggacgtacggtacgtacgttaacttacgttaacgtcgtacctaacgggtcgacctacggacgtacnccgggttagcgtaacggtattaccggtcggttaacgttcggtaccggagggttacgaccgttaccgg

SEQ ID NO: 67336 - DNA, 750 bp, Homo sapiens
  misc_feature: GYAE6OF02IRST2.49.73.G07.1.454.CMB.1.raw
tcagagtcgagagacacgaccggtgctcgatttagctctacgctcagggcacgaccggtgctcgtttagagagagtgtgttgggttgggggtggtcaggaggcagaactcgtgggtgtctcaccatggcctggatccctctacttcctccccctctcactctctgcacagactcgtgacggcctctagtgagctgaccacgacgcccaccgtggtctcgtgtcgtcctacgaggaacacggaaccggccaaaggttactcctacccgtggtcctttacggaggtaagagtcggacctagttacgaaacccgaaaaggtacctaaaattgtacggttaccttaacggtaggtaacccgagtacaacgacgaccgacgaccgacgtccccgtagtcctagaatacgttaaattaagtaaaacgtacgtttgaaacggacgggtacctacggtaaccgggaccctaggacgaccgtaatttcgtaccggtacgtaccaccgtaagtaccgtcgaaacgccgaaactaaacgactaccgaacgtttacgaccgtaactacgtaacgggtacggtaacggtaccgggagaacggtaaagggacgtacgggtacctacgttaaacctaagtttacgacgttacgtaagtaccgtacttaaccgaagggttaaactacgggttaagttccgggtaacttaccggtttacggttaccggtttaacgggttaacggtacccggggtacgggaaaccggg

SEQ ID NO: 67337 - DNA, 226 bp, Homo sapiens
  misc_feature: GYAE6OF02F5R5J.49.73.G07.1.454.CMB.1.raw
  modified_base (210)..(226): a, c, t, g, unknown or other
  misc_feature (210)..(226): n is a, c, g, or t
tcagagtcgagagacacgaccggtgctcgatttagctctacgctcagggcacgaccggtgctcgatttagagagagtgtgttgggtttgggggaagaggaagactgacggtccccccaggagttcaggtgctgggcacagccggccctgggcctgcctggtcaaggactacttcctctctcgactctgagcggctggacaggcgcatagnnnnnnnnnnnnnnnnn

SEQ ID NO: 67338 - DNA, 790 bp, Homo sapiens
  misc_feature: GYAE6OF02IH239.49.73.G07.1.454.CMB.1.raw
  modified_base (119)..(119): a, c, t, g, unknown or other
  misc_feature (119)..(119): n is a, c, g, or t
  modified_base (311)..(311): a, c, t, g, unknown or other
  misc_feature (311)..(311): n is a, c, g, or t
  modified_base (701)..(701): a, c, t, g, unknown or other
  misc_feature (701)..(701): n is a, c, g, or t
tcagagtcgagagacacgaccggtgctcgatttagctctacgctcagggcacgaccggtgctcgtttagagagagtgtgttgggtttgggggtgggtccaggaggcagaactctgggtntctcaccatggcctggatccctctacttcctccccctctcactctctgcacagactcgtgacggcctcctatgagctgacacacgccacccgtggtctctggtcgtccctagacggacgacggaccggacctagtaactccaccgtgtcctaggtaggagtaactcggacttagttaccgaaccgaaaagtntaaaacttagtacgttaccttaccggtacggtaaaccgacggaacgaacggtaccggaaccctcgggaaccccgtacccgggttaccccgttgttaccgtttagaaccgtttacttaaaacggttttaaactaaacggttttcggtttaaacgggaaaccggggtcccgggttaaccctaccgggggtaaacccgtaccccgtaaggtaccggttacttacgttaccggtccgtacggtccctacgcgtactacgacgaacgaaacgtaccgaggttaccgtaccgttaacgaacctgtacgtacgggttagggcccggaaccgggaaggtacggaaacggggtacgtacccggtaagtacgttaccgtttaacgtaccgtgtaccgttntaacgggtacctagaacccggtactgggtacgttaccgtcgttaaccgttggtaccccggttagttacggtaccgggaccggtaaccgg

SEQ ID NO: 67339 - DNA, 802 bp, Homo sapiens
  misc_feature: GYAE6OF02JU239.49.73.G07.1.454.CMB.1.raw
  modified_base (143)..(143): a, c, t, g, unknown or other
  misc_feature (143)..(143): n is a, c, g, or t
  modified_base (291)..(291): a, c, t, g, unknown or other
  misc_feature (291)..(291): n is a, c, g, or t
  modified_base (338)..(338): a, c, t, g, unknown or other
  misc_feature (338)..(338): n is a, c, g, or t
  modified_base (583)..(583): a, c, t, g, unknown or other
  misc_feature (583)..(583): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatcggcctggatccctntacttcctccccctctcactctctgcacagactctagcgcctcctatgagctagaccacacgcccacccgtcgggtctctcggtcgttccctgaacggaccgacggaccggcccgtaagtactccgacctgccgttcgagggacgtancgctcgttacgaccgaaagacctaatatcgtacttacgtcgtaaccnggacaacgaacggacgaccgggacccgtaccggtccccgtgtacgttacgtactacttaagttaaacttaagtacggtttacggaacggttccgggtacccgtacggtaccggtacccgtggaacgtacgtcgttccgttccggtggtaccctacgtacgtaccgtaccgacgtaccgaacgtaaccgttacgaccgttacggtccgttaaccgtactccgggtacggtacgggttaaccggggngggaccgggaaaggggtaccccggtaacggggtaacggttaaccgtaccggtttaaccgttacggtttacccggtaccgtttaacgtacgttaaccgttacggttaccggaaacggtttaaccggtaacgggttaaccgtacccgggttaaggtttcccgttacgggttaacggttttcccggggtaaggggtaccccgggtaccgggggttaaaccgg

SEQ ID NO: 67340 - DNA, 785 bp, Homo sapiens
  misc_feature: GYAE6OF02F7WZU.49.73.G07.1.454.CMB.1.raw
  modified_base (144)..(144): a, c, t, g, unknown or other
  misc_feature (144)..(144): n is a, c, g, or t
tcagagtcgagagacacgaccggtgctcgatttagctctacgctcagggcacgaccggtgctcgtttagagagagtgtgttggggtttgggggtgggtccaggaggcagaactctggggtgtctcaccatggcctggatccctntacttctccccctctcactctctgcacagactctgaggcctctatgagctcgactacgacgcccacccgttggtcgtactgtcgtcctcgaaggcacgaccggcctagtactccgacctgacctcgtggacgatcggctagttacggacctaaagctaaagttacttcggtacctttaaccgtcgggttaacccaggaccgaacggaacggacccgaaccgggacccccacggggtccccctttaggttaccgtttacggtacttacctttaacgttttaaacgtaaaaggttccgttttagggaacggtacgggggtacccttaccggaaccgggtaccccgtgggacgtaccggttactttccgtcgttacgtccgtaccgcgtaccttacgacgaccgaacctaacgtacgttaccgtacggtcgtaacctagttaccgaagggttccggtacgggtaccgggacgtaacgggtacgggacgggtagtacccggtagttaaccgtttaacgttaccggacgttaaccggtactttacgacgttaacggaacggttaacgtaagggttaccggttcggttaaccgttactttccggtttacggttaccggtttcgggttaccgggacgggtaacccggg

SEQ ID NO: 67341 - DNA, 701 bp, Homo sapiens
  misc_feature: GYAE6OF02H309P.49.73.G07.1.454.CMB.1.raw
  modified_base (171)..(171): a, c, t, g, unknown or other
  misc_feature (171)..(171): n is a, c, g, or t
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
  modified_base (578)..(578): a, c, t, g, unknown or other
  misc_feature (578)..(578): n is a, c, g, or t
tcagagtcgagagacacgaccggtgctcgatttagctctacgctcagggcacgaccggtgctcgtttagagagagtgtgttgggtttgggggtgggtccaggaggcagaacctctgggtgtctcaccatggcctggactccctctaccttcctcccccctctcactcctcngcacagctctgagcccttctatgactcgntaccacgcgcccncccgttcggtctaccgtgtcggttccctacgaggtaccagggaaccggtcctaaggttacctccaccgttgccttcgtaggacgtaacgtcgtacctagtttaacggaccaaagacttaaccgtaggttcctaacctttcgtaaccgggtaacacgtagaaggactacccgaacgggtcacccggtcccctgttaccgtaagtactaacgttaattaaaccgttagtccgtttaggacggtaccgtaccgtacggaacccgggttccagtaacgcttacgttacctcggngtctacncgctcgacgaacgtacaactgtacgtcgacgtccgtcacggtgacgtaggccgggtacgaggacggancggtacgtacgtaagttacgtccttaagctaccgttagacctttacggaactagggtacgttaacttccggacgtttaccgttcgtaacgtttaccgggtagttccgggaccgggtaaaccgg

SEQ ID NO: 67342 - DNA, 621 bp, Homo sapiens
  misc_feature: GYAE6OF02IG7P2.49.73.G07.1.454.CMB.1.raw
  modified_base (122)..(122): a, c, t, g, unknown or other
  misc_feature (122)..(122): n is a, c, g, or t
  modified_base (230)..(230): a, c, t, g, unknown or other
  misc_feature (230)..(230): n is a, c, g, or t
  modified_base (376)..(376): a, c, t, g, unknown or other
  misc_feature (376)..(376): n is a, c, g, or t
  modified_base (417)..(417): a, c, t, g, unknown or other
  misc_feature (417)..(417): n is a, c, g, or t
  modified_base (441)..(441): a, c, t, g, unknown or other
  misc_feature (441)..(441): n is a, c, g, or t
  modified_base (612)..(612): a, c, t, g, unknown or other
  misc_feature (612)..(612): n is a, c, g, or t
tcagagtcgagagacacgaccggtgctcgatttagctctacgctcagggcacgaccggtgctcgtttagagagagtgtgttggggtttgggggtgggtccaggaggcagaacctcgtgggtntctcaaccatggcctggactccctctacttcctccccctctcactctctgccacagactcgtgacggccctcctatgagcctagaccacgacgccctacccgttggtntctgtcgtaccctgaggacaggaccgtcagttactcacctgctacgtggagatgctaagtcgaaccaaagtctaatagtcgtacttacgtacgtaccagaccgaagacgcgacgccgacggtcccctgtactgatactaagtttanaaagtcttggaaggtcgccgacgtaaccggccctgagcgtnttcgacgttgcctcgaagtcctanaccggctaaaccacgtagtccgtacgttacgacctaatccggtaaggtcgtaccgggccggaggtaccgaaggaccgggagtacgtccgttaaagttacgtaccgtgtaccgtagtaccgtaatcgaacgacgtggtacgtacggcttactcgttgtaccgtaggtccggnggtaaaccg

SEQ ID NO: 67343 - DNA, 691 bp, Homo sapiens
  misc_feature: GYAE6OF02G5JQ3.49.73.G07.1.454.CMB.1.raw
  modified_base (119)..(119): a, c, t, g, unknown or other
  misc_feature (119)..(119): n is a, c, g, or t
  modified_base (175)..(175): a, c, t, g, unknown or other
  misc_feature (175)..(175): n is a, c, g, or t
tcagagtcgagagacacgaccggtgctcgatttagctctacgctcagggcacgaccggtgctcgtttagagagagtgtgttggggttgggggtgggtccaggaggcagaactctgggtntctcacatggcctggatcctctacttcctcccctctcactctctgacacagactcnggacgcctccgtatggagctgaacacgacgcccacccgttggtgtcctgtcgtcctacggagacacggaccgactaagtactccgacctgctcgaggacagtcgactatcgaaccaaagctaaagtcacgtacttaccgaggtaaccagacgaacgaacggccgaggccacggtcccctgtctacgacttacttaagttaaactaagttcgttaagacggtacggccctaacggcggtaaccctgggactacgtacgtccgttcgacgtccgtaccgtcgaccgttacgacggacctaaacgtacgtaaccgttaacgtacccgggttaactaaccctaacggttacgaaccgggtacggtaccggtaccgggaacggtaacgggacgggaaccggtacgacgtacggttaacttacgtacgttacgacgtagtcgacgttaccgaagttaccgtagtacgttaccgtacgttaccgttacgttcgttacggtacggttaccgggaggtaacccgg

SEQ ID NO: 67344 - DNA, 877 bp, Homo sapiens
  misc_feature: GYAE6OF02HOMAF.49.73.G07.1.454.CMB.1.raw
  modified_base (213)..(213): a, c, t, g, unknown or other
  misc_feature (213)..(213): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccatggcctggatccctctacttctccccctcctcactctctgcacagactctgaggcctcctatgagctgacacagcccacctcggtntctgtcgtcctcgaggacagaccggccagtatcacctgctcgtggagagtgctattcgaaccaaagactaaattagtacgtacctttaacgtacggttacccaggaccgaaggaaaccgcccgaacgggaccccgaccgggtcccccttgttaccttaggtacttaccttaaattttaaacgtaaaacgttacgttttagggaacggtaacggggtacccgttaccggaacccggggtaacccccgtagggtaccgggtaccggttaaccgtttaccgtttaccggttaccgggtacccgttaccccgtaacggtacccgttaccgaaccggtaacccgaaaccgtaaaccgttacggttaacccggtaacggtttaccgaaacccgttaacgttaccggttaacggggtacggggttaccgggtacccgggggtaacgaaacggggtaacggggaaccgggtacggggtaccgttaacggttaaccgtttaacggtttaaccgtaccgggtttaccgtaacgttacccgttaacgttaaccggtaaacgtaaccggttaaagggttaccgggttaccgggtaaccctttacccggttttacggtttaccgggtttaccgggtttaccggggtttaccgggggtaacccggggtaaacccgggg

SEQ ID NO: 67345 - DNA, 832 bp, Homo sapiens
  misc_feature: GYAE6OF02GYBQR.49.73.G07.1.454.CMB.1.raw
  modified_base (117)..(117): a, c, t, g, unknown or other
  misc_feature (117)..(117): n is a, c, g, or t
  modified_base (141)..(141): a, c, t, g, unknown or other
  misc_feature (141)..(141): n is a, c, g, or t
  modified_base (169)..(169): a, c, t, g, unknown or other
  misc_feature (169)..(169): n is a, c, g, or t
  modified_base (229)..(229): a, c, t, g, unknown or other
  misc_feature (229)..(229): n is a, c, g, or t
  modified_base (286)..(286): a, c, t, g, unknown or other
  misc_feature (286)..(286): n is a, c, g, or t
tcagagtcgagagacacgaccggtgctcgatttagctctacgctcagggcacgaccggtgctcgtttagagagagtgtgttgggtttggggtggtccaggaggcagaactctgggtntctcaccatggcctggatcccctntacttcctccccctctcactctctgcanacgactcgtggacggtcctcctatggagtctgaccacgacgtccctaccccgttgggttntccgttcgtcgttcccgtacgaacgggactaacggtacccggacctaaggtttaacnccgaaccgttggtccgttcggtacgggaagtacgtcgtaccgttaacgttccggaaacctaaaacggactaaaattacgtaacgttaccgtttaccggtaacgggttaacccaaggtaaccaaacgggtaaccggtacccggtaccgggaccccgtaacccgggttcccccgtttagttaccgttaacgtacgttaacttaagtttttaaacgtaaacgttccgtttagggaacgggtaccggtcccgtaaccgggtaaccggtacccgttgaccggtacgtacgtttccgcgttaccgccttaccgtacgtcgacgtacgaccgtaaccaacgtacgtcgtacgtacgaaccgtagttacggacggtcgggaccggtacggacggaacggacggtacggagtacgtaaccgttaccgttaagttaccgtacggtacgtaacgttacgtaacggtacgtaacggtaaggttaccgttagggtacccgttacttaccggtttcgttaccggttaacggttaccgggtaccgggtacgggttaaccgg

SEQ ID NO: 67346 - DNA, 752 bp, Homo sapiens
  misc_feature: GYAE6OF02FZRRR.49.73.G07.1.454.CMB.1.raw
  modified_base (166)..(166): a, c, t, g, unknown or other
  misc_feature (166)..(166): n is a, c, g, or t
  modified_base (564)..(564): a, c, t, g, unknown or other
  misc_feature (564)..(564): n is a, c, g, or t
tcagagtcgagagacacgaccggtgctcgatttagctctacgctcagggcacgaccggtgctcgtttagagagagtgtgttgggtttgggggtgggtccaggaggcagaactctgggtgtctcaccagtggcctggatccctctacttcctccccctctcactctntgcacagactctgagcctctatgagctggacacacgccacccgtcggtgtctggtctcctacgaggtacacggacgtccatataccactcggcttcgtaggatatcgactagttcgaaccgaaaacgactaaattacgtagtaccgttttacgtacggtaaccacgtacgaaacggaacgcccgaaacgggccctaaccgggtcccccttagttaccttagtacttacttaaacgttttaagtaaacgttacggttacgacgggtaccgggtaccctacgggaaccgggtaccccgtaggaccggtacgtaactttccgtacgtaccgtcccgtaaccgtcggtacctcgaacgaccgtaaaccgtaacgtaaccggtctaaccggttacggaaaccncggttaacggtagggtaacggggtaccgggtccggaacggtacggaaaggaccggacgtacgtacgttacttaacgtacgttacggtaccgtagttacccagtacgtaacgtaaggttacggtagtaccgtacttaccgtttaccggtggttaacccggttcggttaccggggaccgggtaaacccgg

SEQ ID NO: 67347 - DNA, 777 bp, Homo sapiens
  misc_feature: GYAE6OF02HE56N.49.73.G07.1.454.CMB.1.raw
  modified_base (123)..(123): a, c, t, g, unknown or other
  misc_feature (123)..(123): n is a, c, g, or t
tcagagtcgagagacacgaccggtgctcgatttagctctacgctcagggcacgaccggtgctcgtttagagagagtgtggttggggtttgggggtgggtccaggaggcagaactcgtggggtntctcacatcggctggactccctctacttcctccccctcctcacctctctgcacacgactctgacggtcctcctatgatcgtagaccacgacgcccaccgtcgggtcgtcgtgtacgtccgtaacgaggacgacgaccggtaccgtaattaccgtacccgtccgttccgttacgtacgtagggaacgtacgtaggtacctagtttccgaaaccgaaaaacggaacttaataacgttataccgttaacggtacggtaacccaggaccgaaacgaaccaccggacccgtacccgtaaccgtcccttcggttctaacggtacttccggttaaatttaaaggtaaacgttgtttaggaaaccgggtcggtacccgtaacgggtaccgtaccccgttagacgttaccgtactttccgtttaccgtcgtaccgtccgacggtctaacgaacgacccgtaacgaaacgtaccgtacggtaacgtcgacctaaggttcgaacggtcgggaccggtccgggaagtaagggacggtacggtaggacctacgtttacgtacttacgtcgtaactcggaacttgtaacgaacggtacctaggtacggtaccggtatttaccggtcggttacgttcggttacggttaacccgggacggtaaacccggg

SEQ ID NO: 67348 - DNA, 804 bp, Homo sapiens
  misc_feature: GYAE6OF02J08UQ.49.73.G07.1.454.CMB.1.raw
  modified_base (151)..(151): a, c, t, g, unknown or other
  misc_feature (151)..(151): n is a, c, g, or t
  modified_base (178)..(178): a, c, t, g, unknown or other
  misc_feature (178)..(178): n is a, c, g, or t
tcagagtcgagagacacgaccggtgctcgatttagctctacgctcagggcacgaccggtgctcgtttagagagagtgtgttgggtttgggggtgggtccaggaggcagaactctggggtgtctcaccatggcctggatccctctacttccnccccctctcactctctgcacagactcngacggccctctagtcgagtccgtagaccacgacgacccgtacccgttcgggtgttccgtggtcttacccgtacgaacgggacaacgggccgggcctaaggtactccgacctggtcctcggtaggacgtagtcgtactaagttacggaaccgtaaagacctaattacggtcgtaacgtttaacggtacggtaaccaggactaaacggggaaccgtaccgtacgggaccccgtaaccgggttccccgttggttaccgtaaggtaacctttaaccgtttaaaagttttaaaccggaaacgtttcgttaaacgggaaccgggttacgggtaccccttacggggaaccgggtaccccgtaggaacgttcggttcgtttaccgtttcggtacggaccctaccgtacggttaccgaaccgtacgaacggtaacctaaacgttacggtaccgttaacggtaccgactaacggtggttaacgggtacggacggggtacccgaagggacgggagacgggtaccgaccggttacttaaacgttcgtaccgtacgtaccgtaccggtcaacggtacgaacgacggcggtaggtaccgagtacgtttcgacgttacggtacggttccgggaggtaaccg

SEQ ID NO: 67349 - DNA, 526 bp, Homo sapiens
  misc_feature: GYAE6OF01CV8PG.26.70.G04.1.454.CMB.1.raw
  modified_base (521)..(521): a, c, t, g, unknown or other
  misc_feature (521)..(521): n is a, c, g, or t
tcagagactatactcacgaccggtgctcgatttagtgtagtgtgaagggaaaggggaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgtatttttagcctggtttcagcagaaaccagggaaacgcccccaagtccctgatctatgctgcgtccactttagaggtggacgtccatcaaggttcagcggcagtggatcgtgggacagagttcactctcaacatcagcagcctgcagcctgaggtattttgactaactttatactgccagactagtataatgtaacttaccctatccgtacccgtcgggaccggggtacacgggtactacgggaaaacctaaacggaacttggtacggctagccaaccgtnttccg

SEQ ID NO: 67350 - DNA, 501 bp, Homo sapiens
  misc_feature: GYAE6OF01E09HS.26.70.G04.1.454.CMB.1.raw
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
  modified_base (485)..(485): a, c, t, g, unknown or other
  misc_feature (485)..(485): n is a, c, g, or t
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatgacccagtcgccatcctcactgtctgcctctgtaggagacagagtcaccatcacttgtcgggcgagtcagggcattagcgtatttttagcctggtttcagcagaaaccagggaaagcccccaagtccctgatctatgctgcgtccactttagaaggtggagtcccatcaaggttcagcggcagtggatcgtgggacagagttcactctcaacatcagcagcctgcagtcngaanattgngctaatttatactgtcagcaatataatcctggccctccgctcactttcgggacggagggaccaagggttgaagtatacaaaacggtactggtggctgcacctntctgtcttcattcccg

SEQ ID NO: 67351 - DNA, 505 bp, Homo sapiens
  misc_feature: GYAE6OF01A9FMV.26.70.G04.1.454.CMB.1.raw
  modified_base (260)..(260): a, c, t, g, unknown or other
  misc_feature (260)..(260): n is a, c, g, or t
  modified_base (488)..(488): a, c, t, g, unknown or other
  misc_feature (488)..(488): n is a, c, g, or t
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatgacccagtcgccatcctcactgtctgcctctgtaggagacagagtcaccatcacttgtcgggcgagtcagggcattagcgtatttttagcctggtttcagcagaaaccagggaaacnccccaagtccctgatctatgctgcgtccactttagaaggtggagtcccatcaaggttcagcggcagtggatcgtgggacagagttcactctcaacatcagcagcctgcagcctgaggtatttgctagtctattactgtcagcaatattaattactggtcttcgttcgtttcggggacgggggtaccaggtcgtggagactcgaaccgaacgtgtggctgcaccatctntcttcactcctcccgac

SEQ ID NO: 67352 - DNA, 539 bp, Homo sapiens
  misc_feature: GYAE6OF01C6UDO.26.70.G04.1.454.CMB.1.raw
  modified_base (277)..(277): a, c, t, g, unknown or other
  misc_feature (277)..(277): n is a, c, g, or t
tcagagactatactcacgaccggtgctcgatttagtgtagtgtgaagggaaaggggaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaacncccccaagtccctgatctatgctgctcctagttagaggtggtagtcccatcaaggttcagcggcaggtggatcgtgggacaggtagttcactctacaactactcagcacgcctgcacgccgtggagggttattttcggacctaactttacttactcgaccagctagtaataatcgtacttaccctatcctaccgttccgggaccggggacgacggtcgtaacggaaacctaacgaactggtcgctacgctaccgtgttaccg

SEQ ID NO: 67353 - DNA, 526 bp, Homo sapiens
  misc_feature: GYAE6OF01B6R80.26.70.G04.1.454.CMB.1.raw
  modified_base (282)..(282): a, c, t, g, unknown or other
  misc_feature (282)..(282): n is a, c, g, or t
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagagactatactcacgaccggtgctcgatttagtgtagtgtgaagggaaaggggaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttggtcgggcgagtcagggcattagcgtattttttagccttggtttcagcaagaaaccgagggaaacncccccaagtccctgatctatgctgctcactttagagtgagtccatcaagtcagcgcagtgatcgtgggacagtagttcactctacaacatcagcagcctgcagcctaggacgttntttcgacttaactttattacngccagctaatataatntacttaccatccgtaccgttcgggacccggggactaccgggtctaacgggtaaaacctaacggtaacttcgtacggctagcctacgtagtcg

SEQ ID NO: 67354 - DNA, 563 bp, Homo sapiens
  misc_feature: GYAE6OF01C45B0.26.70.G04.1.454.CMB.1.raw
tcagagactatactcacgaccggtgctcgatttagtgtagtgtgaagggaaagggtaatcattatactgctggcagtaataagttgcaaaatcctcaggctcctgctgctctgttttcccaggtgccagatgtgacatccagatgacccagtcgccatcctcactgtctgcctctgtaggagacagagtcaccatcacttgtcgggcgagtcagggcattagcgtatttttagccttggtttcagcagaaaccagggaaacgcccccaagtccctgactctatgctgcgtccacgtttagaggtggacgtccatcaaggttcagcggcaggtgatcgtgggacaggagttcactctacaacatcagcagctgctagtctagtaagtagtttgtacttagtttattacttgtactagactaagtaataaaacgtcggccgttccggtacggtaccggttccggaccgtaacgggaccgtaagggtacggaataacgaaacgtaacgtggtaggcgtcgacctacctactcgttcgttcttcctacttcccttcccgcctatacg

SEQ ID NO: 67355 - DNA, 632 bp, Homo sapiens
  misc_feature: GYAE6OF01BALZX.26.70.G04.1.454.CMB.1.raw
  modified_base (95)..(96): a, c, t, g, unknown or other
  misc_feature (95)..(96): n is a, c, g, or t
  modified_base (358)..(358): a, c, t, g, unknown or other
  misc_feature (358)..(358): n is a, c, g, or t
tcagagactatactcacgaccggtgctcgatttagtgtagtgtgaagggaaagggtaatcattatactgcgggcagtaataagttgcaaaatccnngctcctgctgctctcgtttccctaggtgccagatgtgacatccagatgacccagtcgccatcctcactgtctgcctctgtaggagacagagtcaccatcacttgtcggcgagtcagggcattagcgtattttttagccgttggttttcagcaagaaaccgagggaaacgcccccgaagtccctgaatctatcgctgccgtcacgtttagaacgggtggacgttcccaagtctaacggttcacggtcggctaggtggactcgngggacaagagttcgactctacaactacgtcagaccacgtccttgaccacgccgtaggtaggtactttttcgactaaactttacgttaaccgtgaccctaggtactaagttagtaaattcgtaactttaacccttatacccgtaacccggtttcgggaccccgggggtactaccgggtcctaagggaaaacccttaacgtaacgtacggttcggacgttacgctacccgattcctagttccttacacgttcccctttaccgccttactcgttacg

SEQ ID NO: 67356 - DNA, 744 bp, Homo sapiens
  misc_feature: GYAE6OF01D7DRD.26.70.G04.1.454.CMB.1.raw
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatgacccagtcgccatcctcactgtctgcctctgtaggagacagagtcaccatcacttgtcgggcgagtcgagggcattagcgtatttttagccttggtttcagcaagaaaccagggaaacgcccccaagtccctgactctatgctcgccgtcctaacgtttaggaaggtggactccagtctaaggttcaggcggacaggtgagtcgtgggacagtacgttcacgtctacgaatactacgagtaccacggcccttaggaccacggtcccgttaggggtaacggtttacgttttttacggtaacctttaacgttttttaactttaaccgttcggtaaccgtaacggtccgtaacgggtacgttaacggtaacctaaccggttcgggttacccttcccttacggttacccggttttaccgggggaccggggtaaccggggtaacccgggtaggggggttacggtaacggtaacgttacccggaaacgggttaaacccggtaacggtttacggggtacgggtacccgttacccgggaaccgtaaacccccgttaggtttccgtttaccgggttttacccctttctaacccggttttacccccccgg

SEQ ID NO: 67357 - DNA, 689 bp, Homo sapiens
  misc_feature: GYAE6OF01B29SZ.26.70.G04.1.454.CMB.1.raw
  modified_base (683)..(683): a, c, t, g, unknown or other
  misc_feature (683)..(683): n is a, c, g, or t
tcagagactatactcacgaccggtgctcgatttagtgtagtgtgaagggaaagggtaatcattatactgctggcagtaataagttgacaaaatcctcaggctcctgctgctcttgtttcccaggtgccagatgtgacatccagatcgacccagtcgccatcctcactgtctgcctctggtaggagacagagtcaccatctacgttggtcgggcgagtcgagggctagttagtcgttattttttacgccgttggtttacagtacaacgaaaccgaacgggaaacccgccccaaagtccctagactacctatcgtcgttcgccgttacctacgttttaaggaacggttcggtacgtcccaagttaccgaaggttccgaacggcggacgtaaggtggtactacggtagggaactagtaactctacctctacctaccagtaccgaggtcccggtacttacgacgttcgtaggaaccgtaccgttcgtacgtaactaaacgtttactaaccgtacgaaccctaaaataacgttattagtaactttaacttttactcctaccgtaacggtccggttaccgggaccgggtaaacgggtacgtaaagggtcggtaacgtacgaacggtacgtaacgtcggtaggcctagaccgactgtaccgttcgttactacttacccttccgtccccgnttaacg

SEQ ID NO: 67358 - DNA, 739 bp, Homo sapiens
  misc_feature: GYAE6OF01C26VP.26.70.G04.1.454.CMB.1.raw
  modified_base (185)..(185): a, c, t, g, unknown or other
  misc_feature (185)..(185): n is a, c, g, or t
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatgacccagtcgccatcctcacttgtctcgcctcgtagtagganacgagacgtcaccatctacgttggcgggcgagtcgagggtcagttagtacgttatttttacgccttggtttcagacaacggaaaaccgaacgggaaccgcccccaagtccctagatctatgctgtaccgtacctacgtttaggaacggtcggacgtacccagtaccgtaaggttcgacggcgagtaggtggtaacgttcgtagggaactacggtacgttcacttacctactaacgtactcgaacgtcgaccgtccgtacgaccgtacgtcccggtaaggtttacggttaactttacgtaacctttaaacctttacgtttccgtaacgtaacaaaccgttacggtacctttaacccgtaacggttcccgggttacgggtaccgttaccgggaacccggaacccgggtacggtaacgggggtacaaaccggaaacccgttaacggtacgttacggtacggaaccttccggaaccgacccgtttagtccgtttaccgttaccgtttacctaacccgttccctttaccccgacggtactttacggcggttttaaaacg

SEQ ID NO: 67359 - DNA, 584 bp, Homo sapiens
  misc_feature: GYAE6OF01DW7V9.26.70.G04.1.454.CMB.1.raw
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatgacccagtcgccatcctcactgtctgcctctgtaggagacagagtcaccatcacttgtcgggcgagtcagggcattagcgtattttttagcctggtttcagtcagaaaaccagggaaacgcccccaagtccctgatctatgctgcgtccactttagaaggtggacgtccatcaaggttcaggcgcagtggatcgtgggacagagttcactctacaacatcagcagcctgcacgcctgagtatttgactactttattacttgtcagacaggtaccgtagactaacgttcggcccttcgttaccgtacgttttccgggacgggtaacggtaccggtaggggttagacggtagtaccgaaggtaaccgtaacggttggtacgggtcttacggacctaacccgtacgttacgttcgtttacctttcccgtacgtttaccccccgg

SEQ ID NO: 67360 - DNA, 786 bp, Homo sapiens
  misc_feature: GYAE6OF01C05VC.26.70.G04.1.454.CMB.1.raw
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatcgacccagtccgccatcctcactgtctgcctcgtgtaggagacagagtacaccatctacgttggtcgggcgtagtccgagggtctaagttagtacgtttatttttacgccgtttgggtttcacgtacaacggaaaccgacgggaaacccgacccctaacgtccctagtactcctagtcgcgtcgtaccgttaccttaacgttaggaacggtcggtaccgtacccgagttacgtaacggttcgacggtccggtacgtaggtacgtacgtcggtacggacgtaacgtacgttactacctaccgtacccaacctacgtaccgtaacgtcgtaccgtacgtaaacccgtacgttaacggttaacttacgttttaccgacctttaaaccgttttaccgttacttaacgtaacccgtaaacgtaaccggtaaccgtttaaacccgtaaccggttaccccgggttacggttaacccgggtttaccggaaaccccggtaaaccggggtaccggtaaacggggtacccgtaaaccggtaacccgaaacggttaccgtggtaccggtacgttaccgaaccgtacctacgttctacccggttacttccgtaccttcccgtaccgtacctacgttagtaacgtagttagtacccg

SEQ ID NO: 67361 - DNA, 609 bp, Homo sapiens
  misc_feature: GYAE6OF01D4U1W.26.70.G04.1.454.CMB.1.raw
  modified_base (268)..(268): a, c, t, g, unknown or other
  misc_feature (268)..(268): n is a, c, g, or t
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatgacccagtcgccatcctcactgtctgcctctgtaggagacagagtcaccatctacttgtcgggcagtcagggctattagcgttatttttagccttggttcagcgaacgtaaaccgagggaaaccnccccgaagtcctgactctatgactgccgtacctactttaggaggtggactccatcaaggttcagtcgacctaggtcggactcgtaggacagtacttcactctcaactactaccaatacgtccgtcaacctaaccgttagtaaacgttgtttacgaaccttaacctttacgtctacgtacctaacgagttacgttaacccgaaacggttcccgtaggtaccggttccggaccgtaacggacgtagggtacgaacgtaccgaaacgtcgtggtacgctaccggacacgtcgtcttcggtcttactacttccctccccgtactacttactagtaagtcgttacg

SEQ ID NO: 67362 - DNA, 651 bp, Homo sapiens
  misc_feature: GYAE6OF01A3RBK.26.70.G04.1.454.CMB.1.raw
  modified_base (334)..(334): a, c, t, g, unknown or other
  misc_feature (334)..(334): n is a, c, g, or t
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatgacccagtcgccatcctcactgtctgcctctgtaggagacagagtcaccatcacttgtcgggcgagtcagggcattagcgtatttttagccttggtttcagacaagaaaccgagggaaacgccccaagtccctgatctatgctcgcgtcctacgtttaggaggtggactcccatacgaaggttcaggcggnaggtgacgtcgtgggacagtacgttcacctcgtacaagtactaatttaaataacgttctacgacctaacgtaggtaacggttattttacgtaaccttaaacctttaaccgttacgtagttaaccaacgtaacgtaacgttaacccgtacccggtaccccccctttaagttacccgttttacgggaccgtaacggggtaacccgaaggtaccgttaggacgtactaccgacggtaacggtaacgtggtaccggctacgacctactacttcgttcgttacccttcgtacctttcccgtacccctacctcgttcgtaagg

SEQ ID NO: 67363 - DNA, 806 bp, Homo sapiens
  misc_feature: GYAE6OF01A3URV.26.70.G04.1.454.CMB.1.raw
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatgacccagtcgccatcctcactgtctgcctctgtaggagacagagtcaccatcacttggtcgggcgagtcgagggcagttagcgttatttttacgccgttgtttcagacaacgaaaccgaacgggaaaccgaccccaacgtccctagatctagtgtctcgccgtacctaacgtttaggaacggtcggacgtaccctagtaccgtaacggttacgacggtcggtcgtaggtaggtactcggaggacgtacggtacgttaccaccgttacctacgaacctacgtacgaccgggtccggtcctaccggtacgttaccgtaggtaccggtaccttacgttacggtaacccttaaactttaaccgttaaccgtaacgtaaccctaaacttaaagttaacgtttaacgttaatttttaaccttttaaccgtttacccgttacggttaacggttccccggggttaacccggtaacccgggggtaaaccgggggtaaaccgtaaggggttaaaccgggaaccggttaacggtaaaccgggtaccggttaaccggttaccggggtcggttacccttacccgggacccttaaacccgttacgtttcccgtttacccggtttccctttacccgttaccccgtttcccccgttacccccggtacgtttaaacccgg

SEQ ID NO: 67364 - DNA, 512 bp, Homo sapiens
  misc_feature: GYAE6OF02IG689.26.70.G04.1.454.CMB.1.raw
tcagagactatactcacgaccggtgctcgatttagtgtagtgtgaagggaaaggggaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgtatttttagccttggtttcagcagaaaccagggaaacgcccccaagtccctgatctatgctgcgtccatttagaaggtgagtcccatcaaggttcagcggcagtggatcgtgggacaggagttcactctacaacatcagcagcctgcagcctggaggtattttgactaacttatactgccagccaagtataatgtaacttaccctatccgtaccgttcgggccggggtacacgggtctacgggaaactaacgacgtggcggctgcaccatcg

SEQ ID NO: 67365 - DNA, 490 bp, Homo sapiens
  misc_feature: GYAE6OF02GAX05.26.70.G04.1.454.CMB.1.raw
  modified_base (275)..(275): a, c, t, g, unknown or other
  misc_feature (275)..(275): n is a, c, g, or t
tcagagactatactcacgaccggtgctcgatttagtgtagtgtgaagggaaaggggaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgatttttagcctggtttcagcagaaaccagggaaanccccaagtccctgatctatgctgcgtcactttagagtggagtccatcaaggttcagcgcagtggatcgtgggacagagttcactctcaacatcagcagcctgcagcctgaggattttgctaacttattactgccagcagtataatgaattaccctatcaccgttcggccggggacacggctaggaaactaacgatcggtaggctgcctaccatcg

SEQ ID NO: 67366 - DNA, 545 bp, Homo sapiens
  misc_feature: GYAE6OF02IVGI2.26.70.G04.1.454.CMB.1.raw
tcagagactatactcacgaccggtgctcgatttagtgtagtgtgaagggaaagggtaatcattatactgctggcagtaataagttgcaaaaatcctcaggctcctgctgctctgtttcccaggtgccagatgtgacatccagatgacccagtcgccatcctcactgtctgcctctgtaggagacagagtcaccatcacttgccgggcaagtgagggcaataaacaaattcttaaattggtatcaggagaaaccagggagagcccctaaggtcctgatctatggtgcatcctattttgacaaaggtggggtcccaaccaaatttcagtggcagtggatcgtgggacagtatttcgactctcagctattaaataatctgacaacctgaggtattttgactaaacttactaacttgtacaactagtaagttaacacggtaccccccttattaccgttttcggaccgtaggggaacccaaggctagggagatcaacaggaactgtggctgccacatctgtcttcattccttcccgctacttctgtaacg

SEQ ID NO: 67367 - DNA, 586 bp, Homo sapiens
  misc_feature: GYAE6OF02IV9AD.26.70.G04.1.454.CMB.1.raw
  modified_base (345)..(345): a, c, t, g, unknown or other
  misc_feature (345)..(345): n is a, c, g, or t
  modified_base (402)..(402): a, c, t, g, unknown or other
  misc_feature (402)..(402): n is a, c, g, or t
tcagagactatactcacgaccggtgctcgatttagtgtagtgtgaagggaaagggtaatcattatactgctggcagtaataagttgcaaaatcctcaggctcctgctgctctggctcccaggtgtcaaatgtgacatccagatgacccagtctccttccaggctgtctgcatctgtcggagacagagtcacccatcacttgccgggccagtcagagtattggtaggtggttggcctggtatcagcagaaaccaggaacaatcctaagatcctaatctctcaggcgtcgtggttggaaagtgggtccatcaaggttcagtgcgcgatcgtggacagaattcactcncacatcacgcgggctccgagtctgacggactctgactaactttatactgacccaaanaaattatagtatttaatttactttcctccaggtccgtttccgggaccgagggggtaaccaaagggtcgggtaaacgtccgaaaagggtccgaaacgttggtaggtacgtacggaccaaccgtaagttccgttaggttccctttaccgtaactttcccgtttacccccggtacctaagttaccgg

SEQ ID NO: 67368 - DNA, 662 bp, Homo sapiens
  misc_feature: GYAE6OF02GPAA6.26.70.G04.1.454.CMB.1.raw
tcagagactatactcacgaccggtgctcgatttagtgtagtgtgaagggaaagggggaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacgttggtcgggcgagtcgagggcagttagcgtatttttagccgttgtttcagcaagaaaccgagggaaacgccccaagtccctgactctatgctgcgtccacgttagaaggtggacgtccatcgaaggttcaggcggagaggtggatcgtaggacaggtagttacactcacaactatacgagacgagcctgacgacgccgtaggtaggttacttttacgacttaaacgtttaacttaccgtacggtaccgtaacgtacgtaacgtttaattaacgtttacggttaaacccttttaaacccttaacgttacccgttaacccgggtttacccgggggaacccgggggtaaccgtaaccgggtaaccggttaaacgggtaaaaacccgttaaaacgggtaaccgttacgggttacggtaccgttacggaccctaaccgttacgtttacccg

SEQ ID NO: 67369 - DNA, 584 bp, Homo sapiens
  misc_feature: GYAE6OF02G33D4.26.70.G04.1.454.CMB.1.raw
  modified_base (367)..(367): a, c, t, g, unknown or other
  misc_feature (367)..(367): n is a, c, g, or t
tcagagactatactcacgaccggtgctcgatttagtgtagtgtgaagggaaagggtaatcattatactgctggcagtaataagttgcaaaatcctcaggctcctgctgctctgtttcccaggtgccagatgtgacatccagatgacccagtcgccatcctcactgtctgcctctgtaggagacagagtcaccatcacttgtcgggcgagtcagggcattagcgtatttttagcctggtttcagcagaaaccagggaacgcccccaagtccctgatctatgctgcttccaatttgacaaagtggacgtcccatcaagtattcagtcgccaggtggatcgtgggacagtatttcactctcacatcaacngtctgacaacctgaagtatttgactaacttacttctgtacaactagtacgttaccgaaacgtcccggtaggtaccgttccggaccgtaacgggaccgtaggggtacgaacgacccgaaacggtaacgtggtacggacgttcggaccgtacctacgttccgttacgttacctttaccgacctttcccgttacccccgacctacgttccgtaggtaacg

SEQ ID NO: 67370 - DNA, 606 bp, Homo sapiens
  misc_feature: GYAE6OF02GIPGF.26.70.G04.1.454.CMB.1.raw
  modified_base (204)..(204): a, c, t, g, unknown or other
  misc_feature (204)..(204): n is a, c, g, or t
tcagagactatactcacgaccggtgctcgatttagtgtagtgtgaagggaaaggggaggaatcagacccagtcaggacacagcatggacatgagagtcctcgctcagctcctggggctcctgctgctctgtttcccaggtgccagatgtgacatccagatcgacccagtcgccatcctcactgtctgcctctgtaggagacagngtccaccatcacgttggtcgggcgagtcagggcagttgcgtatttttacgccgttgtttcagacaagaaaccgaaggaaaccgccccgaagtccctagtactactagtcgtctcgtccgtacctaacgtttaggaaggtcggtacgtcccagtacgtaacggttcaggtcggcgaggtcggactcggtaggaacagtacgttaccactctaccaactactacacgcacgcctagccacgtacctgtaggtattcgacttacttatactcgacacgtactagtaatagtactaaccttacctactaccgtacccggttccgggaccgggaccgtaccggtaacgtaaccggtaaaacgttaaccgaacgttcggtacggtaccgcgtacctacctagttaccg

SEQ ID NO: 67371 - DNA, 583 bp, Homo sapiens
  misc_feature: GYAE6OF02G8C95.26.70.G04.1.454.CMB.1.raw
tcagagactatactcacgaccggtgctcgatttagtgtagtgtgaagggaaaggggaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttggtcgggcgagtcgagggcagttagcgttatttttacgccttggtttcagcaagaaaccgagggaaaccgacccccaagtccctgactctatgctgccgtcctagttagaagggtggacgtccatacgaaggttcaggcggctaggtggatcgtgggacagtacgttcactctacaacatcagcacgcctgcagcctggagtatttacgactaacttattactcgaccagtctaagtaataacgtacgttaacctttaccctaattccgtaaccggttcggggacccggggacgtaccgggtaccgtaacgggtaaaacctaaacggtaaggttcggtacggtaccgtacgacccgtactagttccg

SEQ ID NO: 67372 - DNA, 651 bp, Homo sapiens
  misc_feature: GYAE6OF02F15RO.26.70.G04.1.454.CMB.1.raw
  modified_base (264)..(264): a, c, t, g, unknown or other
  misc_feature (264)..(264): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (640)..(640): a, c, t, g, unknown or other
  misc_feature (640)..(640): n is a, c, g, or t
tcagagactatactcacgaccggtgctcgatttagtgtagtgtgaagggaaagggtaatcattatactgctggaagtaataagttgcaaaaatcctcaggctcctgctgctctgtttcccacggtgccagatgtgacatccagatgacccagtcgccatcctcactgtctgcctctgtaggagacagagtcaccatcacttgtcgggcgagtcagggcattagcgtattttttaggcctggtttcagcagaaaccagggaaacncccccaagtcccctgatcgtatgctgccgtcactttagaaggtggacgtcccatactaaggttcaggtcggcaggttgatcgnggaacngagttccatcctacaacatcagcacgcctagcgacgcctaggtagtattttcgaactactttagtactcggaccctaggaccagttaactaagtctaacccttttaaccctaacttccgaacccggttttccggggggaccccgggggaactaacccgggtagttaaccgggtaaaaaccttaaaaccgtacgttagggttaccggaccttacgggcccaaacgttaccgttaccttacgtttacttcccgttaacttccccgtttacccccccggatttaccgttnttaaacccggg

SEQ ID NO: 67373 - DNA, 774 bp, Homo sapiens
  misc_feature: GYAE6OF02FXD9H.26.70.G04.1.454.CMB.1.raw
  modified_base (530)..(530): a, c, t, g, unknown or other
  misc_feature (530)..(530): n is a, c, g, or t
tcagagactatactcacgaccggtgctcgatttagtgtagtgtgaagggaaaggggaggaatcagacccagtcaggacacagcatggacatgagagtcctcgctcagctcctggtgctcctgctgctctgtttcccaggtgccagatgtgacatccagatcgacccagtccgccatccctcactgtctgcctctggtaggagacaggacgtcacctatccacgttggtcgggcgagtcgagggcctattaggcgttattttttacgccgttggtttcagtacaacggaaaccgaaggggaaaacccgccccccgtaaacgttccctaggtacttcgtaactcggtctcgaccgttacctaacgtttaaggtaacggggtacggtaccgtacccgtacgtaccgtaacgggtttaccgacggccgacgtagggtggacgttcggtagggtaacaggttacgtttacctacgtaccttaacaacgtactccgagtccgacgcccttggaccgacgtccgtaggaacggtttntttacgacctttaacgtttacgttaccacggtaccgtacgtactaaggttaacttaacgttaacgttaacccttaaccgtttaccctacccgggtttaccccgggttacccggggtacccgggggtaaacccgttaacccggggttaccggtaaaaccgggttaaaaaccccgttaaacccgggtaaccgtttaccgggggtaaccggttacccggtaacgggttaccccctacggttaacccg

SEQ ID NO: 67374 - DNA, 753 bp, Homo sapiens
  misc_feature: GYAE6OF02H3K52.26.70.G04.1.454.CMB.1.raw
  modified_base (154)..(154): a, c, t, g, unknown or other
  misc_feature (154)..(154): n is a, c, g, or t
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
tcagagactatactcacgaccggtgctcgatttagtgtagtgtgaagggaaaggtaatcattatactgctggcagtaataagttgcaaaatcctcaggctcctgcctgctctcgtttcccgaggtcgccagatgtagacatccagatcgacccngtcgccatcctcactgtctcgcctntgaggaganagacgtcacntctacgttggcggatacgtcgaggtcagtcggactaacgttatttaaagtggtactacgaacgtaacgaaaccggtaacgggaaacctacccccgtaaacgttacctaggtaacttaccgtagtcgtcttaccgtacccttaaccgttaatttacggaaacgtaaggtcggacctaccgaacgttacaagttactcgtacggtcgaccgtaggtacgtagtcggtaaggacgtacgtttacttacctacttccaaccaccgtaacttccaacgtttaccgtcttaccgtaaccgtaacgtaacgttaagtttaccttacgttacttaaccgtttaccttcgttaactacgtaacgtaacgttacgttaacccgttaacggtacccggtaacggtccggtaaccgggtaaccgaccgggtaacggaacgggtaaccggaacgtaaccgtaaacgtacgtacgtccgtacgtaccgaccgtactacgttaccgttcgttaacctaccggttcccgtttacccgtacccgtaccgttacgttccgttacgttaaccgg

SEQ ID NO: 67375 - DNA, 508 bp, Homo sapiens
  misc_feature: GYAE6OF01CJH37.44.46.E02.1.454.CMB.1.raw
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
  modified_base (495)..(495): a, c, t, g, unknown or other
  misc_feature (495)..(495): n is a, c, g, or t
tcagacagtatatacacgaccggtgctcgatttagactcatctacagggaaaggggaggaactgctcagttaggacccagagggaaccatggaagccccagctcagcttctcttcctcctgctactctggctccagataccaccggggaaattgtgttgacacaatctccagccaccctgtctttgtctccaggggaaangccaccctctcctgcagggccagtcagagtgttaggaactacttagcctggtatcaanagacacctggccaggctccaggctcctcatctatgatgcatccaatagggccncgggcatcccagccaggttcagtggcagtgggtctgagacagacttcactctcaccatcagcgctagagccgaagatttgctagttattactgtcaacaccgtagcgactggcctaggtacagtttggccgtagggaccaaggctggagctacgaaacgaactgtggctgcaccatctgtcttnactcttcccgtcc

SEQ ID NO: 67376 - DNA, 412 bp, Homo sapiens
  misc_feature: GYAE6OF01B6R5A.44.46.E02.1.454.CMB.1.raw
  modified_base (406)..(412): a, c, t, g, unknown or other
  misc_feature (406)..(412): n is a, c, g, or t
tcagacagtatatacacgaccggtgctcgatttagactcatctacagggaaagggctggagtgggttgtccgtattagaaccaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatccggtcttccccctggccgccctgcctccaggacgccacctccgagacgcacagcggccctgggctgcctggtcaaggctacttcctatactactgtctgagcgggctggcaaggcgcatagnnnnnnn

SEQ ID NO: 67377 - DNA, 405 bp, Homo sapiens
  misc_feature: GYAE6OF01CKDZY.44.46.E02.1.454.CMB.1.raw
  modified_base (315)..(315): a, c, t, g, unknown or other
  misc_feature (315)..(315): n is a, c, g, or t
  modified_base (400)..(405): a, c, t, g, unknown or other
  misc_feature (400)..(405): n is a, c, g, or t
tcagacagtatatacacgaccggtgctcgatttagactcatctacagggaaagggctggagtgggttgtccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaccctggtcaccgtctcctcagcctccaccaagggcccatcggtcttcccctggccgccctgctccaggacncacctccgagagcacagcggccctgggcctgcctggtcaaggctactcctatatactgtctgagcgggctggcaaggcgcatagnnnnnn

SEQ ID NO: 67378 - DNA, 413 bp, Homo sapiens
  misc_feature: GYAE6OF01CRDQ8.44.46.E02.1.454.CMB.1.raw
  modified_base (402)..(413): a, c, t, g, unknown or other
  misc_feature (402)..(413): n is a, c, g, or t
tcagacagtatatacacgaccggtgctcgatttagactcatctacagggaaaggggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaccctggtcaccgtctcctcagcctccaccaagggcccatcggtctccccctggcgccctgctccaggacgcacctctggggcacagcggccctgggctgcctggtcaaggactacttcctcgatcgcgtctgagcgggctgggcaaggcgcagtagnnnnnnnnnnnn

SEQ ID NO: 67379 - DNA, 460 bp, Homo sapiens
  misc_feature: GYAE6OF01D03OY.44.46.E02.1.454.CMB.1.raw
  modified_base (450)..(460): a, c, t, g, unknown or other
  misc_feature (450)..(460): n is a, c, g, or t
tcagacagtatatacacgaccggtgctcgatttagactcatctacagggaaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccaaggaaacggttcggggaatcataaactactactatttgatggatgtctggggcagggggacgtcggtcaccgtctcctcagcttccaccaagggcccatcggtcttccccctggccgccctgcctccaggacgcacctcgtgggggcacgagccggccctgggctgcctggtcaaggctacttccacgtctactgctgacgcgggctggcaaggcgcatagnnnnnnnnnnn

SEQ ID NO: 67380 - DNA, 726 bp, Homo sapiens
  misc_feature: GYAE6OF01CQL5F.44.46.E02.1.454.CMB.1.raw
tcagacagtatatacacgaccggtgctcgatttagactcatctacagggaaagggggaggaactgctcagttaggacccagagggaaccatggaagccccagctcagcttctcttcctcctgctactctggctcccagataccaccggcgaaattgtgttgacacaatctccagccaccctgtctttgtcgtccgggggaacagccaccctctcttgcgagggccgccagactgtgacgacgacttagcctggtaaccaacagaacgcctggcccaggcctcccaagacctcctcatctatgattacttcgtaggtacggcctcgtggacctactcccgacggccccgtcttccgaggtcggctagggtcggggtctagggggactaaggtacctttcaacctttccaccaaccctatacccgaacccgtaggtaccccttaagggaccgtacccgtaaggtaaacgtttaactttttcggaccgttaaggtttttaactttaacgttcggttaaccttaaccgtaaccggttaaaggtaacgttcggtacccttaacctaaattacctttaccgttaccggttttacccgggaccccggttaggggtaaacccgtaaaggttacggtaacttaacgtaaccgtaaaacgtaaccgtggtacggacctcggacctaccgtattccgttagttaccttaccgtacttcccgttcccgacctgttacc

SEQ ID NO: 67381 - DNA, 452 bp, Homo sapiens
  misc_feature: GYAE6OF01D9N2K.44.46.E02.1.454.CMB.1.raw
  modified_base (444)..(452): a, c, t, g, unknown or other
  misc_feature (444)..(452): n is a, c, g, or t
tcagacagtatatacacgaccggtgctcgatttagactcatctacagggaaagggcctgatgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacgttgggggatttatcggtttgggcccacacgtggggccagggaaccttggtcgtcgtctcctcagcttccaccaagggcccagtccggtccttcccctggccgccctgcctccgaggacgcacctcgtggggccacgacggcggcccgtgggctcgccgtggtcaaggactacttcctatatactgtctgaggcgggctggcaggcgcatgnnnnnnnnn

SEQ ID NO: 67382 - DNA, 554 bp, Homo sapiens
  misc_feature: GYAE6OF01E0NYY.44.46.E02.1.454.CMB.1.raw
  modified_base (202)..(202): a, c, t, g, unknown or other
  misc_feature (202)..(202): n is a, c, g, or t
  modified_base (374)..(374): a, c, t, g, unknown or other
  misc_feature (374)..(374): n is a, c, g, or t
tcagacagtatatacacgaccggtgctcgatttagactcatctacagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctctcctgcagggccagtcagagtgttaggaactacttagcctggtatcaacagaccacctggccaggctcccaggcctcctcatctatgatgcatccaatacggggccgcggggcatccccagccaggttcagtggcaggtgggtctgagacagagttcactcncaccatcagcagcctgcagtctagaagtattttgactagttttattactgtcagtctagttatagtgaacgtcggtccttccgttcctacctttcgggacccttgggaccacgtagtccgtaatttaccgaaacgttacgtggtcggtcttcggacctaccgtatccttgtccgtttacc

SEQ ID NO: 67383 - DNA, 621 bp, Homo sapiens
  misc_feature: GYAE6OF01EFAKI.44.46.E02.1.454.CMB.1.raw
  modified_base (201)..(201): a, c, t, g, unknown or other
  misc_feature (201)..(201): n is a, c, g, or t
tcagacagtatatacacgaccggtgctcgatttagactcatctacagggaaagggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccaccctctccgtgtagggccagtcggagtgttgactaagtacctagcctaggtaaccaacagaaacctggaccaggcctacccgaggcctcctcatctatgatcgctataccaagcgggtcacgtcggacccacccagacgtaggttccaggtggactaggtgggtctagggacagtacttcactctccgaccgtcagtactaagtcgtaacacgtcctagtaagttgtttagacttagtttacttacgtagtactcgtacacgtccttccacgacggccgtccgttcgtaccgggtttccggggaccggggtaacgtagggtacgggacgtacgtacgacggaacgtacgtcggtaggtccgtacgacctaaccgtacttcgttacgttccttactccgttcccgtaccccg

SEQ ID NO: 67384 - DNA, 605 bp, Homo sapiens
  misc_feature: GYAE6OF01DN8PI.44.46.E02.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
tcagacagtatatacacgaccggtgctcgatttagactcatctacagggaaagggggaggaactgctcagttaggacccagagggaaccatggaagccccagctcagcttctcttcctcctgctactctggctccagataccgacgggaattgtgttgacacaatctccagccacctgtctttgtctcgaggggaaancgcccaccctctcctgcgagggccagtcagagtgttagacttactagctggatacaanagacaccgtggccacggcctccgaggcctcctacatctatgatgactactaccgaaagtcgggccgcggcactcccagcgtaggtcaggtggctaggtcggtctggacgactcgacttcgactcctacacagtcacggtccgctacggacggaccggtaagttacgtttagtacgttagtttatttacgtacgtactaacgtaaccgtagaccgtacgttcggtaccgttaggttaccgttaggtttcggacggtacgggtaactacggcggtacgacgtactacgaaacgtacgtggtcgcgtacgccacgtagttcgttcgttacttccgtcttcccgtcccgtacg

SEQ ID NO: 67385 - DNA, 598 bp, Homo sapiens
  misc_feature: GYAE6OF01EVVSE.44.46.E02.1.454.CMB.1.raw
  modified_base (200)..(200): a, c, t, g, unknown or other
  misc_feature (200)..(200): n is a, c, g, or t
  modified_base (302)..(302): a, c, t, g, unknown or other
  misc_feature (302)..(302): n is a, c, g, or t
  modified_base (390)..(390): a, c, t, g, unknown or other
  misc_feature (390)..(390): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (554)..(554): a, c, t, g, unknown or other
  misc_feature (554)..(554): n is a, c, g, or t
tcagacagtatatacacgaccggtgctcgatttagactcatctacagggaaagggggaggaactgctcagttaggacccagagggaaccatggaagccccagctcagcttctcttcctcctgctactctggctccagataccaccggggaattgtgttgacacaatctccagccacctgtctttgtctccgaggggaaangccaccctctcctgcagggccagtcagagtgttaggaactacttagcctggtatcaacagacacctggccaggcctcccgaggcctcctcattctatggtcncactcccaccgacgggccacgtcggtactccccaccgtaggttcaggtggctaggtcggggtccggacaggtacgttcactctcaccntccgagcggcctgctagttcgnggtagtntttgcttagtttattcgtgtacagtactagtataatacgtcgccttcgtacgttcggtttaccgggggaccggggtactaagggtcggaagtaacgtaccgtaaaacgtacgtggtacggcttacgcctaacgtnttccgttgttaccttcgtacttccccgttaccgcctgtccgtag

SEQ ID NO: 67386 - DNA, 523 bp, Homo sapiens
  misc_feature: GYAE6OF01E4PGY.44.46.E02.1.454.CMB.1.raw
  modified_base (266)..(266): a, c, t, g, unknown or other
  misc_feature (266)..(266): n is a, c, g, or t
  modified_base (484)..(523): a, c, t, g, unknown or other
  misc_feature (484)..(523): n is a, c, g, or t
tcagacagtatatacacgaccggtgctcgatttagactcatctacaggggaaaggggctggagtgggttggccgtattagaaccaaagctgacggtgggacagcagactacgctgcacccgtgaaaggcagattcaccatctcaagagatgattacaaaagatacggtgtctctgcagatgaacagcctgaacaccgaggacacagccgtctattactgtctgggattggtttcagttcgggccagggaacccctggtcaccgtcncctcagccctcaccaagggccctatccggtcttccccctggccgccctgcctccgaggcgccgtacccgtccgagcgcactacgccggcccgtgggcctaggcccttaggtaccctaaagggtaccctttaaccgtttccctaagttaacttaaccgttggttaccgtcggacgggccggggcgttacgggacccaaagggccgacctaagttaacgnnnnnnnnnnnnnnnnnnnnnnnnnnnnnnnnnnnnnnnn

SEQ ID NO: 67387 - DNA, 662 bp, Homo sapiens
  misc_feature: GYAE6OF01D49Z5.44.46.E02.1.454.CMB.1.raw
  modified_base (204)..(204): a, c, t, g, unknown or other
  misc_feature (204)..(204): n is a, c, g, or t
  modified_base (615)..(615): a, c, t, g, unknown or other
  misc_feature (615)..(615): n is a, c, g, or t
tcagacagtatatacacgaccggtgctcgatttagactcatctacagggaaagggggaggaactgctcagttaggacccagagggaaccatggaagccccagctcagcttctcttcctcctgctactctggcctccagataccgaccggggaaattgtgttgacacaatctccagccacctgtctttgtctccgaaggggaaancgccaccctctcctggcagggccagtcagagtgttagaactactagcctggtatcaacagacacctggccacgggcctcccgaggcctcctcatctatggatcgactataccgaaagtcggggccgtcggcactcccgagtcctaggttcaggtcggcgtaggtcggggtcagaacgtacacgtactttcacttccacactacgtccgaggccggtaaccgtagggaacggtaccgggtaagttacgttttacgacgtttaacggttttactaaccgttcgtaaacctaacggtacccgtagtacccggtacgtacggtaccgttaagggttaccgttacggggtttcgacccgggtaacgggaaccagggtacgtaggtacgtataacccgtaaggacgttgggacgtcnggaccctacgtacttcgttacgttccttacgtccttcccgtccgtac

SEQ ID NO: 67388 - DNA, 614 bp, Homo sapiens
  misc_feature: GYAE6OF01DJGB2.44.46.E02.1.454.CMB.1.raw
  modified_base (347)..(347): a, c, t, g, unknown or other
  misc_feature (347)..(347): n is a, c, g, or t
  modified_base (548)..(548): a, c, t, g, unknown or other
  misc_feature (548)..(548): n is a, c, g, or t
tcagacagtatatacacgaccggtgctcgatttagactcatctacagggaaagggggggggtaggtccctgtggaaaagggtcagaggccaaaggatgggagggggtcaggctggaactgaggagtcagtctcagtcaggacacagcatggacatgagggtccccgctcagctccgtggggctcctgctactctggctccgaggtgccagatgtgacatccagatcgacccagtcctccttcctccctgtctgcttcataggagacagagtcgccatcacttgccggcagtcagaccattaacagtcttaatttaagttggtactcagcagacgaccgagggaaacnccccgtagaacctcctgactcctcgtgcctcgtccctccacttctcggacgtaagggtggacgtttccttacgttacgtaagggtttcaagggttcggaccgtaggtggaacttcggtagggtaacctaggtactttcaccgttcctacctaacctacttcctacctagttcctagacctaaacccgttagtaaacgtttntttacgaccttaaactttactacgttacgtacaacgtagtacttataccctccgtccccgtttacg

SEQ ID NO: 67389 - DNA, 715 bp, Homo sapiens
  misc_feature: GYAE6OF01AFJFM.44.46.E02.1.454.CMB.1.raw
  modified_base (207)..(207): a, c, t, g, unknown or other
  misc_feature (207)..(207): n is a, c, g, or t
  modified_base (263)..(264): a, c, t, g, unknown or other
  misc_feature (263)..(264): n is a, c, g, or t
tcagacagtatatacacgaccggtgctcgatttagactcatctacagggaaagggggaggaactgctcagttaggacccagagggaaccatggaagccccagctcagcttctcttcctcctgctactctggcctcccagataccgaccggggaaattgtgttgacacaatctccagcccaccctgtctttgtctccgaaggggaaanagcccaccctctcctgcagggccagtcagagtgttagactactagctggtatcaannacacgtggccaggcctcccgaggcctcctcatctatgatgcataccaaagtacgggcccggcgggaccacgtccccgaggacccgtaggttccgaagggtgggaccgtagggttcgggtcgtagggaacgacgtaacggtaccttccgtaacctcctaccgaaccctacttccggaacggtaccgggtaccgtaacggaacggtacccggtaaaggtttacgttttacggactttaacgttttaactttaaccgttacgtaacctaaccgtaaccggtacgtaccgtaccgtacggtacccgttagggttaccgttaggttttaccgggacggtacggggtaaccacggtacggtacggacgtaccgtaacgaaaacggtacgtacgggtcgacgtcgacctacctagttcccgttcgttaccttaccgttaccttccccgttcccgtacc

SEQ ID NO: 67390 - DNA, 790 bp, Homo sapiens
  misc_feature: GYAE6OF01A0HAF.44.46.E02.1.454.CMB.1.raw
tcagacagtatatacacgaccggtgctcgatttagactcatctacagggaaagggggaggaactgctcagttaggacccagagggaaccatggaagccccagctcagcttctcttcctcctgctactctggctcccagattcccaccggcgaaattggtgttgacacaatctccagccaccctgttctttgtcgtccgggggaacgacgccaccctctcttgcgaggccggcagctgttgacgacgtacttagcctggtaaccaacgtagaacgccgtggacccacggcctacccgagtacctcctctactctagtacgattaccttcgtacggtacgggcctacgtcggctactcccacggccccgtacttccgtaggtacggcgtagggttcggggtcgtacgggggtacaacggtccttacgaacttcccgtacaacccgtctaacccacccgtaagtaccccgtaagtcccgaccgttaggtaacgttacgttttacgtaaccgtttaagttttaacttacggttacgttaacccgtaaccgtaaccggttaaacggtaacgttaccgggtacccttaaccgttaacttacctttacggttaccccgttttacccggtaccccggttaacgggttaacccgtaaacgggttaacgtaacgttaaaccgtaaccgaaaaccggttacgttacggtaacggtcccggtacgtaacccgtacccgttaacttacccggttccgtttaccttacccgtactttccccgtacccccgtacttcgttaaccg

SEQ ID NO: 67391 - DNA, 453 bp, Homo sapiens
  misc_feature: GYAE6OF01B51QB.44.46.E02.1.454.CMB.1.raw
  modified_base (160)..(160): a, c, t, g, unknown or other
  misc_feature (160)..(160): n is a, c, g, or t
  modified_base (209)..(209): a, c, t, g, unknown or other
  misc_feature (209)..(209): n is a, c, g, or t
  modified_base (307)..(307): a, c, t, g, unknown or other
  misc_feature (307)..(307): n is a, c, g, or t
  modified_base (446)..(453): a, c, t, g, unknown or other
  misc_feature (446)..(453): n is a, c, g, or t
tcagacagtatatacacgaccggtgctcgatttagactcatctacagggaaaggggctggagtgggttggccgtattagaaccaaagctgacggtgggacagcagactacgctgcacccgtgaaaggcagattcaccatctcaagagatgattcaaaagntacggtgtctctgcagatgaacagcctgaacaccgaggacacagccgtntattactgtctgggattggtttcagttcgggccagggaccctggtcaccgtctcctcagccctccaccaacgggccctagtccggtccttccccccgnggccgcccctgcctccgacggacgccaccctccgagacgcacgacgccggcccgtgggcctcgccgtggtacaacggtacttaccgttcctataactactgtcctggacggcgggtctgggaccgaagggcacagtagnnnnnnnn

SEQ ID NO: 67392 - DNA, 710 bp, Homo sapiens
  misc_feature: GYAE6OF01A0EOP.44.46.E02.1.454.CMB.1.raw
  modified_base (201)..(201): a, c, t, g, unknown or other
  misc_feature (201)..(201): n is a, c, g, or t
  modified_base (340)..(340): a, c, t, g, unknown or other
  misc_feature (340)..(340): n is a, c, g, or t
tcagacagtatatacacgaccggtgctcgatttagactcatctacagggaaagggggaggaactgctcagttaggacccagagggaaccatggaagccccagctcagcttctcttcctcctgctactctggctcccagataccaccggggaaattgtgttgacacaatctcagccacctgtctttgtctccgaggggaaancgccaccctctcctgcgagggccagtcagagtgttcgacaccaccacagcttctacgcctggtaccagcaagacgcctggccaggcctaccgaggtcctcctcatctagtggtcacactccacgacggccacgtgtacnccaggcctagggttcaggtcgacgaggttcgggtcgtggggactaaggtcgttactaccgtctaccgaccgttacgacgtaactaagtacgttaacgacggtacccttaaggtaaaacgtttgttttacggactttaaggttttacttaacggttccgtactaacggcttaccgggtccctttacccgtaccggaccgggtacccttcgtttacccggttaaccgggttttacccggggggaccggggggtaaccgtaacggggttcgggtaaacgtacggtaccggtaaacgggtaaccggtaaacggttcgggtacgtcgttacgggaccccttaacggtacctttcggtacgttcccgtttaacccg

SEQ ID NO: 67393 - DNA, 465 bp, Homo sapiens
  misc_feature: GYAE6OF01D3UDZ.44.46.E02.1.454.CMB.1.raw
  modified_base (162)..(162): a, c, t, g, unknown or other
  misc_feature (162)..(162): n is a, c, g, or t
  modified_base (212)..(212): a, c, t, g, unknown or other
  misc_feature (212)..(212): n is a, c, g, or t
  modified_base (450)..(450): a, c, t, g, unknown or other
  misc_feature (450)..(450): n is a, c, g, or t
  modified_base (453)..(465): a, c, t, g, unknown or other
  misc_feature (453)..(465): n is a, c, g, or t
tcagacagtatatacacgaccggtgctcgatttagactcatctacagggaaaggggctggagtgggttggccgtattagaaccaaagctgacggtgggacagcagactacgctgcacccgtgaaaggcagattcaccatctcaagagatgattacaaaaagntacggtgtctctgcagatgaacagcctgaacaccgaggacacgagccgtntattactgtcgtgggtattggtttcagttccgggccagggtaccctggtccaccgtctcctcacgcctccaccaacgggcccatccggtccttcccccgtggccgcccctgcctccgaggcgccacccgtaccgagacgcaacaggccggcccgtgggcctcgccgtggtacaacggtacttacttcctatactacgtgtcgtgacggcgggtctagggacgaacggcgactagtagnagnnnnnnnnnnnnn

SEQ ID NO: 67394 - DNA, 450 bp, Homo sapiens
  misc_feature: GYAE6OF01A39TQ.44.46.E02.1.454.CMB.1.raw
  modified_base (432)..(450): a, c, t, g, unknown or other
  misc_feature (432)..(450): n is a, c, g, or t
tcagacagtatatacacgaccggtgctcgatttagactcatctacagggaaaggggctggagtgggttgtccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggattggttcagttcgggccagggaccctggtccaccgtctcctcagccctccaccaagggcccatccggtccttcccccgtggccgcccctgcctcccgaggacgccacctccgagacgccacgagccggccctgggcctcgcctggtcaaggactacttccacgttctacgtgctggacgcgggtctgggactaagggccgcaataggnnnnnnnnnnnnnnnnnnn

SEQ ID NO: 67395 - DNA, 578 bp, Homo sapiens
  misc_feature: GYAE6OF01BN12P.44.46.E02.1.454.CMB.1.raw
  modified_base (307)..(307): a, c, t, g, unknown or other
  misc_feature (307)..(307): n is a, c, g, or t
  modified_base (370)..(370): a, c, t, g, unknown or other
  misc_feature (370)..(370): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (547)..(547): a, c, t, g, unknown or other
  misc_feature (547)..(547): n is a, c, g, or t
  modified_base (550)..(551): a, c, t, g, unknown or other
  misc_feature (550)..(551): n is a, c, g, or t
  modified_base (553)..(556): a, c, t, g, unknown or other
  misc_feature (553)..(556): n is a, c, g, or t
  modified_base (558)..(559): a, c, t, g, unknown or other
  misc_feature (558)..(559): n is a, c, g, or t
  modified_base (563)..(565): a, c, t, g, unknown or other
  misc_feature (563)..(565): n is a, c, g, or t
  modified_base (567)..(568): a, c, t, g, unknown or other
  misc_feature (567)..(568): n is a, c, g, or t
  modified_base (570)..(571): a, c, t, g, unknown or other
  misc_feature (570)..(571): n is a, c, g, or t
  modified_base (573)..(575): a, c, t, g, unknown or other
  misc_feature (573)..(575): n is a, c, g, or t
  modified_base (577)..(578): a, c, t, g, unknown or other
  misc_feature (577)..(578): n is a, c, g, or t
tcagacagtatatacacgaccggtgctcgatttagactcatctacagggaaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgaggggacctccgaaggaacggttcgggaatcataaactactactatttgatgatgtcgtggggcgagggggacgtcggtcaccgtctcctcngccttccaccgaacgggcccatccggtccttcccccgtggcccgcccctgcctccgacgggcncctaccgtcggtcggggccacgcggcccgggcccgtcggggcctcggcccgttggtaccgaacggtaccttacccttaccttaactacttaaccgtcggttaccgttacggacgggtccgggtcgtacggggaccgaacgggccgtacgtaagtacggngacncgcncgncgtagcncgnngnnnngnngcgnnncnncnncnnngnn

SEQ ID NO: 67396 - DNA, 720 bp, Homo sapiens
  misc_feature: GYAE6OF01A6YAB.44.46.E02.1.454.CMB.1.raw
  modified_base (323)..(323): a, c, t, g, unknown or other
  misc_feature (323)..(323): n is a, c, g, or t
tcagacagtatatacacgaccggtgctcgatttagactcatctacagggaaaggggagctctgggagaggagcccagcactagaagtcggcggtgtttccattcggtgatcagcactgaacaaagaggactcaccatggagtttgggctgagctgggttttcctcgttgcttcttttaagaggtgtccactgtcaggtgctaccgtggtggagtcgtggggagtcgtggtccaggccgtgggacgtcccgtgacgcttcgtccgtgtgacgtcctcgtggtatttaggttcaggttggttctggctagtgctacgtgggtccncgaggtcctacgaggacgagggcgtaggtggttggctagttagtacgcacgagtgtagtaggtacgtttctaggtaaattagttagtacgacgtaacgtacgttaccggtagggtaaaccgggtccgtaatttcccggtcccgttccgtaaccctaggaaacgtaacctaaacgtttaccgaaacgtaaacctaccgggttaacttaacgtaccttaaacgaaagttacggaaaccgttaagttacggaacgtacggaccggaacggtaccgttacgccgtttactacttaacggttagtttaccggacgttaccggtacccttaaggttccggttaccttaacggggttcccggggaacgtaaggggttaccccgttcccgggtggttaacccccg

SEQ ID NO: 67397 - DNA, 807 bp, Homo sapiens
  misc_feature: GYAE6OF01A5QTD.44.46.E02.1.454.CMB.1.raw
  modified_base (798)..(798): a, c, t, g, unknown or other
  misc_feature (798)..(798): n is a, c, g, or t
tcagacagtatatacacgaccggtgctcgatttagactcatctacagggaaagggggaggaactgctcagttaggacccaggagggaaccatggaacgccccagctcagcttctcttcctcctgctactctcggcctcccgagagactccgaccggagagtagttgtgttgaccgcagtcctccacgtccctaccttgttcgtttcgtccgtaccggaaggggaaacaccgccctacccgttccgtccgtcgaccgacgggccctaacggtccgaggtacgttaggttacgccgtacgtacctttaacgttacgaccgttaacgggtaaacccaacgaaacggtaaacccgtcggaccgacggtccctaccgacggtcctctactacttaccgtagtcggtctacctaccgtacccgaccggacggtacctacggtacggtacctaccccgacggtaccgttaggtaccgtaggtacggtcgtacgggttcgggtacggttacggaacgttaggttaccgtacccgtacctccgtaactaaccgacgttaccgacggaccctcgttacccgttcgggacttaacgggttacgtaacgggttaaattttcgggttttacggacctttttaagtttaacctcggtacgtacgtagtacgttaacgttataccgtagttaccgcgtttcccttagccggtttagggtaccgggtaccgggaagtggtaaacgggattaaacccgggtaacgaaacggttcgtcggtacgaccgtcgtaacctacgtagttccgtaccgttnttaaccccg

SEQ ID NO: 67398 - DNA, 708 bp, Homo sapiens
  misc_feature: GYAE6OF01C9W5I.44.46.E02.1.454.CMB.1.raw
tcagacagtatatacacgaccggtgctcgatttagactcatctacagggaaaggggagctctgggagaggagcccagcactagaagtcggcggtgttccagttcggtgatcagcactgaacacagaggactcacagtggaggtttggctgagtcgttcgggttttcctcgttgtctttacgttttaaggaggtcgtccacgtgtcgaggtgcgagacgtaggtggacggtcggtggggaggacgccgccgagcgtacggaacctccgtagacgacctcctccgtgtacgccgacgtccgtcgtacggtattcctacgttacttccgacggtacctatccgaccagtcgcgtacggtcggcccgacgcggactaccggaacggacgggtaacgggcgtaggtagggttgggacgtactaagttacgactaaggaaggaagtagtaagtaaagtcggaaaacaacgtacggtaacggacgtaacggacggtaaggaccggtacgtactaccgtaccgtactaacgaacgacgaacgtacgaaccgtaacgaactactacgagtacgtagtaacgtacgtaactaactacgtaaccctaacgtacgaacgtaacgtacggacgtaacgaccgggttactacggttacttacgtttacgtacggttacggaccgtacgaccccggtcccgtaccggtaccggtaaccccggg

SEQ ID NO: 67399 - DNA, 605 bp, Homo sapiens
  misc_feature: GYAE6OF01DDZO1.44.46.E02.1.454.CMB.1.raw
  modified_base (158)..(158): a, c, t, g, unknown or other
  misc_feature (158)..(158): n is a, c, g, or t
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
tcagacagtatatacacgaccggtgctcgatttagactcatctacagggaaagggggaggaactgctcagttaggacccagagggaaccatggaagccccagcgcagcttctcttcctcctgctactctggctcccagacaccactggagaaatagtnatgacgcagtctccagcccaccctgtctctgtctccgaggggaaanacgccaccctctcctgcgagggccagtcagagtgtggcagcgagcgtagccgtggtccagcagaacctggaccagacctccaggctccctacatctataccacactccaaccgaggcccacgtcggtactacccgagccagtacttcgacgtcggcacgtggtcgnggacagtacgttcactcgtacaccatcagacgacgccgtcgactacgtacgtagtaagtagtttcgacgttacgtttattacgtgttacagtactaagtagttagtcgtacgttcggtaccttccgttaccgttaccgtttccgggcccgttacgggacccgttacgacggttaccgtaactttaaccggaaaccgttaacggttccgtacggtacctcggtacctaccgttacg

SEQ ID NO: 67400 - DNA, 726 bp, Homo sapiens
  misc_feature: GYAE6OF01DPA3P.44.46.E02.1.454.CMB.1.raw
  modified_base (160)..(160): a, c, t, g, unknown or other
  misc_feature (160)..(160): n is a, c, g, or t
  modified_base (167)..(167): a, c, t, g, unknown or other
  misc_feature (167)..(167): n is a, c, g, or t
  modified_base (642)..(642): a, c, t, g, unknown or other
  misc_feature (642)..(642): n is a, c, g, or t
  modified_base (644)..(645): a, c, t, g, unknown or other
  misc_feature (644)..(645): n is a, c, g, or t
  modified_base (649)..(649): a, c, t, g, unknown or other
  misc_feature (649)..(649): n is a, c, g, or t
  modified_base (671)..(671): a, c, t, g, unknown or other
  misc_feature (671)..(671): n is a, c, g, or t
  modified_base (683)..(683): a, c, t, g, unknown or other
  misc_feature (683)..(683): n is a, c, g, or t
  modified_base (686)..(686): a, c, t, g, unknown or other
  misc_feature (686)..(686): n is a, c, g, or t
  modified_base (689)..(689): a, c, t, g, unknown or other
  misc_feature (689)..(689): n is a, c, g, or t
  modified_base (697)..(697): a, c, t, g, unknown or other
  misc_feature (697)..(697): n is a, c, g, or t
  modified_base (704)..(706): a, c, t, g, unknown or other
  misc_feature (704)..(706): n is a, c, g, or t
  modified_base (716)..(716): a, c, t, g, unknown or other
  misc_feature (716)..(716): n is a, c, g, or t
  modified_base (718)..(718): a, c, t, g, unknown or other
  misc_feature (718)..(718): n is a, c, g, or t
tcagacagtatatacacgaccggtgctcgatttagactcatctacagggaaaggggctggagtgggttggccgtattagaaccaaagctgacggtggacagcagactacgctgcaccgtgaaaggcagattcaccatctacaagagatgattacaaaagntacggtntctctagcagatagaacagcctagaaccacggaaggacactacgtccgttactattacgtgttcgtgggtaattcggtttcacggttccgggacccgaagggtaaccccttggtacctaccggtttcctaccctacgaccggtccctacccgaaaccgaaccgggtccctaacggttcccgtttaccccgtttcccccgcggggtccctccccgttacggaccgttacccggaggtaaccgtccccttaacccggaaccgacgtaaccgaccgaaaccggccgggtccccgggtaccccggtttagggccccttacggtaccccggttaagggtaaaacccgtaaacggtaccgtttttaaacccttaccgtttaaacgttaactttaccgggttacgttccggttaacggacgggttaccccgggtagtacgggtaaccgaacgggtccgaacgtacgttaggactagacgtangnngtangactacgacgacgtacgagacncgtacgtacacncanacnacgcacgntagactnnncagactacananctgtagcg

SEQ ID NO: 67401 - DNA, 718 bp, Homo sapiens
  misc_feature: GYAE6OF01BV967.44.46.E02.1.454.CMB.1.raw
  modified_base (170)..(170): a, c, t, g, unknown or other
  misc_feature (170)..(170): n is a, c, g, or t
  modified_base (376)..(376): a, c, t, g, unknown or other
  misc_feature (376)..(376): n is a, c, g, or t
  modified_base (514)..(514): a, c, t, g, unknown or other
  misc_feature (514)..(514): n is a, c, g, or t
tcagacagtatatacacgaccggtgctcgatttagactcatctacagggaaagggggggggtaggtcccctgtggaaaaagggtcagaggccaaaggatgggagggggtcaggctggaactgaggagtcagtctcagtcaggacacagcatggacatggagggtccccgntcagcctccgtggggctcctgctactctggctccggaggtgccagatgtgacactccagatcgaccctagtcctccttcctcctgtctgtcttctagtaggagacacgtcgtccgaccatcgtacgtcggccggactaggtcacgtactataacagtacttaatttaagtgtaatcgaagtacgagaacgaccgaacgggtaaccncccgtaagacccttcgacgtacttccgtacgtcgtctcccgtacctccgacctacggtcggtagggtacgggtcgtaacgttccgttacgttaccggttaagttccggtaaggtccgggtagacgggttacggtaccngggtacggtaactacgttaccgtttcccaacgttcccgtaacccttaccgtaaccgttccccggtaacgtttacgtccggttaacctacccggttaaacggtagtttaaccgttaacgtttcggaaccccttttaagttaacgtcgtaacgtacctaaagtccgttaagttaccctccgttcccgggttacccgtttaacgggg

SEQ ID NO: 67402 - DNA, 737 bp, Homo sapiens
  misc_feature: GYAE6OF01DPLAH.44.46.E02.1.454.CMB.1.raw
  modified_base (289)..(289): a, c, t, g, unknown or other
  misc_feature (289)..(289): n is a, c, g, or t
tcagacagtatatacacgaccggtgctcgatttagactcatctacaggggaaagggggggggtaggtcccctgtaggaaaagggtcagaggccaaaggagtgggagggggtcaggctggaactgaggagtcagtctcagtcaggacacagcataggacatggacgggtccccgctcagctccgtggggctacctgctactctggcctccagactaccagatgtagacataccagactcgaaccctagtcctacctactccctacctgtctagctagtcgtggtacgganaccagtacgtaccaaccgattcccgtaacgttccggacccggggtagaacgttaccggagggtacctaagttaacgaccttaattttacgttacggtccgttaggtactacaacggacgaaaacggaaaccggtagggaaacgtcctaaacccgtaagtccctttaacgtagtaactactaacgtaacgtaaacctacttaccttaagtttcgaaccttaacgtaccgggtacgggtaccctagttcccggtacggtacgaacggtcccggagtacggtaggtacgttacggtacggtaacgtagttacgttacccgaaccttaccggtccgtaaccgttcgaacgttcaccggtctacgaccgtagtaccgtagtaacgtactttaggtactaagttaaaccctttgaaccgttaattaaaacgaacttaacgtacgcgtaaccccg

SEQ ID NO: 67403 - DNA, 648 bp, Homo sapiens
  misc_feature: GYAE6OF01C42AM.44.46.E02.1.454.CMB.1.raw
  modified_base (167)..(167): a, c, t, g, unknown or other
  misc_feature (167)..(167): n is a, c, g, or t
  modified_base (610)..(611): a, c, t, g, unknown or other
  misc_feature (610)..(611): n is a, c, g, or t
  modified_base (614)..(621): a, c, t, g, unknown or other
  misc_feature (614)..(621): n is a, c, g, or t
  modified_base (623)..(648): a, c, t, g, unknown or other
  misc_feature (623)..(648): n is a, c, g, or t
tcagacagtatatacacgaccggtgctcgatttagactcatctacagggaaaggggctggagtgggttggccgtattagaaccaaagctgacggtgggacagcagactacgctgccacccgtgaaaggcagacttcaccatctacaagagatgaattacaaaaagtntacggtgtctctgcagatagaacacgtcctacggaaaccaccggaggaaccacgacgtcccgttaacttacttacgtggttcgttggggtatttcgggttacacggttccgggaccgtacgggacccgtggtacccgtaccgttctccctacgtaccgccctaccccgaacccgtaaccgggccctacgttacccggttccctttccccccgtcggcccgttccccgtcgacccgcccgtacggccgccccgtacccgtaccgacggacgacccgacgaccggcccggtacccggtcgggtccctacggtcccgttacggggtaaccaacgtacccgtttacccttacccgtaccgttacccgttacgtcggtccgtacgggtaaccgggtcccgggtacgggttacggggaccgacggggccgacgtaggtaccgtgactcnncgnnnnnnnncnnnnnnnnnnnnnnnnnnnnnnnnnn

SEQ ID NO: 67404 - DNA, 785 bp, Homo sapiens
  misc_feature: GYAE6OF01ADK4S.44.46.E02.1.454.CMB.1.raw
  modified_base (181)..(181): a, c, t, g, unknown or other
  misc_feature (181)..(181): n is a, c, g, or t
tcagacagtatatacacgaccggtgctcgatttagactcatctacagggaaaggggagctctgggagaggagcccagcactagaagtcggcggtgtttccattcggtgatcagcactgaacacagaggactcaccatggagtttgggctgagcttgggttttcctgttgcttcttttaagnggttcgtccacttgtcagggtgccaccgtgggtggagtcgtgggggagtcgtggtccagccgtggggacgtccctgagaccttctcctgtagaacgtcctctggtattttagtttcagttggttctggctagtgctacgtcgggtcccgccgaggcctaccggagggacggaacggggggtcccggtagggttcggggttcggacgtaggtttaacgtacggccctaacgtagttaggacggtttagggtaaacgtttcgtaaggtaaattatttaagtcggactaacggtaccgttaccggggtaggtaacgggtcccgtaagtttaccccgaacccttacgttacccgttaccgaaaggtaaccgtaacccgttaaccggtttaacccccggaacttaacggttttcggttacggtttaacgttaacgggtaaagttcggtacgaccggtccgttaggtacggtacggtacggacggttacctccgggtcgttagttacggtttacgtttaccggtgggttacggacggtaacgggttaggtaacggggggttagggtttaggggttacggtttaacgggtttaccgggttccggggtacgg

SEQ ID NO: 67405 - DNA, 404 bp, Homo sapiens
  misc_feature: GYAE6OF02F8GPG.44.46.E02.1.454.CMB.1.raw
  modified_base (401)..(404): a, c, t, g, unknown or other
  misc_feature (401)..(404): n is a, c, g, or t
tcagacagtatatacacgaccggtgctcgatttagactcatctacagggaaagggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatagnnnn

SEQ ID NO: 67406 - DNA, 608 bp, Homo sapiens
  misc_feature: GYAE6OF02HBLE6.44.46.E02.1.454.CMB.1.raw
  modified_base (310)..(310): a, c, t, g, unknown or other
  misc_feature (310)..(310): n is a, c, g, or t
tcagacagtatatacacgaccggtgctcgatttagactcatctacagggaaagggggaggaactgtctcagttaggacccgagagggaaaccagtggaagccccagctcgagcttctcttcctcctgctactctggcctcccacgactaccaccggggaaattcgtgttgacacaatctccaggcccacccgtcgtctttgtctccaggggaaagagcccaccctctccctgcagggccaggtccaggagtgttaggactacttagcctggtatcaacaggacacctggccaggctcccagggcctcctnatctatgatgcatccaatgggccgcgggcacgtccccagccacggttcagtggacagtggtctgagacgacgacttcactctcaccatcgagcgcctagacgccgaagtctttcgctagtttatactgtcaacctaccgtagccgacgtggccttagggtactaggttttcggacccgtaaggggtaccctaaggccgtaggtaaccgtcgtaccgaaaccggacgttcggtcgggaccttggacctacccgtattccgttcggttcctttaccggacttcccgttaccccgtacccg

SEQ ID NO: 67407 - DNA, 406 bp, Homo sapiens
  misc_feature: GYAE6OF02H640L.44.46.E02.1.454.CMB.1.raw
  modified_base (363)..(363): a, c, t, g, unknown or other
  misc_feature (363)..(363): n is a, c, g, or t
  modified_base (400)..(406): a, c, t, g, unknown or other
  misc_feature (400)..(406): n is a, c, g, or t
tcagacagtatatacacgaccggtgctcgatttagactcatctacagggaaagggctggagtgggttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggcagggaccctggtcaccgtctcctcagcctccaccaaggcccatcggtcttcccctggcgcccctgctccaggacgcacctccgagagcacagcggccctgggctgcctggtcaaggctacttccncgatcgcgtctgagccgggctggcaagggcgcatagnnnnnnn

SEQ ID NO: 67408 - DNA, 548 bp, Homo sapiens
  misc_feature: GYAE6OF02H4790.44.46.E02.1.454.CMB.1.raw
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
  modified_base (475)..(475): a, c, t, g, unknown or other
  misc_feature (475)..(475): n is a, c, g, or t
  modified_base (506)..(506): a, c, t, g, unknown or other
  misc_feature (506)..(506): n is a, c, g, or t
tcagacagtatatacacgaccggtgctcgatttagactcatctacagggaaagggggggtaggtcccctgtggaaaagggtcagaggccaaaggatgggagggggtcaggctggaactgaggagtcagtctcagtcaggacacagcatggacatgagggtccccgctcagctcctggggctcctgctactctggctccgaggtgccagatgtgacatccagatgacccagtctccttcctccctgtctgcttctgttggaggcagcgtcaccatcacttgccggcgagtcaggtcgttttcggtgctgttgcctggtttcaaacgaaaaggggnaggcccctaaggtcctcgtctctcgtgaaaccngactggaagtagagtcccgtcaggttcagtcncagtccaggtggtgggccggagtccactctcaccattacgcgacctgcgcctgaagtattctgctaacttatttcngtcagcagtatcgattacgtcgtccccgttntacgttttcggccgtacgggtacccaaggtcctaggtaaacg

SEQ ID NO: 67409 - DNA, 604 bp, Homo sapiens
  misc_feature: GYAE6OF02H3S9W.44.46.E02.1.454.CMB.1.raw
  modified_base (211)..(211): a, c, t, g, unknown or other
  misc_feature (211)..(211): n is a, c, g, or t
  modified_base (373)..(373): a, c, t, g, unknown or other
  misc_feature (373)..(373): n is a, c, g, or t
tcagacagtatatacacgaccggtgctcgatttagactcatctacagggaaagggggaggaacgtcgctcagtttacggacccagacgggaaccatggaagccccagctcgagcttctcttcctcctgctactctggctcccagtataccaccggggaaattgtgttgacacgaatcgtccagccaccctgtctttgtctccaggggaaangccaccctctcctgcagggccagtcagagtgttaggaactacttagcctggtatcaacagacacctgccaggcctcccaggctcctcatctatgatgcatccacagggccactggtactccagcaggttcagtggcagtgggtctgggacagagttcactcncaccatccagcagctgcagtctgagtattttgctagttttaattacttgtcgtagctagttaactaagttcgtaacgttcggtacccttcccgtttaccgggacccgtaaacgggggtaccaaaccggtaaccgtacgggtaagtaacgtttaaaccggaacgtacggttacggacgttaggacctaacccgtacgttcgtacgttacctttctaccttccgtttaccccg

SEQ ID NO: 67410 - DNA, 563 bp, Homo sapiens
  misc_feature: GYAE6OF02JP1UG.44.46.E02.1.454.CMB.1.raw
  modified_base (167)..(167): a, c, t, g, unknown or other
  misc_feature (167)..(167): n is a, c, g, or t
  modified_base (261)..(261): a, c, t, g, unknown or other
  misc_feature (261)..(261): n is a, c, g, or t
  modified_base (335)..(335): a, c, t, g, unknown or other
  misc_feature (335)..(335): n is a, c, g, or t
tcagacagtatatacacgaccggtgctcgatttagactcatctacagggaaaggggggggtaggtcccctgtggaaaagggtcagaggccaaaggatgggagggggtcaggctggaactgaggagtcagtctcagtcaggacacagcatggacatgagggtccccgntcagctcctggggctcctgctactctggctccgaggtgccagatgtgacatccagatgacccagtctccttcctccctgtctgcttcatagganacagagtcgccatcacttgccggcaagtcagaccatacagctatttaatgtatcagcagacgacaagggaaacncccctagaacctcctagacttctctgactgtccttccacttctacgacgtaaggtcgtactcttacttacgtaaaggtttccaaggttggactaggtggacttcgtaggacctagtactttccacttctacacctatccttccgagttctacgacctaacgtagagttacttttacgacttaacttactactcgtacaactagtacgttactacttcgtacccttacg

SEQ ID NO: 67411 - DNA, 434 bp, Homo sapiens
  misc_feature: GYAE6OF02GF52U.44.46.E02.1.454.CMB.1.raw
  modified_base (427)..(434): a, c, t, g, unknown or other
  misc_feature (427)..(434): n is a, c, g, or t
tcagacagtatatacacgaccggtgctcgatttagactcatctacagggaaagggcctgatgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttggggggattatcgtttgggcccacactggggccagggaaccttggtcgtcgtctcctcagcttccaccaagggcccatcggtcttccccctggcgccctgctccaggagcacctctggggcacagcggcctgggctgcctggtcaaggactacttcctatatactgtctgagcgggctggcaaggcgcatagnnnnnnnn

SEQ ID NO: 67412 - DNA, 668 bp, Homo sapiens
  misc_feature: GYAE6OF02JWC3R.44.46.E02.1.454.CMB.1.raw
tcagacagtatatacacgaccggtgctcgatttagactcatctacagggaaagggggaggaactgctcagttaggacccagagggaaccatggaagccccagctcagcttctcttcctcctgctactctggctcccagataccaccggggaaattgtgttgacacaatctccagccaccctgtctttgtctccgaggggaaagagccaccctctcctgcagggccagtcagagtgttaggaactacttagcctggtatcaacagacacctggccaggcctcccaggcctcctcatctatcgatgcataccaatacggggccgacgggcacgtcccgagccgaggttcaggtcggcgaggtgggtctggagacgagtacttcactctacacctatccgagcggtacctaaggacggaccgggtaagtacgttttggacttagtttaacttacgtacgtaacctaaccgtaccgttaagccgtacgttcggaccgttaacggtacttacgggttttcgggacccgtaagggggtaaccctaagggtccgtaacggggtaagtaacgtaacggtaaaacgggtaacgttacgggtacgggtactacggtaccgaacccgtaagttccgttacggttcctttaccgaaccgtttcccgttaccccggtaacc

SEQ ID NO: 67413 - DNA, 567 bp, Homo sapiens
  misc_feature: GYAE6OF02GD21F.44.46.E02.1.454.CMB.1.raw
  modified_base (203)..(203): a, c, t, g, unknown or other
  misc_feature (203)..(203): n is a, c, g, or t
  modified_base (398)..(398): a, c, t, g, unknown or other
  misc_feature (398)..(398): n is a, c, g, or t
tcagacagtatatacacgaccggtgctcgatttagactcatctacagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaagngccaccctctcctgcagggccagtcagagtgttaggaactacttagcctggtatcaacagacacctggccaggcctcccaggctcctcatctatgatgcatccaagtacgggccgcgggcactcccagccgaggttcaggtggcaggtgggtctgagacagcttcactctcacatcagcgctagagccggaagtntttgactagtttattactgtcagactagttataatgtactcggtcccttcccgttcggaccgtaagggaccaccggtacgtaggaacgtaacgttaacgacgttggtacggtctcgacctaacctacttcgttcgttccttacctaccttcccgttccccgaccttacg

SEQ ID NO: 67414 - DNA, 563 bp, Homo sapiens
  misc_feature: GYAE6OF02IPP5S.44.46.E02.1.454.CMB.1.raw
  modified_base (346)..(346): a, c, t, g, unknown or other
  misc_feature (346)..(346): n is a, c, g, or t
  modified_base (481)..(481): a, c, t, g, unknown or other
  misc_feature (481)..(481): n is a, c, g, or t
tcagacagtatatacacgaccggtgctcgatttagactcatctacagggaaagggggggggtaggtcccctgtggaaaaagggtcagaggccaaaaggatgggagggggtcaggctggaactgaggagtcagtctcagtcaggacacagcatggacatgagggtccccgctcagctcctggggctcctgctactctggctccgaggtgccagatgtgacatccagatgacccagtctccttcctccctgtctgcttctataggagacagagtcgccatcacttgccggcaagtcagaccattaacagacttaatttaaattgtatcagcaagagaccgaagggaancccctagaactctagactctctgctcgtcttccacttctcgcgtaaggtggagttccttacgttacgtaaggttcaggtcgctaggtggatcgtagggactagtacttcgactctacacctattctcctagtctnacctaacgtagtacgttactttcgaacttaacttactacgttacgtacaacgtacgtagttactacttccgtaccctttacg

SEQ ID NO: 67415 - DNA, 574 bp, Homo sapiens
  misc_feature: GYAE6OF02H05AN.44.46.E02.1.454.CMB.1.raw
  modified_base (203)..(203): a, c, t, g, unknown or other
  misc_feature (203)..(203): n is a, c, g, or t
tcagacagtatatacacgaccggtgctcgatttagactcatctacagggaaagggggaggaactgctcagttaggacccagagggaaccatggaagccccagcgcagcttctcttcctcctgctactctggctcccagacaccactggagaaatagtgatgacgcagtctccagccaccctgtctgtgtctccgaggggaaancgccaccctctcctgcagggccagtcagagtgttaccagcaacttagcctggtaccaccagaaacctgggcaggctccaggctcctcatcatggaacatccaccgagggccacgtggtactccccaccgaggttcaggtggcaggtcggggtccgggacaggtagttcactctcaccatcagcggcctgcagtctggagtatttgctagttattacgtgtcagctagttataatactcggtccttctacgtacgtttcggggacgggggtacctaagggtggacgtaatacgaaacgtacgttggtacggtcgcggtaccaaccgtcgttacgttcgtttccgttacctacttcccgttcccgtcctaacg

SEQ ID NO: 67416 - DNA, 435 bp, Homo sapiens
  misc_feature: GYAE6OF02GC29A.44.46.E02.1.454.CMB.1.raw
  modified_base (430)..(435): a, c, t, g, unknown or other
  misc_feature (430)..(435): n is a, c, g, or t
tcagacagtatatacacgaccggtgctcgatttagactcatctacagggaaagggcctgatgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttgggggattatcgtttgggcccacactggggccagggaaccttggtcgtcgtctcctcagcttccaccaagggcccatcggtcttccccctggccgccctgctccaggagcacctctgggggcacgagcggccctgggctgcctggtcaaggactacttcctatatactgtctgagcgggctggcaaggcgcatagnnnnnn

SEQ ID NO: 67417 - DNA, 433 bp, Homo sapiens
  misc_feature: GYAE6OF02GV2LQ.44.46.E02.1.454.CMB.1.raw
  modified_base (258)..(258): a, c, t, g, unknown or other
  misc_feature (258)..(258): n is a, c, g, or t
  modified_base (428)..(433): a, c, t, g, unknown or other
  misc_feature (428)..(433): n is a, c, g, or t
tcagacagtatatacacgaccggtgctcgatttagactcatctacagggaaagggcctgatgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttggggggattatcgtttgggcccanactggggccagggaaccttggtcgtcgtctcctcagcttccaccaagggcccatcggtcttccccctggcgccctgctccaggagcacctctgggggcacagcggccctgggctgcctggtcaaggctacttcctatatactgtctgagcgggctggcaaggcgcatagnnnnnn

SEQ ID NO: 67418 - DNA, 526 bp, Homo sapiens
  misc_feature: GYAE6OF02GM484.44.46.E02.1.454.CMB.1.raw
  modified_base (366)..(366): a, c, t, g, unknown or other
  misc_feature (366)..(366): n is a, c, g, or t
tcagacagtatatacacgaccggtgctcgatttagactcatctacagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaagagccaccctctcctgcagggccagtcagagtgttagcagcaacttagcctcgtaccagcagaaatctggccaggctcccaggcctcctcatctatggtgcatcccaccagggccacgtggtactcccgagccaggttcagtggcaggtcgggtctgggacaggngttcactctcacctatcagcagcctgcagtctgaagtatttgctagtttattactgtcagctagtatatgactgcctccgtcgacaacgggcacgactggagtactaacgaacgtgtacggctcgacctacgtacttccgtacgttccttccacttcccg

SEQ ID NO: 67419 - DNA, 696 bp, Homo sapiens
  misc_feature: GYAE6OF02IYBF2.44.46.E02.1.454.CMB.1.raw
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
tcagacagtatatacacgaccggtgctcgatttagactcatctacagggaaaggggagctctgggagaggagcccagcactagaagtcggcggtgtttccattcggtgatcagcactgaacacagaggactcaccatggagtttgggctgagctgggttttcctcgttgcttcttttaagaggtgtccactgtcaggtgcacctggtggagtctgggggagcgtggtccagcctgggaggtccctgagactctcctgtgaagcctcgtggattttagttcaggttggttctggcatgcacgttggggtccnccaggcctccgaggcgaaggggccgagttggtgcagttanagcacatcgatgggaattctaggaaattattancgtcgaacgtacctccggtaggaacggggtcccgtaatttcccaaccgtattcctaccgtaaggaacgtaaccctaaacgtttaccccgggaaacttacgtttggttaacggttacctttagggtaaaacttgggtaccctaacgggtcccgttaagggacggtaacggttaccggtaacgggtaaccgttccgggtactttaccgttacggttaacgttttaccggttggtacggacggttacgggtaacggttaccgggggtagggtttagggttaagggtttaacggtttacggttaccccggggacgg

SEQ ID NO: 67420 - DNA, 649 bp, Homo sapiens
  misc_feature: GYAE6OF02JN4B9.44.46.E02.1.454.CMB.1.raw
  modified_base (201)..(201): a, c, t, g, unknown or other
  misc_feature (201)..(201): n is a, c, g, or t
tcagacagtatatacacgaccggtgctcgatttagactcatctacagggaaagggggaggaactgctcagttaggacccagagggaaccatggaagccccagctcagcttctcttcctcctgctactctggcctcccagataccaccggggaaattcgtgttgacacaatctccagccacctgtcttgtctccgagggaancgccacctctcctgcgagggccagtcagtcgtgttaggaactacttagcctggtactcaacgtagacaccgtggaccaggcctcccgaggcctcctcatctatgatgcctataccgaagtcgggcccgacggctactcccgagccgtaggttcaggtggccgtaggtcgggtactaggcgtaactaggtaccttcgaaccttgtaacccgacctatcccggaaggtccccggacgtaacgacggtaccgggtaacgtacgtttcgacgttaggtttaactttaccgtacgtacgaaccgtaccgtagtaccgtacgtacggtccttaacggtacgttacggttcgggtaccgtacgggtaacctacggtcgtaggacgcgtaacgaacgtcgtgtacggctacggaccactacgtacgttcgtacgttacgacgtttcctaccgtacc

SEQ ID NO: 67421 - DNA, 712 bp, Homo sapiens
  misc_feature: GYAE6OF02I8HCN.44.46.E02.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
tcagacagtatatacacgaccggtgctcgatttagactcatctacagggaaagggggaggaactgctcagttaggacccagagggaaccatggaagccccagctcagcttctcttcctcctgctactctggcctcccagataccaccggggaaattgtgttgacacaatctccagccaccctgtctttgtctccgaggggaaanacgccaccctctcctgcagggccagtcagngtgtagactactagcctggtatcaacagaccacgtggaccaggcctcccgaggcctacctcatctatgatgacatccgaagtacgggccgcgggacactcccgagccgtaggttcgaggtcggacgtaggttcgggtcctaggacgacgtagtaccttacgaccttcgaccaaccagtccgaacggtccggaccgtaacggaaccggaccgggtaaagttacgtttacggtacgttaacggtttaacgttaccgtacgtaaccgtaaaccgtaccggtaacgtaccgtaccgtacggtaccggttaaggttaccgttaacggttttaccgggaccggtaaccggggtaaccgtaacggtcggtaacggtaacgtacgttaaccgaacggtaacggttacggtacggccgtaacggtaccgtaaccgtacgttaccgttacgttaccgttaccgtaccgttcccgttaccccggtaacc

SEQ ID NO: 67422 - DNA, 417 bp, Homo sapiens
  misc_feature: GYAE6OF02F2TX3.44.46.E02.1.454.CMB.1.raw
  modified_base (160)..(160): a, c, t, g, unknown or other
  misc_feature (160)..(160): n is a, c, g, or t
  modified_base (310)..(310): a, c, t, g, unknown or other
  misc_feature (310)..(310): n is a, c, g, or t
  modified_base (401)..(417): a, c, t, g, unknown or other
  misc_feature (401)..(417): n is a, c, g, or t
tcagacagtatatacacgaccggtgctcgatttagactcatctacagggaaaggggctggagtgggttggccgtattagaaccaaagctgacggtgggacagcagactacgctgcacccgtgaaaggcagattcaccatctcaagagatgattcaaaagntacggtgtctctgcagatgaacagcctgaacaccgaggacacagccgtctattactgtctgggatggttcagttcgggccagggaccctggtcaccgtctcctcagcctccaccaggcccatcggtctcccctgcgccctgctcaggacncacctcgagagcacagccggccctgggctcgcctggtcaaggactacttcctatactactgtctgagcgggctgggcaaggcgcatagcannnnnnnnnnnnnnnnn

SEQ ID NO: 67423 - DNA, 519 bp, Homo sapiens
  misc_feature: GYAE6OF02GLDXT.44.46.E02.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
tcagacagtatatacacgaccggtgctcgatttagactcatctacagggaaagggggaggaactgctcagttaggacccagagggaaccatggaagccccagctcagcttctcttcctcctgctactctggctcccagataccaccggggaaattgtgttgacacaatctccagccaccctgtctttgtctccaggggaaanagccaccctctcctgcagggccagtcagagtgttaggaactacttagcctggtatcaacngacacctggccaggctcccaggctcctcatcctatgatgcatccaataggccgcgggcatcccagccaggttcagtggcagtgggtctgagacagacttcactctcaccatcagcggcctagagccgaagtatttgctagtttattactgtcaacaccgtagcgactggcctaggtacagttttcggccgaggggaccaagcgtggagctacgaacgacgtgtcggctgcaccatctcgtcttcattcctcccgtcc

SEQ ID NO: 67424 - DNA, 427 bp, Homo sapiens
  misc_feature: GYAE6OF02F5YUM.44.46.E02.1.454.CMB.1.raw
  modified_base (305)..(305): a, c, t, g, unknown or other
  misc_feature (305)..(305): n is a, c, g, or t
  modified_base (412)..(427): a, c, t, g, unknown or other
  misc_feature (412)..(427): n is a, c, g, or t
tcagacagtatatacacgaccggtgctcgatttagactcatctacagggaaaggggctggagtgggttggccgtattagaaccaaatctgacggtgggacagcagactacgctgcacccgtgaaaggcagattcaccatctcaagagatgattacaaaagatacggtgtctctgcagatgaacagcctgaacaccgaggacacagccgtctattactgtctgggattggttcagttcgggccagggaacccctggtccaccgtctcctcagcctccaccaaggcccatcggtctccccctggccnccctcgctccaggacgcacctccgagacgcacagccggccctgggctgcctggtcaagctacttcctatactactgtctggagcgggctggcaacgggcgcagtagnnnnnnnnnnnnnnnn

SEQ ID NO: 67425 - DNA, 559 bp, Homo sapiens
  misc_feature: GYAE6OF02IT9NK.44.46.E02.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
  modified_base (458)..(458): a, c, t, g, unknown or other
  misc_feature (458)..(458): n is a, c, g, or t
tcagacagtatatacacgaccggtgctcgatttagactcatctacagggaaagggggggggtaggtccctgtggaaaagggtcagaggccaaaggatgggagggggtcaggctggaactgaggagtcagtctcagtcaggacacagcatggacatgagggtccccgctcagctcctggggctcctgctactctggctcgaggtnccagatgtgacatccagatgacccagtctccttcctccctgtctgcctttactataggagacagacgtcgaccatccacttgccggnaagtcagaccattaacagctaatttaaatggtatcagcagtagaccaagggaaacnccctagaactccngactctncgctncccttcactctcgacgagtgactctctacgtagttcagtgacgngtggatgtcggacactattcactctacacctataccacgacncgcctcgacgaccgcgtacggtacgtcgtttaccgaccgttacttactttaccgtacgtacccgtaaacttaatttacgtttactttttaccgttaacccg

SEQ ID NO: 67426 - DNA, 456 bp, Homo sapiens
  misc_feature: GYAE6OF02HSS8B.44.46.E02.1.454.CMB.1.raw
  modified_base (445)..(456): a, c, t, g, unknown or other
  misc_feature (445)..(456): n is a, c, g, or t
tcagacagtatatacacgaccggtgctcgatttagactcatctacagggaaagggcctgatgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacgttgggggattatcgtttgggcccacactggggccagggaccttggtcgtcgtctcctcagcttccaccaagggcccatccggtccttccccctgggccgcccctgcctccaggacgccaccgtcgtgggggcacgacggccggcccgtgggctcgccgtggtcaaggacctacttcctatatactgtctgagcgggctggcaggcgcatagnnnnnnnnnnnn

SEQ ID NO: 67427 - DNA, 624 bp, Homo sapiens
  misc_feature: GYAE6OF02I51K3.44.46.E02.1.454.CMB.1.raw
  modified_base (203)..(203): a, c, t, g, unknown or other
  misc_feature (203)..(203): n is a, c, g, or t
tcagacagtatatacacgaccggtgctcgatttagactcatctacaggggaaagggggaggaactgctcagttaggacccagacggaaccatggaagccccagcgcagcttctcttcctcctgctactctggctcccagacaccactggagaaatagtgatgacgcagtctccagccacctgtctctgtctccgaggggaaancgccaccctctcctgcagggccagtcagagtgttggcagcagcgtagcctggtccagcagaacctggccagactcccaggcctcctcatctataccacactccaccgagggcccacgttcggtactccccaggcctaaggactttacgaggtcgcacggttcgggtcgtcggggacaggtacgttcacgtcctacaacccgtataccaggtccacgccttacgccgtacgtactgtaaacgtattttggactttagtttattactggtacagtctaggtattaggtacgtacgttcggtacccgttacgttccgttaccggtttccggtaccccgttacgggacctacccggtaagttaccgtttaacgttaccgtaaaccggtacttacgggtaccggtcctaacggtccctacgttacg

SEQ ID NO: 67428 - DNA, 556 bp, Homo sapiens
  misc_feature: GYAE6OF02GW3KA.44.46.E02.1.454.CMB.1.raw
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
  modified_base (529)..(529): a, c, t, g, unknown or other
  misc_feature (529)..(529): n is a, c, g, or t
  modified_base (531)..(532): a, c, t, g, unknown or other
  misc_feature (531)..(532): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(540): a, c, t, g, unknown or other
  misc_feature (538)..(540): n is a, c, g, or t
  modified_base (542)..(544): a, c, t, g, unknown or other
  misc_feature (542)..(544): n is a, c, g, or t
  modified_base (546)..(547): a, c, t, g, unknown or other
  misc_feature (546)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(556): a, c, t, g, unknown or other
  misc_feature (553)..(556): n is a, c, g, or t
tcagacagtatatacacgaccggtgctcgatttagactcatctacagggaaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttatactgtgcggaggggacctaccgaaggaaacggttcggggaatcaataaactactactatttgatggatggtcgtggggcagggggacgtcggtcaccgtctcctcagcttccaccacgggcccagtccggtcctccccgtggccgccctcgcctccgaggcgcacccgtcggtcggggcacgacggccggtcccgtggctcggcccgtggtacccgaaggttaccctaccttacccgtacgtaccttacgtcgcgttcggacggccgggtcgtcgggacgaacgggccgtacgagttcgancgncagtnacgtcagcgagcgngnnancngnnngnnngnngngngnnnn

SEQ ID NO: 67429 - DNA, 690 bp, Homo sapiens
  misc_feature: GYAE6OF02IVKDJ.44.46.E02.1.454.CMB.1.raw
  modified_base (404)..(404): a, c, t, g, unknown or other
  misc_feature (404)..(404): n is a, c, g, or t
tcagacagtatatacacgaccggtgctcgatttagactcatctacagggaaagggggggggtaggtcccctgtggaaaaagggtcagaggccaaaggatgggagggggtcaggctggaactgaggagtcagtctcagtcaggacacagcatggacatgagggtcccgctcagctcctggggctcctgctactctggctccgaggtcgccagatgtgacatccagatcgacccagtcctccttcctccctgtccttcttctgttggacgcagcgtcaccatcacttcggccggacacgtcgtacggtttcgttttcggtcgtcgttggttcgtccttgggttacaaacggtaaaaggggcgaccggtacccgtaagtccgtcgtcctcgtaccgtacgaaaccgngtaacgtagggaagtacggtaccgttcccgtacgtaacggttcgtacggtacgcccgtacgtccggtagggttcggggtacggggtcggtaccgttaccgtacttaccgtaccgtaccgtaacgttacgccgtaccgttcggaccggtacccgtaggtaacgtacttcgtacgtaccttaaccgtttatttccgttacgtcgtaagacgttagtacttactagtaacgttccgttacccgttctaccgtttcgacggttacgggacctagtacgtaggactaacgg

SEQ ID NO: 67430 - DNA, 445 bp, Homo sapiens
  misc_feature: GYAE6OF02HPHBO.44.46.E02.1.454.CMB.1.raw
  modified_base (432)..(445): a, c, t, g, unknown or other
  misc_feature (432)..(445): n is a, c, g, or t
tcagacagtatatacacgaccggtgctcgatttagactcatctacagggaaagggcctgatgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttgggggattatcgtttgggcccacacgtggggccagggaacctttggtcgtcgtctcctcagcttccaccaaggcccatcggtcttcccccgtggccgccctgctccaggagcacctcgtggggcacgacgccggcctgggctgccgtggtcaggactacttcctatactactgtctgagcggctggcaaggcgcatgnnnnnnnnnnnnnn

SEQ ID NO: 67431 - DNA, 660 bp, Homo sapiens
  misc_feature: GYAE6OF02HVND2.44.46.E02.1.454.CMB.1.raw
tcagacagtatatacacgaccggtgctcgatttagactcatctacagggaaagggggaggaactgctcagttaggacccagagggaaccatggaagccccagctcagcttctcttcctcctgctactctggctcccagataccaccggggaaattgtgttgacacaatctccagccaccctgtctttgtctccgaggggaaagacgccaccctctcctgcagggccagtcagagtagttaggaactacttagcctggtatcaaacagacactcgcacggctccacgactcctcactctactgatgtcactaccaacgtacgggaccggcgggaccgactaccacgaccgacggttactaggtaggcgaggtggtacgtgagttttacgagacgtactactctacaccactacacgcggaccgtagacggaccggaacggtagtttagtactaagtttaacttacgttacgtacctaactacgtacgtaccgacgtacggtaccgttaacggtaacgttaacggtttacggtaccgaacgggaccgtaacgtacgtaggtacgtaccgtaacgtaaacgtaacgtacggtacggtaccgtacggtacgtaacccgtacgttacgttacgttacttacctacgttaccttaccccgtacccg

SEQ ID NO: 67432 - DNA, 629 bp, Homo sapiens
  misc_feature: GYAE6OF02I0TIU.44.46.E02.1.454.CMB.1.raw
tcagacagtatatacacgaccggtgctcgatttagactcatctacagggaaagggggggggtaggtcccctgtggaaaaagggtcagaggccaaaggatgggagggggtcaggctggaactgaggagtcagtctcagtcaggacacagcatggacatgagggtccccgctcagctcctgggctcctgctactctggctccgaggtgccagatgtgacatccagatgacccagtcctccttccctcctgtctcgcttctataggagacagagtccgccatcacgttgccgggacaagtcagaccattaacagctatttaaatggtatcagcagagaccgaagggaacgcccctaggaactcctgactctctgtctcgtccctcccacttccgtcgcgaagggtcgtagttccgtcgttacgtaacggttcacgggttggtaccgtaggttaggtacgttcggtacgggtactaacgttacgtttaccacgtttaccttacctaaccctaccgttccgttccgtacgttcctcgtacctaccgtagtacttagtttacgtaccttaactttacctacttacgttaaccgtaactacggtatttacgtacgttcccgtccccgtttaaccgg

SEQ ID NO: 67433 - DNA, 879 bp, Homo sapiens
  misc_feature: GYAE6OF02HYZ83.44.46.E02.1.454.CMB.1.raw
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
  modified_base (801)..(801): a, c, t, g, unknown or other
  misc_feature (801)..(801): n is a, c, g, or t
  modified_base (834)..(834): a, c, t, g, unknown or other
  misc_feature (834)..(834): n is a, c, g, or t
tcagacagtatatacacgaccggtgctcgatttagactcatctacagggaaaggggggaggaacgtgctcagttaggaccagagggaaccagtggaacgccccagctcagcttctcttcctcctgcctacgtctggcctcccagactaccgaacccggggtaaatttggtcgttacgaactacctaactcctaccacggtcccacccttgttccttttcgtccgtacccggaaaggggggaaacaccggcccaccccctttcctaccgngcccggacgggccctagggtaccagggtaacgttcggttaanaccgaaggtacctaaaacgttcgcccgttacggtaacccaggtaccaacgtaaaaccgttcgtaccgggaccaacgggtcctacccccgagggtcccctccgtactacctacgttactaggaacttcgtacacgtaccgtaacgtccgggttacgaacgtccgggaacccaccccgaaacggtccgtaacgggttaccgtaaggttccggtaccgtaaggggtttcggggtacgttacgggaaacgttacggaaccttccggtaaacccttcccgtaaccgttacccgtacgtaacccggattaaccgaacgaacgttaaccgaccgttaagggtaaactttcgttaaccgggtactttaaggttttaacctttaagcgttaaacccgtaaggccctaaggggtacccttaacccgttccgaaccgggttcctacccgtaccggtttaccggttaccggggggaaccgggtaccggtacgttagggaacncggttaccgtaacgggtacaacggtttccgggngtccgtaacgccacgtactccgtttgacccttacgtcccgttacc

SEQ ID NO: 67434 - DNA, 782 bp, Homo sapiens
  misc_feature: GYAE6OF02J17I5.44.46.E02.1.454.CMB.1.raw
  modified_base (207)..(207): a, c, t, g, unknown or other
  misc_feature (207)..(207): n is a, c, g, or t
tcagacagtatatacacgaccggtgctcgatttagactcatctacagggaaagggggaggaactgctcagttaggaccagagggaaccatggaagcccagctcagcttctcttcctcctgctactctcggctcccagtactaccgaccggggaaattgtcgttgacacaatctccagccaccctgtctttgtctccgaggggtaaancgccaccctctcctgccgacgggccagtccgagacgttggttaggaacttacgttagccttaggtactcaaacgagacctaaccgtggacccaggtacctcccgaggtccttccctacacttacgttatcgtacgtcgacctaactccgtaaaggtacggggtcccggtaccgggaccaaccgttccccgaaacgggtccccgttaagggtttcccgaaagggttcgggacctacgggttcgggggttacctagggaaccggtacgaacggttacccgttaccgtaacccgtttcaacccggttaccacgttaccgacggtacccggaccgttagaccggtaaccgggtaagttaccgttttagacgtttaacgtttacgttacttacggtacctaacgtccgttaagcgtactcggtaccgttagtaccggttacgttacggaccgttacggggaacccgtagtacggtcggaacgtaccgtaacgtaacgtaacggtttcggtacggtactaacggtcctaaccgtcggttaccgttcgttaccttacgtaaccgtttcccttaccccggtac

SEQ ID NO: 67435 - DNA, 429 bp, Homo sapiens
  misc_feature: GYAE6OF02F8GYI.44.46.E02.1.454.CMB.1.raw
  modified_base (159)..(159): a, c, t, g, unknown or other
  misc_feature (159)..(159): n is a, c, g, or t
  modified_base (408)..(429): a, c, t, g, unknown or other
  misc_feature (408)..(429): n is a, c, g, or t
tcagacagtatatacacgaccggtgctcgatttagactcatctacagggaaagggctggagtgggttggccgtattagaaccaaagctgacggtgggacagcagactacgctgcacccgtgaaaggcagattcaccatctcaagagatgattcaaaagntacggtgtctctgcagatgaacagcctgaacaccgaggacacagccgtctattactgtctgggatggtttcattcgggccagggaaccctggtcaccgtctcctcagcctccaccgaagggccccatcggtcttccccctggccgccctgcctccaggcgcacctccgagacgcacagccggccctgggcctgcctgtcaacggactacttctcgatcgcgtctgagcgggctggccaaggcgcatagnnnnnnnnnnnnnnnnnnnnnn

SEQ ID NO: 67436 - DNA, 775 bp, Homo sapiens
  misc_feature: GYAE6OF02HYPBI.44.46.E02.1.454.CMB.1.raw
  modified_base (169)..(169): a, c, t, g, unknown or other
  misc_feature (169)..(169): n is a, c, g, or t
tcagacagtatatacacgaccggtgctcgatttagactcatctacagggaaagggggggggtaggtcccctgtggaaaaagggtcagaggccaaaggatgggagggggtcaggctggaactgaggagtcagtctcagtcaggacacagcatggacatgagggtccccgntcagctccgtgggctcctgctactcgtgctccgaggtcgccagtatgtgactatccagactacgaccctagtcctcctttaccctccctgtctcgtcttacttagaggagtacgaagcgtccgaccatacctacgttcggccgggtacaagtcaacggaacctaagttaaccagtactttaaactttttaaaagtcggttaatcaacggtactaacggaacggaacccggtaaagggaaacccgtccccttaaggaaacccttccgttagaactttcccgttgtaaccgcgtttcgacccttaccgtactcgttacgaacggtaggtacggtacgttaccttacgttacgtaggttccgaacggaccgggtactacgggttaacgtacgtaccggttaacgggacctaaaggttaccttacccgttaccgtacccttaaccgtaaccgtaagtacccggtaaccgtaccgtaaccgtcccgtaagtacccgacgttacttacggtaacgtacgtttttacgtttaacgaaccctttttaaacgttaaccgtttaaccgtacgtaaacccgtaaacgtttaacggtttaaagtaaccgttttaaacg

SEQ ID NO: 67437 - DNA, 787 bp, Homo sapiens
  misc_feature: GYAE6OF02HRRFA.44.46.E02.1.454.CMB.1.raw
tcagacagtatatacacgaccggtgctcgatttagactcatctacagggaaaggggagctctgggagaggagcccagcactagaagtcggcggtgtttccattcggtgatcagcactgaacaaagaggactcaccatggagtttgggctgagcgttgggttttcctcgttgcttcttttaagaggtgtccactgtcaggtgcaccgtggtggagtcgtgggggagcgtggtccagccgtgggacgtccctgacgactcgtcctagtacgaagtcccttcgtggtaattttagttccaggttcggttccgtggcctagtgacctacggttcgggtcccgcgacggcctaccgagggcccgaagggggtccgtaggttcgggttcgacgtaaggtttactacggcaaacaggttacgaagttagggtaacgttttcgaagtaaagttatttacgagtaaccgtacgtaccgttacccgggtacgggtaaacgggtcccggttaagttttccccggtacccggttacccttaccggaaacggtaaccggtaaccttaaacgtttaacccgaaaacggttaaacccgtaaccggttacggttaaccttaaccgtaaacgtaaaacgtacggtaaaacgttaaacgtttacggaaacggtaccggtaacggaaccgtaaccggttccgtaccgttacgtttacgttatttacgtacggtaaccgaccgtaccgtacgttacggttccgtaacgggttccgggaccgcgggtacgttcccggtcgttacccgg

SEQ ID NO: 67438 - DNA, 848 bp, Homo sapiens
  misc_feature: GYAE6OF02G43UA.44.46.E02.1.454.CMB.1.raw
  modified_base (205)..(205): a, c, t, g, unknown or other
  misc_feature (205)..(205): n is a, c, g, or t
  modified_base (273)..(273): a, c, t, g, unknown or other
  misc_feature (273)..(273): n is a, c, g, or t
tcagacagtatatacacgaccggtgctcgatttagactcatctacaggggaaagggggaggaactgctcagttaggacccagagggaaccatggaagccccagctcagcttctcttcctcctgctactctggcctcccagataccaccgggggaaattgtgttgacacaatctccagcccaccctgtctttgctccgaggggaancgccaccctctcctgcgacgggccagtcagtagttgttaaggaaccttagttacgcctaggtatcaangacaccgtggccaggcctcccaggtcctcctacatctagtgatgcagtaccaagtacggggccgcgggacacgtcccaggccgtagggtacacggtgcgtaggttcggggtactggaacgaccaggttacctttaccgtacctacctacccaacctacgtaccggaaccgggttcccgggtaaccgttaacgggaaccggggtaaccgggtaaacggttttacggtttttacggaacgttttaacggttttaaccgttacggtttacccgtttaaccttaaacccggtaaaccggttttaaacgggacggtttaccgggtaacccctttaaccttaaacgttcctttttaacccggttacccggttttaccccggggtaaccccgttaaacggggtaaaccttaaaacggggtttacgtaaacctttaaacgtaacccggttaaaaacggttcccgttttacggggtaccggttaaccgttacccggtaacccgttaacccgttacgttttacccggttaccggtttaaccccgtttacttaaccccggttttccccgtaacccccgggttaacc

SEQ ID NO: 67439 - DNA, 598 bp, Homo sapiens
  misc_feature: GYAE6OF02GGQRS.44.46.E02.1.454.CMB.1.raw
  modified_base (205)..(205): a, c, t, g, unknown or other
  misc_feature (205)..(205): n is a, c, g, or t
  modified_base (576)..(576): a, c, t, g, unknown or other
  misc_feature (576)..(576): n is a, c, g, or t
tcagacagtatatacacgaccggtgctcgatttagactcatctacagggaaagggggaggaactgctcagttaggacccagagggaaccatggaagccccagctcagcttctcttcctcctgcctactctggcctcccagactacccaccggagagattgtgttgacacagtctccaggcaccctgtctttgtctccgagggganagagccaccctctcctggtacgggccagtcggagttgttgacgtaacgtacctagccttggtaacccaacgagaaacctggaccaggcctcccaggcctcccgtcattctatgtatgcatacccagtagggtcaacgtggccacccgagacgagttcaggtcgacgagtgggtactggggactagtaccttcactctaccgaccgtcagactaagtacgtacacgtcgtagaagttatttgacgttagtttaacttcgtagtactagacgtcgtactccgtccgacggcctctacgtcggttacgggccggggtaaccgtaggtagagactacgtacgacgtacgcgtcggcgtcgacctacgagtcgttntacctctacttccgtcctaccg

SEQ ID NO: 67440 - DNA, 685 bp, Homo sapiens
  misc_feature: GYAE6OF02G9V5I.44.46.E02.1.454.CMB.1.raw
  modified_base (204)..(204): a, c, t, g, unknown or other
  misc_feature (204)..(204): n is a, c, g, or t
tcagacagtatatacacgaccggtgctcgatttagactcatctacagggaaagggggaggaactgctcagttaggacccagagggaaccatggaagcccccagctcagcttctcttcctcctgctactctggctcccagataccaccggggaaattgtgttgacacaatctccagccaccctgtctttgtctccaggggaaagngccaccctctcctgcagggccagtcagagtgttaggaactacttagcctggtatcaacagacacctggccaggctcccgaggctcctcatctatgatgcatccaacgagggtcacgtggccaccccgagaccgtagggttccaggtcggcgaggtggggtcctggggaccagtaccttcgaccttctacacccgtacacgtacaagtcgtacacgtcgtagaagtattttcgacttagtttattacgttgtacgtagtcgtacgtccgtttcccgtaccgtaccggtaccccgccgttacccgtaccgggttttacccggggaccgggggggtaaccgtaaacgggggttacggacgggttaacgtaccgtaacgggtaccgtaacggttacgggtacggtaccgttaccggtaccgtaacccgtaccgttacgtttcggttccttttaccgtaccctttcccgttacccccgtaaccccg

SEQ ID NO: 67441 - DNA, 873 bp, Homo sapiens
  misc_feature: GYAE6OF02IXMZO.44.46.E02.1.454.CMB.1.raw
tcagacagtatatacacgaccggtgctcgatttagactcatctacagggaaagggggagaactgctcagttaggacccagagggaaccatggaagccccagctcagcttctcttcctcctgctactctggctcccagataccactggagaaatagtgatgacgcagtctccagcccacctgtactgtgtctcgagggatagcgtccctaccgtctcctgcacggggccagtcaagtaattagttacggccgaccgtaacttacgttacggccgttacggtacccagtccaaggacggaccctcggacctacgcccttacccgaggtccctccctacacgttcccggacggtcgactaccgtacccgaacgaccggggtacccacggttccggccgtaccccgttagggaaccgttacggtttccggaaacgttcggggaccgtttaccgggtacggggttccgtaggggaccctaacggttcccttaaccgtaacccgttcgtaccgactaacgtcgaaaccgtcgaaccgggttcggtacggtaacgttcccggtaagttaacggtttcgttttaacggacgtttagtttaacccgtttaacggtttaacctaccggtttaacctttacggttttaaccccgttaaggtttccccgggttttaaacccccgttttaccggtttacccgggtttaaaccggttttaccgggaaacccggttaaacccggggtaaaaaccctttaacgggtaacggtttaaaaccgtaacccggtaaaacggttacccggttacggtaacccgggttaactccgttaaacccctacggtttaccggtttaacccgttaccggttttacccgtacttacccccgg

SEQ ID NO: 67442 - DNA, 692 bp, Homo sapiens
  misc_feature: GYAE6OF02FTDHP.44.46.E02.1.454.CMB.1.raw
  modified_base (201)..(201): a, c, t, g, unknown or other
  misc_feature (201)..(201): n is a, c, g, or t
tcagacagtatatacacgaccggtgctcgatttagactcatctacagggaaagggagaggaactgctcagttaggacccagagggaaccatggaagccccagctcagcttctcttcctcctgctactctggctcccagattccaccggcgaaattgtgttgacacaatctccagccacctgtctttgtctccgaggggaanacgccaccctctcctgcacgggccagtcagagtgtagaactactagctgtatcaacagacaccgtggccacggcctcccgaggcctcctcactctagtgatcgacactccaaggtacggggccgcgggccacgtcccacgtccgtaggttcgaggtcggcgtaggtcgggttcaggagacgtacgtaccttacgacttccgtacaaccctactacgacggccgtaccgtaacggacggtaccgggtaagtttacgtttacggtaacgttagttttaacgttacgttacgtacctaaaccgtaccgttacgccggtacgtacgggtaccgttaagggttaccgttacggtttacgggaccggtacggggaacctacgggtacgttacgggaacgttaccgtaaccggtaaaccggtacgtacgggttaccggtaccgtacgacccgtaccgtcgtttacccgttacggttcctttactaccgtttacccccg

SEQ ID NO: 67443 - DNA, 578 bp, Homo sapiens
  misc_feature: GYAE6OF02H7DY2.44.46.E02.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
tcagacagtatatacacgaccggtgctcgatttagactcatctacagggaaagggggaggaactgctcagttaggacccagagggaaccatggaagccccagctcagcttctcttcctcctgctactctggctcccagataccaccggggaaattgtgttgacacatctccagccaccctgtcttgtctccgaggggaanagccaccctctccngcagggccagtcagagtgttaggaactacgttagcctggtatcaactagaccacgtcggaccagggcctcccgaggcctccctcgatctatgaatcgcactccaaggtcgggccgcgggccactccccagcctaggttcaggtggcaggtcggtngagactagtcttcacctcncacctncacggcgacgagacggacgaagtagttgcgtagttatactgtacaacgtacgtagcgtacgtcggcgtacgtacgtaggtttcggaccgtacgggaccgtaacgtcgtggacgtcgtaacgaacgtacgtggtacggtctcgaccgtacctctcgttactccttactacttccctacccgtccg

SEQ ID NO: 67444 - DNA, 684 bp, Homo sapiens
  misc_feature: GYAE6OF02I38SJ.44.46.E02.1.454.CMB.1.raw
  modified_base (391)..(391): a, c, t, g, unknown or other
  misc_feature (391)..(391): n is a, c, g, or t
  modified_base (582)..(582): a, c, t, g, unknown or other
  misc_feature (582)..(582): n is a, c, g, or t
  modified_base (593)..(593): a, c, t, g, unknown or other
  misc_feature (593)..(593): n is a, c, g, or t
  modified_base (599)..(599): a, c, t, g, unknown or other
  misc_feature (599)..(599): n is a, c, g, or t
  modified_base (631)..(631): a, c, t, g, unknown or other
  misc_feature (631)..(631): n is a, c, g, or t
  modified_base (664)..(664): a, c, t, g, unknown or other
  misc_feature (664)..(664): n is a, c, g, or t
tcagacagtatatacacgaccggtgctcgatttagactcatctacagggaaagggcctgatgtgggtctcacgtattaacaccgatgggattatcactggttactcagacgccgtgaagggccgattcatcatctccagagacaatgtacgaaaacacggtgtatttaacaaatgaacagtactaagagtcgaggacacggctcgtactactattgtgtagacgtacttatcgtatttcgtacggtggggtagttagttccggttacgggcccacgtacgtcggggaccgaacgggtaaccgttggtcgtcgttcctctcacgtcttaccaccgaacggcctacgtccggttccttccccgtggcccgtccctcgtccgtaccgacggacnccgtacctacggtcggggaccacgacggtccggtcccggtgggtacctcggtcccggttacggtaccgtaaacggtacccttaccgtttacccgttaagtaccttttaaccgtgtttacccggtacggaacggggtccgggtccggttacgggaaccgaaggggttccgaaaccgtaaggtactcgaacgngtacgacgacncggtanacgcgagacgcgtagtacgacgttcacgtagntcgtacgtcgacgagtactcgcgacgcgtacgngtacgtacgtacgtctcgtc

SEQ ID NO: 67445 - DNA, 547 bp, Homo sapiens
  misc_feature: GYAE6OF02H0VO8.44.46.E02.1.454.CMB.1.raw
  modified_base (372)..(372): a, c, t, g, unknown or other
  misc_feature (372)..(372): n is a, c, g, or t
  modified_base (431)..(431): a, c, t, g, unknown or other
  misc_feature (431)..(431): n is a, c, g, or t
  modified_base (515)..(516): a, c, t, g, unknown or other
  misc_feature (515)..(516): n is a, c, g, or t
  modified_base (519)..(519): a, c, t, g, unknown or other
  misc_feature (519)..(519): n is a, c, g, or t
  modified_base (521)..(542): a, c, t, g, unknown or other
  misc_feature (521)..(542): n is a, c, g, or t
  modified_base (544)..(547): a, c, t, g, unknown or other
  misc_feature (544)..(547): n is a, c, g, or t
tcagacagtatatacacgaccggtgctcgatttagactcatctacaggggaaagggggccggagtgggtggcagtcatctccgacgatggaagtgagaagtattactcagactccgtgaaggccgattcacatctccagagacaaattccaaagaacacgctgtaatctgacaaatgaacagcctagagagaccgaggacacggctgtgtattatgtgcgaggacattattagtaacgtactaccacctgcgtagggactactaacctaggtactggacgttcgtagggccgaaagggacccgtacggtaccaccgtacctaccctcgacggcccctaccaaccgaaacggcccagtccgtcccttcccccnggccacccctacctaccaagacaccacctcgtcggggcacgacggccggacccgtggcncgccgtggtacgaacggtcgtaacctttccgtatactactgtctaggacgacgggcgtaggacgaacggtcgaacgaacgtagnnatnannnnnnnnnnnnnnnnnnnnnnannnn

SEQ ID NO: 67446 - DNA, 931 bp, Homo sapiens
  misc_feature: GYAE6OF02HY31F.44.46.E02.1.454.CMB.1.raw
  modified_base (111)..(111): a, c, t, g, unknown or other
  misc_feature (111)..(111): n is a, c, g, or t
  modified_base (171)..(171): a, c, t, g, unknown or other
  misc_feature (171)..(171): n is a, c, g, or t
  modified_base (808)..(808): a, c, t, g, unknown or other
  misc_feature (808)..(808): n is a, c, g, or t
tcagacagtatatacacgaccggtgctcgatttagactcatctacagggaaaggggggggggtaggtcccctgtggaaaaagggtcagaggccaaaggatgggagggggtnaggctggaactgaggagtcagtctcagtcaggacacagcatggacatgacgggtccccgntcagcctccgtggggcttcctggtctactcgtcggtccgtccggtaggtcgccgtaaggtgtggtacgaacctagtacggaagtacgtacggaaccccgtaggtttcccttcccttttccccttccgtttcgtttccctttttccgttccgtttaggggtttcggggacgggtcctaggtcccggtacctaacccctagtcctaccggtttcgggccccggggtacgaggttccggagggttttccggtttttcggcggtcgtttcggttcttcccgttttaggtttacgaaaaaccgggtaaaagggggggcgtaacccgggttcccccgttaaaggggttcccgtaccggtttaccgtaccggttacgtaaccggtaaaaccacggtaccggttaaggggtaaaaccggtacggtaacccggtttccccgtaccggttaaagggttcccggacgttaacgggtcccgtaacggtccggtaaggggttccggggttacggggtcccgggttacgttacccgtaccttccggtacctaacccgtagtttaaccgcccgttaacgtcggtaccggtactacggtaagttaccgttcgaccgtttaaaccgtactttttacttgtacgtacggtacgtnttaacggtctttaactacggttaaccggtccccgttacccgggtttacttacccggttaccgggtacccgggaaccggggttaccttaagggtacccggttaacggtaaaccgtaaaccccgg

SEQ ID NO: 67447 - DNA, 847 bp, Homo sapiens
  misc_feature: GYAE6OF02IJYMD.44.46.E02.1.454.CMB.1.raw
  modified_base (207)..(207): a, c, t, g, unknown or other
  misc_feature (207)..(207): n is a, c, g, or t
  modified_base (334)..(334): a, c, t, g, unknown or other
  misc_feature (334)..(334): n is a, c, g, or t
tcagacagtatatacacgaccggtgctcgatttagactcatctacaggggaaagggggaggaactgctcagttaggacccagagggaaccatggagccccagctcagcttctctttcctcctgctactctgccccagactaccgacgggaattgtgttgaacacaatctccagcccaccctgttctttgtctccgaaggggaaacgngccctaccctctccgtgacgacggaccagtcagtagttaggttaaggaacttacgttacgccttggtactacaaacgacgacctacgtcggaccaggtccctaccgacggtcctccgtactaacttntaacgtgtatcggacacttaccgaaaacggtccgggacccggtcggacctacaccccaggacccgtagttacgtaggtcggtacgacggtcggtcgaggaaacgtcgacgtttaaccttcgaaccgtaccttacaacctacgtaccggaaccggtccgggtaaccgtaacgggtaaacccggttacccggggttaaacgttttacggtttttaacgtacggttttaaacgttttaaaccgtttacgtttaaccgttaacccgtaaacccgtttaaccgggtacgttaaccgggtacccggttcggttaaccggttaaaccggttttagttaacccgggttttaggaaccccggtaacggggaaacccttacgggtacggttaaacgggaccggttaaacggtaaggtaaaccggtcgttaccggtcgggtacttacccgggaactaacgttaccgttacgtttacccgttccgtttactaacccggttttaccccgtttccgaaccgttaccg

SEQ ID NO: 67448 - DNA, 674 bp, Homo sapiens
  misc_feature: GYAE6OF02JN8PN.44.46.E02.1.454.CMB.1.raw
  modified_base (171)..(171): a, c, t, g, unknown or other
  misc_feature (171)..(171): n is a, c, g, or t
  modified_base (450)..(450): a, c, t, g, unknown or other
  misc_feature (450)..(450): n is a, c, g, or t
  modified_base (475)..(475): a, c, t, g, unknown or other
  misc_feature (475)..(475): n is a, c, g, or t
  modified_base (581)..(581): a, c, t, g, unknown or other
  misc_feature (581)..(581): n is a, c, g, or t
  modified_base (594)..(594): a, c, t, g, unknown or other
  misc_feature (594)..(594): n is a, c, g, or t
tcagacagtatatacacgaccggtgctcgatttagactcatctacagggaaaggggggggggtaggtcccctgtggaaaaagggtcagaggccaaaggatgggagggggtcaggctggaactgaggagtcagtctcagtcaggacacagcatggacatggagggtccccgntcagctccgtggggcctccgtgctactcgtggcctccggaggtgccagattgtcgacatccagactcgaccctagtccttcccttccctccttagttcctacgtcctttacgtacgtaggacgacgtaggtacgtccgtacctaacttccgtaacgttcgggacccgggtactaaacggttaccaacgtacccgtaacttaaccgagtactttaaatttaaggtggttaactacgagtacaggaacgtaccgaagggaacctcccgtaagaaccttcgntactactcgtacgtcctacgtcccncctacgttcacggtaacggtaggtacgtacgttccttacgtacgtaggttacgaggtcggtacgagtgtacgttgacggactgtctcgtctccacctctgttaccncttcgtcgtaccncgtaagtacggtactttataccgtccttaacttctacttcgaacacgttagctttaaccgccgtttaccgtcgttaacgg

SEQ ID NO: 67449 - DNA, 748 bp, Homo sapiens
  misc_feature: GYAE6OF02IW5NQ.44.46.E02.1.454.CMB.1.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (562)..(562): a, c, t, g, unknown or other
  misc_feature (562)..(562): n is a, c, g, or t
tcagacagtatatacacgaccggtgctcgatttagactcatctacagggaaagggggggggtaggtcccctgtggaaaagggtcagaggccaaaggatgggagggggtcaggctgggaactgaggagtcagtctcagtcaggacacagcatggacatggacgggtccccgctacgacgctccgtggggcctcctgctactcgtggcctccggaggtcgccgagactgtcgacatccagactcgacccngttcctccttcctccctgtctcgtacctttctagtaggganaaccgtaggtactccgacctatccgacgttccggccggtanaacgtccacgtacctataaccgngtactaagtttaaacgtggtactcgagtacaggaacgacgtaagggaaccncccttgaaacctcgtagacctttcncgtacgtcncgtacccctccgtactcggtactacggaacggttacggtacttccgttaacgttaccggtaaaggttccgtagggtcggtaccgtaggtacggttacctacgggtacgggaacgttaacgtttntttacccccggtacttacccgtaccgtaaaacccgttgtaaccccgttccggtaactttccgggaaaccgtacccctaaggttacgttaacgttcttttaaccggaacctttaaacctttacgtacgtaccgttaagaacccgttaggttacgttaacgtccggttacccccgttacgtttaccgg

SEQ ID NO: 67450 - DNA, 247 bp, Homo sapiens
  misc_feature: GYAE6OF01EVV9R.37.37.D04.1.454.CMB.1.raw
  modified_base (247)..(247): a, c, t, g, unknown or other
  misc_feature (247)..(247): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagn

SEQ ID NO: 67451 - DNA, 247 bp, Homo sapiens
  misc_feature: GYAE6OF01DBVV8.37.37.D04.1.454.CMB.1.raw
  modified_base (246)..(247): a, c, t, g, unknown or other
  misc_feature (246)..(247): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctggggcacagcggccctgggctgcctggtcaaggactacttccatctacactactgagcgggctggcaaggcgcatagnn

SEQ ID NO: 67452 - DNA, 248 bp, Homo sapiens
  misc_feature: GYAE6OF01BJ7B7.37.37.D04.1.454.CMB.1.raw
  modified_base (243)..(248): a, c, t, g, unknown or other
  misc_feature (243)..(248): n is a, c, g, or t
tcagtagtgtagatcacgaccggtgctcgatttagtagcatactgttgggtttggtgcccaagctgctggaggcacggtcaccacgctgctgagggagtagagtcctgaggactgtaggacagcccatcggtcttcccctggcaccctcctccaagagcacctctggggcacagcggccctgggctgcctggtcaaggactacttccatctacactactgagcgggctggcaaggcgcatagnnnnnn

SEQ ID NO: 67453 - DNA, 251 bp, Homo sapiens
  misc_feature: GYAE6OF01B9QOX.37.37.D04.1.454.CMB.1.raw
  modified_base (242)..(251): a, c, t, g, unknown or other
  misc_feature (242)..(251): n is a, c, g, or t
tcagtagtgtagatcacgaccggtgctcgatttagtagcatactgttgggtttggtgccaagctgctggagggcacggtcaccacgctgctgaggagtagagtcctgaggactgtaggacagcccatcggtcttcccctggcaccctcctccaagagcacctctggggcacagcggccctgggctgcctggtcaaggactacttccatctacactactgagcgggctggcaaggcgcatagnnnnnnnnnn

SEQ ID NO: 67454 - DNA, 125 bp, Homo sapiens
  misc_feature: GYAE6OF01ANOG3.37.37.D04.1.454.CMB.1.raw
  modified_base (125)..(125): a, c, t, g, unknown or other
  misc_feature (125)..(125): n is a, c, g, or t
tcagtagtgtagatcacgaccggtgctcgatttagtagcatactgttggttggcacagcggccctggctgcctggtcaaggactacttccatctacactactgagcggctggcaaggcgcatagn

SEQ ID NO: 67455 - DNA, 253 bp, Homo sapiens
  misc_feature: GYAE6OF01EH0RH.37.37.D04.1.454.CMB.1.raw
  modified_base (245)..(253): a, c, t, g, unknown or other
  misc_feature (245)..(253): n is a, c, g, or t
tcagtagtgtagatcacgaccggtgctcgatttagtagcatactgttgggtttgggtgcccaagctgctggagggcacggtcaccacgctgctcgagggagtagagtcctgaggactgtaggacagcccatcggtcttcccctggcaccctcctccaagagcacctctggggcacagcggccctgggctgcctggtcaaggactacttccatctacactactgagcggctggcaaggcgcatagnnnnnnnnn

SEQ ID NO: 67456 - DNA, 247 bp, Homo sapiens; identical to SEQ ID NO: 67451
  misc_feature: GYAE6OF01B8550.37.37.D04.1.454.CMB.1.raw
  modified_base (246)..(247): a, c, t, g, unknown or other
  misc_feature (246)..(247): n is a, c, g, or t

SEQ ID NO: 67457 - DNA, 130 bp, Homo sapiens
  misc_feature: GYAE6OF01CD4EQ.37.37.D04.1.454.CMB.1.raw
  modified_base (130)..(130): a, c, t, g, unknown or other
  misc_feature (130)..(130): n is a, c, g, or t
tcagtagtgtagatcacgaccggtgctcgatttagtagcatactgttgggtttgggcacagcggccctgggctgcctggtcaaggactacttccatctacactactgagcgggctggcaaggcgcatagn

SEQ ID NO: 67458 - DNA, 247 bp, Homo sapiens; identical to SEQ ID NO: 67451
  misc_feature: GYAE6OF01AUWPL.37.37.D04.1.454.CMB.1.raw
  modified_base (246)..(247): a, c, t, g, unknown or other
  misc_feature (246)..(247): n is a, c, g, or t

SEQ ID NO: 67459 - DNA, 510 bp, Homo sapiens
  misc_feature: GYAE6OF01DCVLN.37.37.D04.1.454.CMB.1.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgttactctggctcccagataccactggagaaatagtgatgacgcagtctccagccaccctgtctgtgtctccaggggaaanagccaccctctcctgcagggccagtcagagtgtagcagcaacttagcctggtaccagcagaaacctggccaggctcccaggctcctcatctatggtgcatccaccagggccactggtatcccagccaggttcagtgcagtggtctgggacagagttcactctcaccatcagcagcctgcagtctagaagtnttttgctagtttatttctgtcagcagtataattactggcctctacgtggtacgttcggaccgaagggacctaaggtaggaaatacaaacggaactgtaggctcgacaccatctgtc

SEQ ID NO: 67460 - DNA, 252 bp, Homo sapiens
  misc_feature: GYAE6OF01B7JBO.37.37.D04.1.454.CMB.1.raw
  modified_base (247)..(252): a, c, t, g, unknown or other
  misc_feature (247)..(252): n is a, c, g, or t
tcagtagtgtagatcacgaccggtgctcgatttagtagcatactgttgggtttgggtgcccaagctgcgtggagggcacggtcaccacgctgctgagggagtagagtcctgaggactgtaggacagcccatcggtcttccccctggcaccctcctccaagagcacctctggggcacagcggccctgggctgcctggtcaaggactacttccatctacactactgagcgggctggcaaggcgcatagnnnnnn

SEQ ID NO: 67461 - DNA, 497 bp, Homo sapiens
  misc_feature: GYAE6OF01DLKUD.37.37.D04.1.454.CMB.1.raw
  modified_base (452)..(452): a, c, t, g, unknown or other
  misc_feature (452)..(452): n is a, c, g, or t
tcagtagtgtagatcacgaccggtgctcgatttagtagcatactgttgggtttggggacccaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgaccacagatacatccacgagcacagcctacatggagctgaggagcctgagatctgacgacacggccgtgtttacngtgcgagagtacagaatattagtaatggatacgtgggccaacggg

SEQ ID NO: 67462 - DNA, 250 bp, Homo sapiens
  misc_feature: GYAE6OF01CAOAL.37.37.D04.1.454.CMB.1.raw
  modified_base (247)..(250): a, c, t, g, unknown or other
  misc_feature (247)..(250): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnn

SEQ ID NO: 67463 - DNA, 249 bp, Homo sapiens
  misc_feature: GYAE6OF01CKPEY.37.37.D04.1.454.CMB.1.raw
  modified_base (247)..(249): a, c, t, g, unknown or other
  misc_feature (247)..(249): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnn

SEQ ID NO: 67464 - DNA, 494 bp, Homo sapiens
  misc_feature: GYAE6OF01BBMCJ.37.37.D04.1.454.CMB.1.raw
  modified_base (412)..(412): a, c, t, g, unknown or other
  misc_feature (412)..(412): n is a, c, g, or t
  modified_base (450)..(450): a, c, t, g, unknown or other
  misc_feature (450)..(450): n is a, c, g, or t
tcagtagtgtagatcacgaccggtgctcgatttagtagcatactgttgggtttggggacccaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcacctgaccacagatacatccacgagcacagcctacatgganctgaggagcctgagatctgacgacacggcgtgtttacngtgcgagagtacagaatatgtaatggactagtggggctaacggg

SEQ ID NO: 67465 - DNA, 249 bp, Homo sapiens; identical to SEQ ID NO: 67463
  misc_feature: GYAE6OF01D9Y5C.37.37.D04.1.454.CMB.1.raw
  modified_base (247)..(249): a, c, t, g, unknown or other
  misc_feature (247)..(249): n is a, c, g, or t

SEQ ID NO: 67466 - DNA, 259 bp, Homo sapiens
  misc_feature: GYAE6OF01D9U1G.37.37.D04.1.454.CMB.1.raw
  modified_base (248)..(259): a, c, t, g, unknown or other
  misc_feature (248)..(259): n is a, c, g, or t
tcagtagtgtagatcacgaccggtgctcgatttagtagcatactgttgggtttggggtgcccaagctgcttgagggcacggtcaccacgcctgctgagggagtagagtcctgaggactgtaggacagcccatcggtcttccccctggcaccctcctccaagagcacctctggggcacagcggccctgggctgcctggtcaaggactacttccatctacactactgagcgggctggcaaggcgcatagnnnnnnnnnnnn

SEQ ID NO: 67467 - DNA, 248 bp, Homo sapiens
  misc_feature: GYAE6OF01BBXO3.37.37.D04.1.454.CMB.1.raw
  modified_base (247)..(248): a, c, t, g, unknown or other
  misc_feature (247)..(248): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnn

SEQ ID NO: 67468 - DNA, 250 bp, Homo sapiens
  misc_feature: GYAE6OF01DCXBI.37.37.D04.1.454.CMB.1.raw
  modified_base (246)..(250): a, c, t, g, unknown or other
  misc_feature (246)..(250): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctggggcacagcggccctgggctgcctggtcaaggactacttccatctacactactgagcgggctggcaaggcgcatagnnnnn

SEQ ID NO: 67469 - DNA, 526 bp, Homo sapiens
  misc_feature: GYAE6OF01EAD3N.37.37.D04.1.454.CMB.1.raw
  modified_base (516)..(516): a, c, t, g, unknown or other
  misc_feature (516)..(516): n is a, c, g, or t
  modified_base (522)..(522): a, c, t, g, unknown or other
  misc_feature (522)..(522): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaacctggccaggctccaggctcctcatctatggtgtatccaccgagggccatggtatcccagccaggttcagtgcagtggctgggacagagttcactctcaccatcagcagcctgctagtctagtaagtattttgacttaacttttacttactgtcagtcaagtataactacgtcggtccccggtagttcgaccgaacgggaccaaggtaggaaactacgaaacgaacgtaggacggctagcactatactntcttcntccc

SEQ ID NO: 67470 - DNA, 129 bp, Homo sapiens
  misc_feature: GYAE6OF01C1A9H.37.37.D04.1.454.CMB.1.raw
tcagtagtgtagatcacgaccggtgctcgatttagtagcatactgttgggtttgggcacagcggccctgggctgcctggtcaaggactacttccatctacactactgagcgggctggcaaggcgcatag

SEQ ID NO: 67471 - DNA, 249 bp, Homo sapiens; identical to SEQ ID NO: 67463
  misc_feature: GYAE6OF01DESBD.37.37.D04.1.454.CMB.1.raw
  modified_base (247)..(249): a, c, t, g, unknown or other
  misc_feature (247)..(249): n is a, c, g, or t

SEQ ID NO: 67472 - DNA, 247 bp, Homo sapiens
  misc_feature: GYAE6OF01B2WNF.37.37.D04.1.454.CMB.1.raw
  modified_base (246)..(247): a, c, t, g, unknown or other
  misc_feature (246)..(247): n is a, c, g, or t
tcagtagtgtagatcacgaccggtgctcgatttagtagcatactgttgggtttgggtgcccaagctgctcggagggcacggtcaccacgctgctgagggagtagagtcctgaggactgtaggacagcccatcggtcttcccctggcaccctcctccaagagcacctctggggcacagcggccctgggctgcctggtcaaggactacttccatctacactactgagcgggctggcaaggcgcatagnn

SEQ ID NO: 67473 - DNA, 544 bp, Homo sapiens
  misc_feature: GYAE6OF01CGV1L.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccacagggccactggtactccccagcctacctttagtcggcaggtgggtctgggacaggagttcactctcaccatcagcagcctgcagtctagaagtattttgactagtttattactgtacaactagtacaatgactggtccttctctaccgtttcgggacggacgggaccgaagggtgggaagtaacgtacgaaaacggtacgtggtacggacgtcgaccacctaactcgttcgttacc

SEQ ID NO: 67474 - DNA, 249 bp, Homo sapiens
  misc_feature: GYAE6OF01CJMS5.37.37.D04.1.454.CMB.1.raw
  modified_base (245)..(249): a, c, t, g, unknown or other
  misc_feature (245)..(249): n is a, c, g, or t
tcagtagtgtagatcacgaccggtgctcgatttagtagcatactgttgggtttgggtgccaagctgctggagggcacggtcaccacgctgctgagggagtagagtcctgaggactgtaggacagcccatcggtcttccccctggcaccctcctccaagagcacctctggggcacagcggccctgggctgcctggtcaaggactacttccatctacactactgagcgggctggcaaggcgcatagnnnnn

SEQ ID NO: 67475 - DNA, 249 bp, Homo sapiens
  misc_feature: GYAE6OF01DVWTE.37.37.D04.1.454.CMB.1.raw
  modified_base (246)..(249): a, c, t, g, unknown or other
  misc_feature (246)..(249): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctggggcacagcggccctgggctgcctggtcaaggactacttccatctacactactgagcgggctggcaaggcgcatagnnnn

SEQ ID NO: 67476 - DNA, 249 bp, Homo sapiens; identical to SEQ ID NO: 67463
  misc_feature: GYAE6OF01DG5KD.37.37.D04.1.454.CMB.1.raw
  modified_base (247)..(249): a, c, t, g, unknown or other
  misc_feature (247)..(249): n is a, c, g, or t

SEQ ID NO: 67477 - DNA, 250 bp, Homo sapiens; identical to SEQ ID NO: 67462
  misc_feature: GYAE6OF01ERUHF.37.37.D04.1.454.CMB.1.raw
  modified_base (247)..(250): a, c, t, g, unknown or other
  misc_feature (247)..(250): n is a, c, g, or t

SEQ ID NO: 67478 - DNA, 253 bp, Homo sapiens
  misc_feature: GYAE6OF01CH9X4.37.37.D04.1.454.CMB.1.raw
  modified_base (247)..(253): a, c, t, g, unknown or other
  misc_feature (247)..(253): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnn

SEQ ID NO: 67479 - DNA, 247 bp, Homo sapiens; identical to SEQ ID NO: 67451
  misc_feature: GYAE6OF01AJ9OO.37.37.D04.1.454.CMB.1.raw
  modified_base (246)..(247): a, c, t, g, unknown or other
  misc_feature (246)..(247): n is a, c, g, or t

SEQ ID NO: 67480 - DNA, 247 bp, Homo sapiens; identical to SEQ ID NO: 67451
  misc_feature: GYAE6OF01BH8HM.37.37.D04.1.454.CMB.1.raw
  modified_base (246)..(247): a, c, t, g, unknown or other
  misc_feature (246)..(247): n is a, c, g, or t

SEQ ID NO: 67481 - DNA, 248 bp, Homo sapiens; identical to SEQ ID NO: 67467
  misc_feature: GYAE6OF01D4SB8.37.37.D04.1.454.CMB.1.raw
  modified_base (247)..(248): a, c, t, g, unknown or other
  misc_feature (247)..(248): n is a, c, g, or t

SEQ ID NO: 67482 - DNA, 576 bp, Homo sapiens
  misc_feature: GYAE6OF01CYLS2.37.37.D04.1.454.CMB.1.raw
  modified_base (203)..(203): a, c, t, g, unknown or other
  misc_feature (203)..(203): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctccagataccactggagaaatagtgatgacgcagtctccagccaccctgtctgtgtctccgaggggaaanagccaccctctcctgcagggccagtcagagtgttagcagcaacttagcctggtaccaacagagacctggccacggcccccaggcctcctcatctatggtgcatccacagggccacgtggtactcccagccaggttcagtggcaggtgggtctgggacagagttcactctcacatcagcagcctgcagtctagaagtatttgcttagtttattctgtcagtctaagttataattacgtcggtccttaccgtaggttcggtacgtttccggaccgtaaacgggtacccgtaaaggggtacggaaaacttaccgaaaacggtacgttacgggtacggtaccgttcggaccctaaccgtactttccgtggtttaccc

SEQ ID NO: 67483 - DNA, 132 bp, Homo sapiens
  misc_feature: GYAE6OF01ESW4J.37.37.D04.1.454.CMB.1.raw
  modified_base (132)..(132): a, c, t, g, unknown or other
  misc_feature (132)..(132): n is a, c, g, or t
tcagtagtgtagatcacgaccggtgctcgatttagtagcatactgttgggtttgggcacagcggccctgggctgcctggtcaaggactacttccatctacactactgagcgggttctggcaaggcgcatagn

SEQ ID NO: 67484 - DNA, 511 bp, Homo sapiens
  misc_feature: GYAE6OF01DT80V.37.37.D04.1.454.CMB.1.raw
  modified_base (203)..(203): a, c, t, g, unknown or other
  misc_feature (203)..(203): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccacagggccactggtactcccagccaggttcagtggcagtgggtctgggacagagttcactctcaccatcagcagcctgcagtctagaagtattttgctagtttattactgtcagcaagtataatactcggccccggtacgttcggcgaacggaccgaaggtaggaaagtacgaaacgaatggtgactgacacatctctcttctac

SEQ ID NO: 67485 - DNA, 247 bp, Homo sapiens
  misc_feature: GYAE6OF01APDMY.37.37.D04.1.454.CMB.1.raw
  modified_base (245)..(247): a, c, t, g, unknown or other
  misc_feature (245)..(247): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctggggcacagcggccctgggctgcctggtcaaggctacttccatctacactactgagcgggctggcaaggcgcatagnnn

SEQ ID NO: 67486 - DNA, 248 bp, Homo sapiens; identical to SEQ ID NO: 67467
  misc_feature: GYAE6OF01DH21L.37.37.D04.1.454.CMB.1.raw
  modified_base (247)..(248): a, c, t, g, unknown or other
  misc_feature (247)..(248): n is a, c, g, or t

SEQ ID NO: 67487 - DNA, 294 bp, Homo sapiens
  misc_feature: GYAE6OF01AS614.37.37.D04.1.454.CMB.1.raw
  modified_base (249)..(249): a, c, t, g, unknown or other
  misc_feature (249)..(249): n is a, c, g, or t
  modified_base (255)..(294): a, c, t, g, unknown or other
  misc_feature (255)..(294): n is a, c, g, or t
tcagtagtgtagatcacgaccggtgctcgatttagtagcatactggttaggggtttgggtgcccaagctgctggagggcacggtcaccacgcctgctgagggagtagagtcctgaggactgtaggacagcccagtcggtcttccccctggcaccctcctccaagagcacctcgtgggggcacgaggccggccctgggctgcctggtcaaggctacttccatctacactactgagcgggctggcaaggcncatagnnnnnnnnnnnnnnnnnnnnnnnnnnnnnnnnnnnnnnnn

SEQ ID NO: 67488 - DNA, 247 bp, Homo sapiens; identical to SEQ ID NO: 67451
  misc_feature: GYAE6OF01CD0VX.37.37.D04.1.454.CMB.1.raw
  modified_base (246)..(247): a, c, t, g, unknown or other
  misc_feature (246)..(247): n is a, c, g, or t

SEQ ID NO: 67489 - DNA, 249 bp, Homo sapiens; identical to SEQ ID NO: 67463
  misc_feature: GYAE6OF01B6W0U.37.37.D04.1.454.CMB.1.raw
  modified_base (247)..(249): a, c, t, g, unknown or other
  misc_feature (247)..(249): n is a, c, g, or t

SEQ ID NO: 67490 - DNA, 248 bp, Homo sapiens; identical to SEQ ID NO: 67467
  misc_feature: GYAE6OF01AX2EU.37.37.D04.1.454.CMB.1.raw
  modified_base (247)..(248): a, c, t, g, unknown or other
  misc_feature (247)..(248): n is a, c, g, or t

SEQ ID NO: 67491 - DNA, 608 bp, Homo sapiens
  misc_feature: GYAE6OF01DTYRN.37.37.D04.1.454.CMB.1.raw
  modified_base (406)..(406): a, c, t, g, unknown or other
  misc_feature (406)..(406): n is a, c, g, or t
  modified_base (442)..(442): a, c, t, g, unknown or other
  misc_feature (442)..(442): n is a, c, g, or t
tcagtagtgtagatcacgaccggtgctcgatttagtagcatactgttgggtttgggggacccaaaaaccacacccctccttgggagaatcccctagatcacagctcctcaccatggacgtgggacctggagcatccttttcctggtggcagcagcaacaggtgcccactctcaggttcagctggtgcagtctggagctgaggtgaagagctggggcctcagtgaaggtctcctgcaaggcttctggttatacctttagctaattatggtatcaactgggtgcgacacggcccctggacaagggccagtgagtggatggggatgggatcgagcgtacttaacaaataataacacaacactatgacaacagaacgttccgaagggcaggacgtccaccctagacccanagactaacactaccacgaacgcaacgacgacctaanagtggactcgtagacggagccgtagagtactcgtacggaccgacgtaccgggtccgtttacgtttacgtcggttacggaccgggtaagttagtaaccgaaggttaaattaagtttaggtaaacgtacgggtaaccttacgggtacgggggaccgtaaacccggggg

SEQ ID NO: 67492 - DNA, 488 bp, Homo sapiens
  misc_feature: GYAE6OF01AHPWF.37.37.D04.1.454.CMB.1.raw
  modified_base (300)..(300): a, c, t, g, unknown or other
  misc_feature (300)..(300): n is a, c, g, or t
  modified_base (482)..(482): a, c, t, g, unknown or other
  misc_feature (482)..(482): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctccaggctcctcatctatggtncatccaccagggccactggtactcccagccaggttcagtggcagtgggtctgggacagagttcactctcaccatcagcagcctgcaggctgaggatggtggcgtatttatactgtcagcagtattataatactctccgacgttcgcagggaccaaggtgaaatcaaacgactgtgctgcacntctgtc

SEQ ID NO: 67493 - DNA, 137 bp, Homo sapiens
  misc_feature: GYAE6OF01AH8SO.37.37.D04.1.454.CMB.1.raw
  modified_base (132)..(137): a, c, t, g, unknown or other
  misc_feature (132)..(137): n is a, c, g, or t
tcagtagtgtagatcacgaccggtgctcgatttagtagcatactggttgggtttgggcacagcggccctgggctgcctggtcaaggactacttccatctaccactactgagcgggctggcaaggcgcatagnnnnnn

SEQ ID NO: 67494 - DNA, 280 bp, Homo sapiens
  misc_feature: GYAE6OF01BKXWU.37.37.D04.1.454.CMB.1.raw
  modified_base (248)..(280): a, c, t, g, unknown or other
  misc_feature (248)..(280): n is a, c, g, or t
tcagtagtgtagatcacgaccggtgctcgatttagtagcatactgttgggtttgggtgcccaagctgctggacgggcacggtcaccacgcgtgctgagggagtagagtcctgacggactgtaggacagcccatcggtcttcccctggcacctcctccaagagcacctctggggcacagcggcctgggctgcctggtcaaggactacttccagtctacactactgagcgggctggcaaggtcgcatagnnnnnnnnnnnnnnnnnnnnnnnnnnnnnnnnn

SEQ ID NO: 67495 - DNA, 673 bp, Homo sapiens
  misc_feature: GYAE6OF01BQJZA.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtcgtggagctggaggtagaaagaacgtccggtcggggcctcgagtaggaacggtcctccgtgacgaaggtcctttcgttaggttacttaccgtttagactaatttagttggttaactacctaacggttggggtgaccgtaacgaccggtccccgtagggaaccgaacgggcctagtaggaggtaggaggtaggggtatggactcgaggcgtacttaacaaagttaactaaccacaactacgtatcgacaacgaagtaacgttccggagggacagtacgtacccaccgtacgaaccacgaagaactaacactacccgaagacgaccacgaccgtacctaagacgtggactcgtaggaacggcgacgtagagtactcgacgacgtaccgaccggttcgtttacgtttacgtggtcggacgtaagtagtaacgacgtaagttaggttagttaacgtaggtaaccgtacgggtacggggccgtaaaccggg

SEQ ID NO: 67496 - DNA, 248 bp, Homo sapiens; identical to SEQ ID NO: 67467
  misc_feature: GYAE6OF01EMII5.37.37.D04.1.454.CMB.1.raw
  modified_base (247)..(248): a, c, t, g, unknown or other
  misc_feature (247)..(248): n is a, c, g, or t

SEQ ID NO: 67497 - DNA, 586 bp, Homo sapiens
  misc_feature: GYAE6OF01AJEOS.37.37.D04.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttagcagcaacttagcctggtaccagcagaacctggccaggctccaggctcctcatctatggtncatcccaccagggccacgtggtactcccagccctaggttcaggtggcaggtgggtctgggacagagttcactctcaccatcagcagcctgcagtctagtaagtattttgctagtttatttctgtcagtctagttaattaattacgtcggtcccttccgttaccggttacgggtaccggtttccgggaccgtaaacggggtaacccgtaaaggggtacgggtaaacgtaccgaaaaccggtaacgttaggtacgggtacgttacgacccaacctacgttcgttaccgg

SEQ ID NO: 67498 - DNA, 628 bp, Homo sapiens
  misc_feature: GYAE6OF01BCRBI.37.37.D04.1.454.CMB.1.raw
  modified_base (206)..(206): a, c, t, g, unknown or other
  misc_feature (206)..(206): n is a, c, g, or t
tcagtagtgtagatcacgaccggtgctcgatttagtagcatactgttggggtttggggacccaaaaaccacgacccctccttgggacgaatcccctagatcacagcttcctcaccatggactggacctggagcatccttttcctggtggcagcgagtcgaacaggtgcccacgttcttcgtaggttcagtctaggtgcagtctggngctgaggtgaagagcggtgggctcagtgaaggtctcctgcgaaggcttctggttatacctttagctaattagttggtattcaacgttgggtcgcgacacggcccctaggaaccagggccagtcggaggtgggaggtgggatgggatcgagcgtacttaacaataactaacacacactatcgacaacaagtaacgttccaggctaagacgtccaccgtgaacccgacaagtactaacaactcccgaacgaacggaccaaccgacgaccctaagactacggacgtcgtaggacggacgccgtagacgtacgtcgtaggacgacgacgggtccgttagtttacctgtcggacgaggtaggtaacgaaggtaagttagttaggttaagttacgggtaacgtttacggtggggtaccgtaaacgggg

SEQ ID NO: 67499 - DNA, 250 bp, Homo sapiens; identical to SEQ ID NO: 67468
  misc_feature: GYAE6OF01BFAVC.37.37.D04.1.454.CMB.1.raw
  modified_base (246)..(250): a, c, t, g, unknown or other
  misc_feature (246)..(250): n is a, c, g, or t

SEQ ID NO: 67500 - DNA, 594 bp, Homo sapiens
  misc_feature: GYAE6OF01C6FNT.37.37.D04.1.454.CMB.1.raw
  modified_base (278)..(278): a, c, t, g, unknown or other
  misc_feature (278)..(278): n is a, c, g, or t
  modified_base (482)..(482): a, c, t, g, unknown or other
  misc_feature (482)..(482): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatcctttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtncgacaggcccctggacaaggccatgagtggatgggatggatcagcgcttacaataataacacacactatgacacagaagttcaggcagacgtacaccctgaccaacagaactacactaccaacgagacaacacgacctaacatggagctaggaggagcctagagaactcgtaggaccgacgaccggtccgttaggttttaaccngggttacgacgggtaacgtaaggtaaccgtaaaggtaaacgtttaagtttaacggttaaaacgttacgggtaaaccttaaccgggtacgggggacccgtaaaacccgggggg

SEQ ID NO: 67501 - DNA, 293 bp, Homo sapiens
  misc_feature: GYAE6OF01CP5V8.37.37.D04.1.454.CMB.1.raw
  modified_base (254)..(293): a, c, t, g, unknown or other
  misc_feature (254)..(293): n is a, c, g, or t
tcagtagtgtagatcacgaccggtgctcgatttagtagcatactgttgggtttgggtcgcccaagctgctggagggcacggtcaccgacgctgctgtagggagtagagtcctgaggactgtaggacagcccatcggtcttccccctggcaccctcctccaagagtcacctctgggggctacagcggccctgggctggcctggtcaaggctacgttccatcgtacactactgagcgggctggcaaggcgcatagnnnnnnnnnnnnnnnnnnnnnnnnnnnnnnnnnnnnnnnn

SEQ ID NO: 67502 - DNA, 512 bp, Homo sapiens
  misc_feature: GYAE6OF01E52QP.37.37.D04.1.454.CMB.1.raw
  modified_base (464)..(464): a, c, t, g, unknown or other
  misc_feature (464)..(464): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttaacaataataacacacactatgcacagaagttccagggcagacgtcaccctgaccacagatacatccaacgagcaacagcctacatggagctgaggagcctagagatctagacgacaccgggtccgttgtttacgngtgcgagagtacagtaatattgtaatggactacgtgggccgtaacggg

SEQ ID NO: 67503 - DNA, 548 bp, Homo sapiens
  misc_feature: GYAE6OF01BKUDE.37.37.D04.1.454.CMB.1.raw
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
tcagtagtgtagatcacgaccggtgctcgatttagtagcatactgttgggtttgggggaggaactgctcagttaggacccagagggaaccatggaagccccagctcagcttctcttcctcctgctactctggctcccagataccaccgcagaaattgtgttgacacagtctccagccaccctgtctttgtctccgagggganagagccaccctctcctgcagggccagtcagaatgttagcagtcacttagcctggtaccaacagagacctggccacggccccaggctcctcatctatgctgcttccctcacggccactggcatcccagccaggttccagtgcaggtggctgagcagtactcactctcacatcagcagtctaagcnccgtagaagtatttgactactttatatattctacaacngtcgtacacgtaccgttgggtaccgtaccgttcggaccgaacgggaccgtaaggtcggtaactttaccgtaacgtaacgtcggtggtcctaggaccctacctagttcctcgttccttcgtaccg

SEQ ID NO: 67504 - DNA, 524 bp, Homo sapiens
  misc_feature: GYAE6OF01C9C1Z.37.37.D04.1.454.CMB.1.raw
  modified_base (202)..(202): a, c, t, g, unknown or other
  misc_feature (202)..(202): n is a, c, g, or t
  modified_base (345)..(345): a, c, t, g, unknown or other
  misc_feature (345)..(345): n is a, c, g, or t
  modified_base (517)..(517): a, c, t, g, unknown or other
  misc_feature (517)..(517): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctccagataccactggagaaatagtgatgacgcagtctccagccaccctgtctgtgtctccaggggaaanagccaccctctcctgcagggccagtcagagtgttagcagcaacttagcctggtaccagcagaaacctggccaggctccaggctcctcatctatggtgcatccacagggccactggtactcccgagccaggttcaggtggacgnggtagggtctgggacagagtttcactctcacatcagcagcctgcagtctgaagtattttgctagtttatttctgtcagctaagtataagttactggcctacgttacgtggcgttcggaccgaagggacgaaggttgaaatccggaaaacgaacgttgtacggctagccaccnttcgtcg

SEQ ID NO: 67505 - DNA, 537 bp, Homo sapiens
  misc_feature: GYAE6OF01D5RC5.37.37.D04.1.454.CMB.1.raw
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
  modified_base (530)..(530): a, c, t, g, unknown or other
  misc_feature (530)..(530): n is a, c, g, or t
tcagtagtgtagatcacgaccggtgctcgatttagtagcatactgttgggtttgggggagaactgctcagttaggacccagacggaaccatggaagtccccagcgcagcttctcttcctcctcgctactcgtggctcccagataccactggagaaatagtgactgacgcagtctccagccaccctgtcctgtgtctccgaggggaaancgcccacccgtctcctgcagggccagtcagngtgtagcagcaacttgcctggaccagcaagaacctggccaggctcccagctcctcatctatggtnctactccaccgagggccagtgtactcccagcctaggttcagtgctagtcggntgggactagtagtttccactctcgacctatccgagccacgccctgcagtcgtatagtntttgctagtttattcgngtcagtctaagttattaagttacgtgtccttaccgtagtcgtacgttcggaccgagggacctaggtacgtaaagacaaacgtatggcgtctacgctacngtctacg

SEQ ID NO: 67506 - DNA, 250 bp, Homo sapiens; identical to SEQ ID NO: 67462
  misc_feature: GYAE6OF01EHCQU.37.37.D04.1.454.CMB.1.raw
  modified_base (247)..(250): a, c, t, g, unknown or other
  misc_feature (247)..(250): n is a, c, g, or t

SEQ ID NO: 67507 - DNA, 248 bp, Homo sapiens; identical to SEQ ID NO: 67467
  misc_feature: GYAE6OF01DVX2S.37.37.D04.1.454.CMB.1.raw
  modified_base (247)..(248): a, c, t, g, unknown or other
  misc_feature (247)..(248): n is a, c, g, or t

SEQ ID NO: 67508 - DNA, 249 bp, Homo sapiens; identical to SEQ ID NO: 67463
  misc_feature: GYAE6OF01C65DT.37.37.D04.1.454.CMB.1.raw
  modified_base (247)..(249): a, c, t, g, unknown or other
  misc_feature (247)..(249): n is a, c, g, or t

SEQ ID NO: 67509 - DNA, 249 bp, Homo sapiens; identical to SEQ ID NO: 67475
  misc_feature: GYAE6OF01D3LCN.37.37.D04.1.454.CMB.1.raw
  modified_base (246)..(249): a, c, t, g, unknown or other
  misc_feature (246)..(249): n is a, c, g, or t

SEQ ID NO: 67510 - DNA, 571 bp, Homo sapiens
  misc_feature: GYAE6OF01BRH70.37.37.D04.1.454.CMB.1.raw
  modified_base (394)..(394): a, c, t, g, unknown or other
  misc_feature (394)..(394): n is a, c, g, or t
tcagtagtgtagatcacgaccggtgctcgatttagtagcatactgttgggtttggggacccaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagctaattatggtatcaactgggtgcgacaggcccctggacaaggccatgagtggatgggatggatcgagcgtacttaacaattaaataacacaacactatgacaacagaagtccgagggcagacgtcaccctgaccanagactacaatcccaacgacgacacacgcctaacagtaggagcgtaggacggagccgtagagatcgagacgacgacggtccgttagtttacgtcgtggacggagtaaggtactaaggtaaattaagttaggttaaacgtacgggtaaacgttacggtcgggggaccctaaaccggggg

SEQ ID NO: 67511 - DNA, 690 bp, Homo sapiens
  misc_feature: GYAE6OF01BNCA3.37.37.D04.1.454.CMB.1.raw
  modified_base (440)..(440): a, c, t, g, unknown or other
  misc_feature (440)..(440): n is a, c, g, or t
tcagtagtgtagatcacgaccggtgctcgattttagtagcatactgttggggtttggggacccaaaaaccacgacccctccgttgggacgaatcccctagatcacagcttcctcaccatggactggacctggagcatccttttcctggtggcagcagtcgaacaggtgccctacgtttccttcgtaggtttcagtcttagggtgccaggtctggagctgaggtgaagagccggtgggcctcagtgaaggtctcctgcaaggtcttctggtttatacctttagctaatttatggtattcaacgttgggtgcgacacggcccctagggaaccaagggccagtcggaggtcggaggtggatgggatcgagcgtacttaacaataactaacacacactatcgacaacaagtaacgttccagggtcagactccaccgtgaccganagtactacatcccaacgacgaccaaccgacgtaccgtaacgacgttacgggactcgtaggaacggtacgaccgttaggaacgtacgttacggtacgggaaccgaaccggaccgggttccggtttagttttaccgtggttacggtcggtaacggtaacggttaacgtaaaggttaaacgtttaagtttaacgggttaaagtttaccgggtaaccgtttaccgggttacgggggtaaccgtaaacccggggg

SEQ ID NO: 67512 - DNA, 249 bp, Homo sapiens; identical to SEQ ID NO: 67463
  misc_feature: GYAE6OF01DGD9J.37.37.D04.1.454.CMB.1.raw
  modified_base (247)..(249): a, c, t, g, unknown or other
  misc_feature (247)..(249): n is a, c, g, or t

SEQ ID NO: 67513 - DNA, 734 bp, Homo sapiens
  misc_feature: GYAE6OF01DNM60.37.37.D04.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagcagcaacttagcctggtaccagcaagaaacctggccaggcctcccgaggctcctnatctagtggtcgcactccaacgagggccctacgtggtactcccgagtcctaggttcaggtcggctagggtcgggtcgtaggggaactacgggtacgtttccaacgttccgtaccaaccctaagtccgaaggccaacggtcccctaggacccgtaggttacctagggtaaaagtttctttttcggactttaaggttttttatttccgtagttacaacggttactaagtttaactttaacgtttaccgttcgggtacccctttacggttaacgggttcggggttaacccggtttaccggggaacccgtaaaacgggggtaaaccccgttaaagggggttacgggtaaaaaccttaacccgggtaaaaaccggttaaccgttgggggttaaccggtaccgttacgggaacccttaacccggtaagtttccggtttaaccgg

SEQ ID NO: 67514 - DNA, 251 bp, Homo sapiens
  misc_feature: GYAE6OF01CDQRB.37.37.D04.1.454.CMB.1.raw
  modified_base (245)..(251): a, c, t, g, unknown or other
  misc_feature (245)..(251): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctggggcacagcggccctgggctgcctggtcaaggactacttccatctacactactgagcggctggcaaggcgcatagnnnnnnn

SEQ ID NO: 67515 - DNA, 503 bp, Homo sapiens
  misc_feature: GYAE6OF01AZZ5J.37.37.D04.1.454.CMB.1.raw
  modified_base (203)..(203): a, c, t, g, unknown or other
  misc_feature (203)..(203): n is a, c, g, or t
  modified_base (359)..(359): a, c, t, g, unknown or other
  misc_feature (359)..(359): n is a, c, g, or t
  modified_base (498)..(498): a, c, t, g, unknown or other
  misc_feature (498)..(498): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctccaggctcctcatctatggtgcatccaccagggccactggtactcccagccaggttcagtggcagtgggtctgggacagngttcactctcaccatcagcagcctgcagtctgaagtattttgctagttttattctgtcagtcagtataattacgtgtcctctacgtggacgttcggcgaacgggaccaaggtgaatacaaacgacgtgtcgctgacacntctcg

SEQ ID NO: 67516 - DNA, 297 bp, Homo sapiens
  misc_feature: GYAE6OF01E1ZD1.37.37.D04.1.454.CMB.1.raw
  modified_base (254)..(297): a, c, t, g, unknown or other
  misc_feature (254)..(297): n is a, c, g, or t
tcagtagtgtagatcacgaccggtgctcgatttagtagcatactgttgggtttggggtgcccaagctgctggagggcacggtcaccacgctgctgagggacgtagagtcctgaggacgtgtaggacagcccatcggtcttcccccctggcaccctcctaccaagagcacctctgggggcacagcggccctgggcctgcctggtcaaggactacttccatctacactactgagcgggctggccaaggcgcatagnnnnnnnnnnnnnnnnnnnnnnnnnnnnnnnnnnnnnnnnnnnn

SEQ ID NO: 67517 - DNA, 549 bp, Homo sapiens
  misc_feature: GYAE6OF01AEA5E.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacgtgggtgcgacaggcccctggacaaggccatgagtggatgggatggatcgagcgacttacaataactaacacacactatgcacagaagttccgaggcagacgtcacctagaccacagactacactaccacgagacacacgacctacagtaggagcgtaggacggacgcctaggagtactcgtacgacgacgaccggtccgttagtttacgtgtagacgtagtagtacaagtaatagttagtaacgtcggaacgtacggtcggggccgtaacgggg

SEQ ID NO: 67518 - DNA, 248 bp, Homo sapiens; identical to SEQ ID NO: 67467
  misc_feature: GYAE6OF01EYJOJ.37.37.D04.1.454.CMB.1.raw
  modified_base (247)..(248): a, c, t, g, unknown or other
  misc_feature (247)..(248): n is a, c, g, or t

SEQ ID NO: 67519 - DNA, 519 bp, Homo sapiens
  misc_feature: GYAE6OF01DWYEO.37.37.D04.1.454.CMB.1.raw
  modified_base (401)..(401): a, c, t, g, unknown or other
  misc_feature (401)..(401): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaccggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttcagggcaagagtcaccctgaccacagatacactccacgancacagcctacatggagcgtgacggagcctaggagactcgtagaccgacgtaccggccgttgtttactgtgcgagagtacagaatagttgtaatgggaactagtggggccgtaacgggg

SEQ ID NO: 67520 - DNA, 559 bp, Homo sapiens
  misc_feature: GYAE6OF01DM4FE.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggcccctggacaaggccagtgagtggatgggatggatcagcgcttacaataataacacacactatgacacagaagttccagggcagagtcacctgaccacagatacactaccacgagcacacgcctacagtggagctaggaggacgcctaggacgatcgtacgacgacgacggtccgttagttttacgtggtacggacgtaaggtaagtacgaagtaaattagtttaggttaaacgttacgggaacttacggtgggggtacccgtaaacggggg

SEQ ID NO: 67521 - DNA, 256 bp, Homo sapiens
  misc_feature: GYAE6OF01C5Q3K.37.37.D04.1.454.CMB.1.raw
  modified_base (244)..(256): a, c, t, g, unknown or other
  misc_feature (244)..(256): n is a, c, g, or t
tcagtagtgtagatcacgaccggtgctcgatttagtagcatactgttgggtttggggtgcccaagctgctggagggcacggtcaccacgctgctgagggagtagagtcctgaggactgtaggacagccatcggtcttccccctggcaccctctccaagagcacctctggggcacagcgccctgggctgcctggtcaaggactacttccatctacactactgagcgggctggcaaggcgcatagnnnnnnnnnnnnn

SEQ ID NO: 67522 - DNA, 508 bp, Homo sapiens
  misc_feature: GYAE6OF01ECPKQ.37.37.D04.1.454.CMB.1.raw
  modified_base (396)..(396): a, c, t, g, unknown or other
  misc_feature (396)..(396): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttaacaataataacacacactatgcacagaagtcagggcagagtcacctgaccacagatacatccacganacacagcctacatggagctagaggagcctgagatcgtagacgacgacggtcgttgtttactgtgcgagtagtacagaatattagtaataggactacgtggggcctaacgggg

SEQ ID NO: 67523 - DNA, 562 bp, Homo sapiens
  misc_feature: GYAE6OF01CDUSL.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggcccctggacaaggccatgagtggatgggatggatcagcgcttaacaataataacacacactatgcacagaagtccaggcagacgtcacctgaccacagatacataccaacgagcacagacctaacagtaggagcgtaggaaggacgcctaggacgacgtcgtaggaccgaacgacgggtccgtttaggttttactggtcggacgaggtagtaacaggtaaacttagtttaggtaaacgttagggtaacttacggtcgggggaccctaaacggggg

SEQ ID NO: 67524 - DNA, 250 bp, Homo sapiens; identical to SEQ ID NO: 67468
  misc_feature: GYAE6OF01C1BY9.37.37.D04.1.454.CMB.1.raw
  modified_base (246)..(250): a, c, t, g, unknown or other
  misc_feature (246)..(250): n is a, c, g, or t

SEQ ID NO: 67525 - DNA, 280 bp, Homo sapiens
  misc_feature: GYAE6OF01BZ8JP.37.37.D04.1.454.CMB.1.raw
  modified_base (252)..(280): a, c, t, g, unknown or other
  misc_feature (252)..(280): n is a, c, g, or t
tcagtagtgtagatcacgaccggtgctcgatttagtagcatactgttgggtttgggtgcccaagctcgctggagggcacggtcaccacgctgctgagggagtagagtcctgaggactgtaggacagcccatcggtcttccccctggcaccctcctccaagagcaccttcgtggggcacagcggccctgggctgcctggtcaaggactacgttccatctacactactggacgcgggctggcaaggcgcatagnnnnnnnnnnnnnnnnnnnnnnnnnnnnn

SEQ ID NO: 67526 - DNA, 250 bp, Homo sapiens
  misc_feature: GYAE6OF01ELW49.37.37.D04.1.454.CMB.1.raw
  modified_base (247)..(250): a, c, t, g, unknown or other
  misc_feature (247)..(250): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagtggccctgggctgcctggtcaaggactacttccatctacactactgagcgggctggcaaggcgcatagnnnn

SEQ ID NO: 67527 - DNA, 250 bp, Homo sapiens
  misc_feature: GYAE6OF01DRVM3.37.37.D04.1.454.CMB.1.raw
  modified_base (246)..(250): a, c, t, g, unknown or other
  misc_feature (246)..(250): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctctccaagagcacctctggggcgacagcggccctgggctgcctggtcaaggactacttccatctacactactgagcgggctggcaaggcgcatagnnnnn

SEQ ID NO: 67528 - DNA, 253 bp, Homo sapiens; identical to SEQ ID NO: 67478
  misc_feature: GYAE6OF01CVO0V.37.37.D04.1.454.CMB.1.raw
  modified_base (247)..(253): a, c, t, g, unknown or other
  misc_feature (247)..(253): n is a, c, g, or t

SEQ ID NO: 67529 - DNA, 621 bp, Homo sapiens
  misc_feature: GYAE6OF01EF8L3.37.37.D04.1.454.CMB.1.raw
  modified_base (140)..(140): a, c, t, g, unknown or other
  misc_feature (140)..(140): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttccnggtggcagcagcaacaggtgcccactctcaggttcagctggtgcagtctggagctgaggtgaagaagccgtgggcctcagtgaaggtctcctgcaaggcttctggttatacctttagcaattatggtatcaactgggtgcgacacggcccctggacaaggccatgagtggagtgggatgggatcgagcgacttacaataataacaacacactatgcaacagaagttaccaggcagacgcaccctgacacaagatacatacccacgagacaaccgacgacctaacgagtacgggacgtacgtaggacgggtaacgcccgttaggaacggacgttacgttaaccgggacgtaaccggaccgggtcccggtttagttttaacccgtggttacggaccggtaggtaagtaaccggtaaagtaaagtttagttagggttaaattacggggaacttacccgggtagggggacccgtaaacccggggg

SEQ ID NO: 67530 - DNA, 525 bp, Homo sapiens
  misc_feature: GYAE6OF01BMDKX.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaggccatgagtggatgggatggatcagcgcttacaataataacacacactatgcacagaagttccagggcagagtcacctcgaccacagatacatccacgagaccacacgcctacatggagcgtggagacgcctgagatcgtgaccgacgacggtccgttgtttactggtgcgagtagtacgagtaacttagttagttaagtggtaactacggtcggggcgtaaccgggg

SEQ ID NO: 67531 - DNA, 248 bp, Homo sapiens; identical to SEQ ID NO: 67467
  misc_feature: GYAE6OF01CQ0AV.37.37.D04.1.454.CMB.1.raw
  modified_base (247)..(248): a, c, t, g, unknown or other
  misc_feature (247)..(248): n is a, c, g, or t

SEQ ID NO: 67532 - DNA, 258 bp, Homo sapiens
  misc_feature: GYAE6OF01AMZHU.37.37.D04.1.454.CMB.1.raw
  modified_base (247)..(258): a, c, t, g, unknown or other
  misc_feature (247)..(258): n is a, c, g, or t
tcagtagtgtagatcacgaccggtgctcgatttagtagcatactgttgggtttgggtgcccaagctgctggagggcacggtcaccacgctgcctgagggagtagagtcctgaggactgtaggacagcccatcggtcttccccctggcaccctcctccaagagcacctctggggcacagcggccctgggctgcctggtcaaggactacttccatctacactactgagcgggctggcaaggcgcatagnnnnnnnnnnnn

SEQ ID NO: 67533 - DNA, 251 bp, Homo sapiens
  misc_feature: GYAE6OF01C342Y.37.37.D04.1.454.CMB.1.raw
  modified_base (248)..(251): a, c, t, g, unknown or other
  misc_feature (248)..(251): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggccaccctcctccaagagcacctcgtggggcacagcggccctgggctgcctggtcaaggactacttccatctacactactgagcgggctggcaaggcgcatagnnnn

SEQ ID NO: 67534 - DNA, 510 bp, Homo sapiens
  misc_feature: GYAE6OF01CYEQK.37.37.D04.1.454.CMB.1.raw
  modified_base (461)..(461): a, c, t, g, unknown or other
  misc_feature (461)..(461): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcgagcgcttacaataataacacacactatgacacagaagttccagggcagagtcacctgaccacagatacatcccagacgacacacgacctacatggagctgaggagcctgagatctgacgacgacggtccgttgtttacngtgacgtagagtacgagaatattagtaatggatacgtgggccgaacggg

SEQ ID NO: 67535 - DNA, 248 bp, Homo sapiens
  misc_feature: GYAE6OF01DFXBC.37.37.D04.1.454.CMB.1.raw
  modified_base (247)..(248): a, c, t, g, unknown or other
  misc_feature (247)..(248): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctcgtgggggcacagcggccctgggctgcctggtcaaggactacttccatctacactactgagcggctggcaaggcgcatagnn

SEQ ID NO: 67536 - DNA, 534 bp, Homo sapiens
  misc_feature: GYAE6OF01EDH2Q.37.37.D04.1.454.CMB.1.raw
  modified_base (300)..(300): a, c, t, g, unknown or other
  misc_feature (300)..(300): n is a, c, g, or t
  modified_base (399)..(399): a, c, t, g, unknown or other
  misc_feature (399)..(399): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggctcctcatctatggtncatccaccagggccactggactcccagccaggttcagtggcaggtgggtctgggacaggagttcactctcaccatcagcagcctgctagtctagaagtnttttgcttagttttattctgtcagctaagtataattactggtccttacgtacgtcggtacgttcggaccgtaagggacctaagggtcggaaataccgaaaacggaactggtcggtactagaccacctagtctacg

SEQ ID NO: 67537 - DNA, 546 bp, Homo sapiens
  misc_feature: GYAE6OF01AXB6N.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcacctgaccacgagatacactacccaacgacgacaacacgaccctacagtacggacgcgtaggaggacgccgtaggacgtactcgtacgaacgacgaccggtccgttgtttacgtgtgacgagtagtacgagtaattagttagtaatacggaactacggtcgggaccgtaacggg

SEQ ID NO: 67538 - DNA, 535 bp, Homo sapiens
  misc_feature: GYAE6OF01BCMM6.37.37.D04.1.454.CMB.1.raw
  modified_base (399)..(399): a, c, t, g, unknown or other
  misc_feature (399)..(399): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttaacaataataacacacactatgacacagaagttccagggcagagtcacctgaccacagatacatccacgancacacgcctacatggagctaggagacgcctaggagactcgtgaacgacgacggtccgttgtttacgtgtcggacgtagtagtacgaagtaacttagttagtaattcgggaacgtacggtcggggccgtaaacgggg

SEQ ID NO: 67539 - DNA, 264 bp, Homo sapiens
  misc_feature: GYAE6OF01AZGRB.37.37.D04.1.454.CMB.1.raw
  modified_base (260)..(264): a, c, t, g, unknown or other
  misc_feature (260)..(264): n is a, c, g, or t
tcagtagtgtagatcacgaccggtgctcgatttagtagcatactgttgggtttggtgcccaagctgctggagggcacggtcaccacgctgctgaggagtagagtcctgaggactgtaggacagcccatcggtcttcccctcggcaccctcctccaacgagcacctctggggcgacagcggcccgtcggcgtgcctcggtcgaacggacgtaccttcctatctacacctactcgagcgggcgtggcgaacggcggcatagnnnnn

SEQ ID NO: 67540 - DNA, 665 bp, Homo sapiens
  misc_feature: GYAE6OF01AX6UJ.37.37.D04.1.454.CMB.1.raw
  modified_base (404)..(404): a, c, t, g, unknown or other
  misc_feature (404)..(404): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctctgcaaggcttctggttatacctttagctaattatggtatcaactgggtgcgacacggcccctggacaaggccagtgaggtggagtgggatgggatcgagcgtacttaacaataactaacaacacaactatgacacaagtaacgttccagggacagacgtccacccgtgacccanaagatacactacccaacgacaccaaccgacgaccctaacgaagtcgggacgtccgtaggaacgggacgtacccgtaggtaacgacgttccgaaggaacccgtaaccggtaacccgggtccggtttacggtttttaaccgtgggttacggtacgggtaacggttaaacggttaaccgaaaggtttaaacgttacgtttaaggttaaacggttcgggttaaaccgttaccgggtaaccgggggtacccggtaaaacccggggg

SEQ ID NO: 67541 - DNA, 619 bp, Homo sapiens
  misc_feature: GYAE6OF01AT9IS.37.37.D04.1.454.CMB.1.raw
  modified_base (410)..(410): a, c, t, g, unknown or other
  misc_feature (410)..(410): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggcccctggacaaggccatgagtggatgggatggatcagcgcttacaataataacacacactatgcacagaagttcagggcagagtcaccctgaccacagatacactaccacgagcacagcctanatggagctgagggacgccgtaggagacgttcgtacggaaccgaccgaaccgggtcccggtttaggtttttaacccgtgggttacggtaccgggtaacggtaaagggttaacctaaagggtaaaacgtttaagttttaagggttaaaacgtttacggggtaaaccctttaaaccgggttcggggggggaaccccgtaaaacccggggggg

SEQ ID NO: 67542 - DNA, 251 bp, Homo sapiens
  misc_feature: GYAE6OF01CR2OM.37.37.D04.1.454.CMB.1.raw
  modified_base (247)..(251): a, c, t, g, unknown or other
  misc_feature (247)..(251): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnn

SEQ ID NO: 67543 - DNA, 386 bp, Homo sapiens
  misc_feature: GYAE6OF01BR2T8.37.37.D04.1.454.CMB.1.raw
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(300): a, c, t, g, unknown or other
  misc_feature (298)..(300): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (363)..(386): a, c, t, g, unknown or other
  misc_feature (363)..(386): n is a, c, g, or t
tcagtagtgtagatcacgaccggtgctcgattttagtagcatactgttagggtttgggtgcccaagctgacttggaggggcacgggtcacccacgctcgcgtgagggagtagagtaacctgacggtactgtagggacagcccaatcggtcttccccctggcaccctcctccaagagccacctctggggcacagcggcctgggctgcctggtcaaggactacttccgatacgtacacgtactcgacgcgggctgggccaacggccgacgactagctctccngcncctncncagcncncnnncncacncgcgcgcgcgcncgngagacgactactcncgcnctctcngcgcgcgngcgngcngannnnnnnnnnnnnnnnnnnnnnnn

SEQ ID NO: 67544 - DNA, 720 bp, Homo sapiens
  misc_feature: GYAE6OF01ENFSZ.37.37.D04.1.454.CMB.1.raw
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctcgagtgaaggtctcctgcaaggtcttcgtggttattacctttagctaattatggtatacaacgtgggtgacgacgacggccccgtaggaacaacggccagtgaggtggagtgggatggatcgagcgtactaanaaataanaaccaacacgtaactatcgacaacgaagtaacgttccgaagggacaaggtacgtaccacccgtacgaaccaacgaagaactaaccacgtacccgaacggaacgacctaaccgacgacccgttaacgaacgttacgggacgtacgttacggaacgggtacgtacccgttaaggaacggtacgttaccggtaaccggaacccggtaaccgtaaccggggttacccgttaaacgttacgtttaccgtagggttaagggtaacgggaagggtcgggttaacgggggtacgggtaacggggggtaaccgttaccgggggtaccggggaacccggtaaccggggtaaccccgttcggggttaacccccg

SEQ ID NO: 67545 - DNA, 637 bp, Homo sapiens
  misc_feature: GYAE6OF01AJZ9W.37.37.D04.1.454.CMB.1.raw
  modified_base (304)..(304): a, c, t, g, unknown or other
  misc_feature (304)..(304): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctgatggcagcagcaacaggtgcccactctcaggttcagctggtgcagtctggagctgaggtgaagaagcctggggcctcagtgaaggtctcctgcaaggcttctggttatacctttagcaattatggtatcaacgtgggtgcgacaggcccctggacaaggccangagtggatgggatggatcgagcgacgttaacaataataacacacactatgacacagaagttccgagggcagacgtaccaccctagaccacgagactacactaccacgacgacaaccacgaccctaacgacgtaggaacgtccgtagggaacgggacgtacccgttaggaacgtacgttacgtacggaaccggtaacccggaccgggtcccggtttacgtttttaaccgtggttacgggtaccggtaaggtaacggttaaccgaaaggtaaagtttaacgtttaagggtaaacgttacgggtaaccgttaccgggtacggggggtaaccccggg

SEQ ID NO: 67546 - DNA, 539 bp, Homo sapiens
  misc_feature: GYAE6OF01AWP9I.37.37.D04.1.454.CMB.1.raw
  modified_base (415)..(415): a, c, t, g, unknown or other
  misc_feature (415)..(415): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctgggcaaggccatgagtggagtgggatggatcagcgcttacaataataacacacactatgacacagaagttccagggcagagtcaccctgaccacagatacactaccacgagcacacgaccctanagtggagcgtaggaggacgcctaggacgtatcgtacgacgacgaccgggtccgttgttttactggtacgacgagtagtacgagtaattagttagtaagtcggaatcggtggggccgtaacgggg

SEQ ID NO: 67547 - DNA, 642 bp, Homo sapiens
  misc_feature: GYAE6OF01DHZYE.37.37.D04.1.454.CMB.1.raw
  modified_base (332)..(332): a, c, t, g, unknown or other
  misc_feature (332)..(332): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctgggcctcagtgaaggtctcctgcaaggcttctggttatacctttagcaattatggtatcaacgtgggtgcgacaggcccctggacaaggccatgagtggatgggatggatcagcgacttaanaaataataacaacacaactatgacacgaagtaacgttccgagggcagacgtcaacccgtagaacccaagaacgtaactaacacttacccgaacgacgaccaacgacgaccctacaacgtgggacgaccgtaggacgggacgtccgtaggaaggtacttcggtaagaaccggaccgtaacccggggttcccgtttagttttaccgtgggtcggaccggtaaggtaaaggttacaagggtaaattttaacgttagggtaaacttacggggtaaccttaaccggggtcggggtaacccggttaaacccggggg

SEQ ID NO: 67548 - DNA, 595 bp, Homo sapiens
  misc_feature: GYAE6OF01B5TGD.37.37.D04.1.454.CMB.1.raw
  modified_base (389)..(389): a, c, t, g, unknown or other
  misc_feature (389)..(389): n is a, c, g, or t
  modified_base (406)..(406): a, c, t, g, unknown or other
  misc_feature (406)..(406): n is a, c, g, or t
  modified_base (450)..(450): a, c, t, g, unknown or other
  misc_feature (450)..(450): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctctgcaaggcttctggttatacctttagctaattatggtatcaacgtgggtgcgacaggcccctggacaaggccagtgagtggatggggatggatcgagcgtctacaataataacacacactatgacacaagaacgtccagggcagagtcacctgaccanagatacatacccaagancacacgcctaacagtggatcgaggaggacgcccgtagaacggtntacgtaggaaccgacggtaccgggtccgtttacgttttacgtcggttaggacggtacggtaaggtaaccggaaagttaaattaacgtttaggtaaacgttacggggaacttaaccggggtcgggggtaacccgtaaacccggggg

SEQ ID NO: 67549 - DNA, 530 bp, Homo sapiens
  misc_feature: GYAE6OF01CFZDW.37.37.D04.1.454.CMB.1.raw
  modified_base (393)..(393): a, c, t, g, unknown or other
  misc_feature (393)..(393): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcagtgaaggtctcctgcaaggcttctggttatacctttagctaattatggtatcaacgtggggtgcgacaggcccctggacaaggccagtgagtggatgggatggatcagcgcttaacaataataacacacaactatgacaacagaagttccagggcaggatccacctgaccanagatacataccacgagacacacgcctacagtggacgcgtaggaggacgccgtagagagtcgtagacgacgacggcgttgtttagtgtgacgagagacagaactagttagtaataggactacgtggggcctaacgggg

SEQ ID NO: 67550 - DNA, 505 bp, Homo sapiens
  misc_feature: GYAE6OF01B9MHF.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgacacagaagttccagggcagagtcaccctgaaccacagatacatccacgagcacacgcctaacagtggagcgtgaggagcctagagatctgacgacacggccgtgtttactgtgcgagagtacagaatattagtaatggatcgtgggcgtaacggg

SEQ ID NO: 67551 - DNA, 549 bp, Homo sapiens
  misc_feature: GYAE6OF01B4TE3.37.37.D04.1.454.CMB.1.raw
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctccaggctccncatctatggngcatcccacagggccacgtggtaactcccagccaggttcagtggcaggtgggtcgtgggacaggacgttcactcctcaccatcagcagcctgcagtctagaagtattttggactagttttatttctgtcagtcagttacttaattcctggtacccttccgtacggtggtacccggttcggccgtaaacgggaaccaagggtacggtaaactacggaaacgtacgtggtacgcgtagccaccgatcgtacg

SEQ ID NO: 67552 - DNA, 598 bp, Homo sapiens
  misc_feature: GYAE6OF01BA4R7.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggtcttctggttatacctttagctaattatggtatcaacgtggtgcgacaggcccctggacaaggccagtgagtggatgggatggatcgagcgtacttaacaataactaacacacactatgacacgagtaacgtccgagggcagacgtccacctagaccacagactacactacccgaacgagaccaacacgacctaacgagtcggagtcgtaggaggacgtaccgtaggaacgtacgtacgacggaaccgacggtacgggttaccgtttagttttaccgagtcggacggtaaggtaagtaacgtaagtaattagttacgtaagtacggtaacgttacgggtacggggcccgtaaaccgggg

SEQ ID NO: 67553 - DNA, 630 bp, Homo sapiens
  misc_feature: GYAE6OF01B771E.37.37.D04.1.454.CMB.1.raw
  modified_base (400)..(400): a, c, t, g, unknown or other
  misc_feature (400)..(400): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacgtgggtgcgacacggcccctggacaaggccatgagtggagtgggatggatcgagcgtacttaacaaataataaccacacactatgacagaagaacgttcgagggacagagtcacccgtgaccacanaatacatcccaacgacacaaccacgacctaacgagtacggacgacgtaggaacgggacgcccgtaggaacgacttaccgtacggaccgaaccgtaccgggtcccggtttaggttttaaccgtggttacgggtaccggtaaggtaacggttaacgaaggtaaatttaacgttaaggttaaacgtacgggtaaaccgtttacgggtaccgggggtacccggtaaacccgggg

SEQ ID NO: 67554 - DNA, 818 bp, Homo sapiens
  misc_feature: GYAE6OF01AEHBN.37.37.D04.1.454.CMB.1.raw
  modified_base (312)..(312): a, c, t, g, unknown or other
  misc_feature (312)..(312): n is a, c, g, or t
tcagtagtgtagatcacgaccggtgctcgatttagtagcatactgttggggtttggggacccaaaaaccacacccctccgttgggagaatcccctagatcacagcgtccctcaccatggacctgggacctcggagcatccttttcctggtggccaggcagacaacgaggtgcccactctcaggttccagtctcggtcgcctagtctggagctggtaggtagaagaagccgtcgggccctcgacgtacgaacggtccgtcctagacgaaaggtctttcgtaggtttacttaccgttttagcgtaaatttacgnggtaactacgaaacgttggggtcacggaacgaccggaccccgtggtacctaacggcctagtgaagtcggacgttgggattggactcgaggtccggtaccttaaacgaaacttaaacgtaacgaaccaacgtaacgttacgtcgtaccgaaacggaacggtaacggtttacccggaacgggtacctaacggtaaccgtacccaacccgttacggaacccaacgtacgtaaccttaaccgaccgtacccgaaccggaagaccctaacgtacggtacctaaccaaggttacggacgtacgacggaaggtacgtccgtaaggtaacgttaacgttccggttaacgggaaccgttaacccggaaccgggttacccgtttaacggtttaacgtacggtaaccggtaaacggtaaccggtaaacgttaacggtaaggttaaagtttacgttaacggtaaaccggttccggtaaacgtttcccggggttcggggtaacccgttaaacccggggg

SEQ ID NO: 67555 - DNA, 255 bp, Homo sapiens
  misc_feature: GYAE6OF01BPWUH.37.37.D04.1.454.CMB.1.raw
  modified_base (216)..(216): a, c, t, g, unknown or other
  misc_feature (216)..(216): n is a, c, g, or t
  modified_base (245)..(255): a, c, t, g, unknown or other
  misc_feature (245)..(255): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctggggcacagcggccctgggctgcctggtcaaggctacttccatctacnctactgagcgggctggcaaggcgcatagnnnnnnnnnnn

SEQ ID NO: 67556 - DNA, 519 bp, Homo sapiens
  misc_feature: GYAE6OF01BCZYW.37.37.D04.1.454.CMB.1.raw
  modified_base (412)..(412): a, c, t, g, unknown or other
  misc_feature (412)..(412): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaagggccatgagtggatgggatggatcagcgcttacaataataacacacactatgcacagaagttccagggcaggagtcaccctgaccacagatacatccacgagcacacgcctaanactggagctgaggacgcctaggagatacgtgacgacacgggtccgttgtttacgtgtgacgtagagtacagtaatattagtaatggactacgtggggcctaacgggg

SEQ ID NO: 67557 - DNA, 620 bp, Homo sapiens
  misc_feature: GYAE6OF01BK96E.37.37.D04.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (295)..(295): a, c, t, g, unknown or other
  misc_feature (295)..(295): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgagggaanagccacctctcctgcagggccagtcagngtgtagcagcaacttagcctggtacagcagaacctggccagctccaggctctcatctagtggtcnctactccaccgaggcctagtcggtactccgagcctaggtcaggtcggacgaggttggtcgtacgggactaggtacgttcacgttctacgaacctagttccgagtccgtacgtccgttgacgtacggttcgtacggtaagttacgttttacgccgtttaagttttactttacgtacgttcgaacgtactaagtttaactaacgtttacgtaccggtccttaccgtacggtacggtaccggttcggaccgtaaacgggtaccctaagggtccgtaaatacggtaaacgtctacggtacgtcgtacgtaccgaaccttgtccgttacg

SEQ ID NO: 67558 - DNA, 568 bp, Homo sapiens
  misc_feature: GYAE6OF01ARCVI.37.37.D04.1.454.CMB.1.raw
  modified_base (495)..(495): a, c, t, g, unknown or other
  misc_feature (495)..(495): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagcaattatggtatcaactgggtgcgacaggccctggacaaggccatgagtggagtgggatggatcagcgcttaacaataataacacacactatgacacgagaagttccgagggcaagacgtcaccctgaccacagatacatccacgagcaacacgccctaacagtacgggagcgtaggaacgggacgccgtaggaacgtatccgtaggaaccgacgaccgggtccgttacggtttacncggtagccgtaaggtaagtaacaaggtaattagttagtaagtgggtaacctacggtcggggccgtaaacgggg

SEQ ID NO: 67559 - DNA, 619 bp, Homo sapiens
  misc_feature: GYAE6OF01ED103.37.37.D04.1.454.CMB.1.raw
  modified_base (233)..(233): a, c, t, g, unknown or other
  misc_feature (233)..(233): n is a, c, g, or t
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (417)..(417): a, c, t, g, unknown or other
  misc_feature (417)..(417): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgccaccctctcctgcagggccagtcagngtgttagcagcaacttagcctggtaccagacaacgaaacctggaccaggcctcccgaggcctcctcatctagtggtcncactccaccgaggccacgtcggtactcccagccaggttcnggtggcgaggtggtcgtggacngtagtcactctcacatcgagcgacgctgctagtctagtaagttnttttggaccttaggtttttacttcgttcgttacgtagtacgtaagtttaacttaaacgtttccgtcgttaccccgttaccgttacggttcgggtaacccgggttccgggaacccggtaaaccggggtaaccgtaaagggtaacggttaaacgaacgtaaaacgggacgttaaggtacggtctagacccacgtatccgttacg

SEQ ID NO: 67560 - DNA, 577 bp, Homo sapiens
  misc_feature: GYAE6OF01DC6LS.37.37.D04.1.454.CMB.1.raw
  modified_base (507)..(507): a, c, t, g, unknown or other
  misc_feature (507)..(507): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtggggcctcagtgaaggtctcctgcaggcttctggttataccttttagctaattatggtatcaacgtgggtgcgacgacggcccctggacaacggccagtggagtggagtgggatggatcagcgacttaacaataataacacacactatgacacagaacgttcgaggcaggacgtccacctacgaccaacgagaactacatacccaacgacgaccaacacgtcctaacagtaggacgtctaggacggacgcccgtaggacgactcgtagaaccgacgacggtaccgtttagtttacgnggtagacggtaagtagtacgagtaacttagttagtaagtacggacgttacggtcggggaccgtaaccggg

SEQ ID NO: 67561 - DNA, 614 bp, Homo sapiens
  misc_feature: GYAE6OF01B2JXS.37.37.D04.1.454.CMB.1.raw
  modified_base (534)..(534): a, c, t, g, unknown or other
  misc_feature (534)..(534): n is a, c, g, or t
tcagtagtgtagatcacgaccggtgctcgatttagtagcatactgttgggtttgggacccaaaaaccacacccctccttgggagaatcccctagatcacagctcctcaccatggactggacctggagcatcctttcctggtggcagcagcaacaggtgcccactctcaggttcagctggtgcagtctggagctgaggtgaagaagccgtgggcctgagtgaaggtctccgtgacaaggcttcgtggttactaccgtttagctaaattatggtaatcaacgtgggtgcgacacggcccctggacaaggccagtgagtgagtggatggatcgagcgtacttaacgaaataataaccacaacgtaactatcgacaacgaagtaacgttccgagggtacagacgtacctaaccgtgaaccactaagactactacgtccaacgacgactaacgacgtacctacgagtaggacgtacgtaggaaggacgtccgtagacgtacgttacgagaaccgacgtacggtccgttaggtttaccgnggttacgacggtacgtaaggtacgaaggtaattagttaacgtaagtacggtaacgttcggtaggggtcccgtaaacgggg

SEQ ID NO: 67562 - DNA, 649 bp, Homo sapiens
  misc_feature: GYAE6OF01BG2L8.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcagtgaaggtctctgcaaggcttctggttatacctttagctaattatggtatacaacgtgggtgcgacgacggccccgtaggacgaaggccagtggaggtggagtgggatggactcgaggtcgtacttaacaaataaataaccaacaacactatgacaacgaagtaacgttccgagggacaaggtacgtccaacccgtagaacccaacgaacgaactaacaactacccgaacgaacgaccaaccgacgaccctaacgagtcgggaacgtcgtagggaacgggacgtccgtaggaacgtacgtacgtacggacggaccgtaccgggtccggttagtttacgtggtacggacggtaggaagtaacgtaaagtaacgttagttaaggttaacgtacggtaaccgttacgggtacggggtaccgtaaaccgggg

SEQ ID NO: 67563 - DNA, 255 bp, Homo sapiens
  misc_feature: GYAE6OF01DOLCI.37.37.D04.1.454.CMB.1.raw
  modified_base (249)..(255): a, c, t, g, unknown or other
  misc_feature (249)..(255): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctcgtgggggcacagccggccctgggctgcctggtcaaggactacttccatctacactactgagcgggctggcaaggcgcatagnnnnnnn

SEQ ID NO: 67564 - DNA, 538 bp, Homo sapiens
  misc_feature: GYAE6OF01DQDPI.37.37.D04.1.454.CMB.1.raw
  modified_base (331)..(331): a, c, t, g, unknown or other
  misc_feature (331)..(331): n is a, c, g, or t
  modified_base (400)..(400): a, c, t, g, unknown or other
  misc_feature (400)..(400): n is a, c, g, or t
  modified_base (473)..(473): a, c, t, g, unknown or other
  misc_feature (473)..(473): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcgagcgcttanaataataacacacactatgcacagaagttccaggcagagtcaccctgaccacagatacactccacgacncacagacctacagtcggagctaggaggacgccgtagagtacgtctgacgaccgtacggtccgttgttttacgngtggccgtagtaagtacgaagaattagttagtaagtacggtacgtacgtcggggcgtaaccgggg

SEQ ID NO: 67565 - DNA, 250 bp, Homo sapiens
  misc_feature: GYAE6OF01AZDMK.37.37.D04.1.454.CMB.1.raw
  modified_base (247)..(250): a, c, t, g, unknown or other
  misc_feature (247)..(250): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcgccctgctccaggagcacctccgagagcacagcggccctgggctgcctggtcaaggactacttccatctacactactgagcgggctggcaaggcgcatagnnnn

SEQ ID NO: 67566 - DNA, 562 bp, Homo sapiens
  misc_feature: GYAE6OF01BL7YA.37.37.D04.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagtagtgtagatcacgaccggtgctcgatttagtagcatactgttgggtttgggggaggaactgctcagttaggacccagacggaaccatggaagcccagcgcagcttctcttcctcctgctactctggctcccagataccactggagaaatagtgatgacgcagtctccagccaccctgtctgtgtctccgaggggaaangccacctctcctgcagggccagtcagagtgttagcagcaacttagcctggtaccagcaagaaacctggccaggctccaggcctctcatctatggtncatccaccagggccacgtggtaactccagcctaggttcaggtggcaggtcggtctggggacaggtacgtttccactctcaccatcagccagcctgctacgtctagaagttcttttgcttaagttttacttcgtgttacagtactaagttaactaacgtaccgtcgggacccccgtagttccggacgaacgggtaccaagggtacgaaactaccgaaacgtacgtggtacgctacgcctaaccgtacttacgtcgtcctgtacc

SEQ ID NO: 67567 - DNA, 549 bp, Homo sapiens
  misc_feature: GYAE6OF01E37VD.37.37.D04.1.454.CMB.1.raw
  modified_base (204)..(204): a, c, t, g, unknown or other
  misc_feature (204)..(204): n is a, c, g, or t
  modified_base (408)..(408): a, c, t, g, unknown or other
  misc_feature (408)..(408): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcaagaaacctggccaggctcccaggcctcctcatctatggtgcactccaccgagggccacgtggtactcccagccaggttcagtcggcaggtgggtctgggacaggtagttcactctcaccatcagcagcctgctagtctagaatnttttgctagttttattctgtcagctaagttattaattcgtcggtaccttcgttacggtcggtaccggttcggaccgtaaacgggacctaagggtacgaaatacgaaacgacgtggtacggactcgacctactagtcttacg

SEQ ID NO: 67568 - DNA, 624 bp, Homo sapiens
  misc_feature: GYAE6OF01A0N07.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacacggcccctggacaaggccagtgagtggagtgggatggatcagcgacttaacaataactaacacacactatgacacgagaagttccgagggcagacgtcacctgaccacagatacatcccagacacacacgacctaacagtacggacgcgtaggaacgggacgacccgttaggaacgtagttccgtacggaacccgaacggtacccgggtcccgtttaggtttttaaccgtgggttacgacgggtaaggttaacggtaacgtaaggtaaatttacgtttaaggttaaacggttacgggtaaaccgtttaccgggtaggggggaccccggtaaacccggggg

SEQ ID NO: 67569 - DNA, 576 bp, Homo sapiens
  misc_feature: GYAE6OF01EPH3A.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaaacctggccaggcctccaggcctcctcatctatggtgcactccaccgacgggccacgtggtactcccgagcccaggttcaggtcggcaggtgggtcgtggggacaggacgttcactctcaccatcagcagcctgcagtctagaagtatttgacttagttttacttcgtgtcgtagtctaagttattaagttccgtggtcccttacgttacggtcggtaccgttccgggacctaacggggaaccgtaaggggtacgaaattaccgaaaacggtacgttggtacggtctacggaccaacccgtgtcgttacg

SEQ ID NO: 67570 - DNA, 533 bp, Homo sapiens
  misc_feature: GYAE6OF01D8NM2.37.37.D04.1.454.CMB.1.raw
  modified_base (529)..(529): a, c, t, g, unknown or other
  misc_feature (529)..(529): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcactccaccagggccactggtactcccagccaggttcagtggcaggtgggtcgtgggacaggagttcactctcaccatcagcagcctgctagtctaggaagtatggtggtctagttttactttcttgtctgtctagttagttttggggtaccttccgttcggtacgtttcggcggtacgacggggaccgtaagggtggagatcgaagcgaactggtcggctagccacnttcg

SEQ ID NO: 67571 - DNA, 580 bp, Homo sapiens
  misc_feature: GYAE6OF01CDJ53.37.37.D04.1.454.CMB.1.raw
  modified_base (407)..(407): a, c, t, g, unknown or other
  misc_feature (407)..(407): n is a, c, g, or t
  modified_base (504)..(504): a, c, t, g, unknown or other
  misc_feature (504)..(504): n is a, c, g, or t
  modified_base (518)..(518): a, c, t, g, unknown or other
  misc_feature (518)..(518): n is a, c, g, or t
tcagtagtgtagatcacgaccggtgctcgatttagtagcatactgttgggtttggggacccaaaaaccacacccctccttgggagaatcccctagatcacagctcctccaccatggactggacctggagcatccttttcctggtggcagcagcaacaggtgcccactctcaggttcagctggtgcagtctggagctgaggtgaagaagccgtggggcctcagtgaaggtctcctgcaaggcttctggttaatacctttagctaattatggtatcaactgggtgcgacacggcccctaggacaaggccagtggagtggagtgggatggatcgagcgtcttaacaataactaacacacactatgactacagtaacgttcgagggcagacgtaccacctgaaccacaganaccatcccaacgacgaccacacgacctaacgagtcggagcgtaggaaggacgccgtagacgtacgtcgtagacgtacgacggtcgtttagtttacgnggtagacgaggtanaacgtagtaacgttagtttaggtaacgtaacggtacgttacggtagggccggtaaaccgggg

SEQ ID NO: 67572 - DNA, 703 bp, Homo sapiens
  misc_feature: GYAE6OF01B9GH2.37.37.D04.1.454.CMB.1.raw
  modified_base (205)..(205): a, c, t, g, unknown or other
  misc_feature (205)..(205): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagagtgtagcagcaacttagcctggtaccagcagaaacctggccaggcctcccgaggcctcctcatctagtggtgcatcccaccgagggccacgtggtactcccgacgcccgaggttcaggtcggcgtagggtgggtcgtaggggacaggtagttccacgtctaccacctataccgacgtacacgtcccgtacgacacggtacgtaggtaaagttacgtttttacgacgtttaagtttttacgtttccgttagttcgtaacgtacgtaagtttaacgttaaacgtttaccgttacgggttacccctttaccggttaaccgggttacgggtaacccgggtttaccgggaacccgggttaaacgggggtaaaccccggttaaaggggtaaacgggtaaaaccgttaaaccggaaaacggttaaaccggttggtaccggtcgttacggaacccgtaacccgtacgttcgttaccgg

SEQ ID NO: 67573 - DNA, 253 bp, Homo sapiens
  misc_feature: GYAE6OF01CW17H.37.37.D04.1.454.CMB.1.raw
  modified_base (246)..(253): a, c, t, g, unknown or other
  misc_feature (246)..(253): n is a, c, g, or t
tcagtagtgtagatcacgaccggtgctcgatttagtagcatactgttgggtttgggtgcccaagctgctggagggcacggtcaccacgctgctgaggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnn

SEQ ID NO: 67574 - DNA, 622 bp, Homo sapiens
  misc_feature: GYAE6OF01C6P19.37.37.D04.1.454.CMB.1.raw
  modified_base (218)..(218): a, c, t, g, unknown or other
  misc_feature (218)..(218): n is a, c, g, or t
  modified_base (342)..(342): a, c, t, g, unknown or other
  misc_feature (342)..(342): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctnagtgaaggtctcctgcaaggcttctggtttatacctttagctaatttatggtatcaacgtgggtgcgacgacggccctaggacaaggccatggagttggagtgggatggatcgagcgtcttaanaataataacacacatatgacaacaagaacgttcgagggacaaggagtaccaccgtacgaaccaacgacgaatacaacgtacccgacggaacgaccaacgacgtacctaacagtaggacgcgtagagggacgccgtaggaacgtacgtcgtacggacgtaaccgcgggttaccggtttcgttttaaccgtggtacgcggtaacggtagttaacgaaagtaaagttaagttagtaacgttacggttaccgtttacgggtacggggtccggtaaacccggggg

SEQ ID NO: 67575 - DNA, 611 bp, Homo sapiens
  misc_feature: GYAE6OF01C8ZN3.37.37.D04.1.454.CMB.1.raw
  modified_base (442)..(442): a, c, t, g, unknown or other
  misc_feature (442)..(442): n is a, c, g, or t
  modified_base (591)..(591): a, c, t, g, unknown or other
  misc_feature (591)..(591): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcgagtgaaggtctcctgcaaggcttctggttatacctttaggctaattatggtatcgaactgggtgcgacacggcccctggacaaggccatggagtcggagtgggatggatcgagcgcttaacgaataataacacaacactagtcgacaacgagtaacgttccgagggcaaggactccacctgaccacagactacactccaacgacgtacacacgtacctaanacgtggagtcgtaggaggtacgccgttaggacgtacgtcgtaggaaccggtaccgtaccgggttaccgtttacggttttacgaggttacggacgtaaggtaacgtacgtaagtaaattagttaagtaacgtacgggtaacttaccgggnggggtaacccgtaaccgggg

SEQ ID NO: 67576 - DNA, 590 bp, Homo sapiens
  misc_feature: GYAE6OF01DD9WL.37.37.D04.1.454.CMB.1.raw
  modified_base (283)..(283): a, c, t, g, unknown or other
  misc_feature (283)..(283): n is a, c, g, or t
  modified_base (386)..(386): a, c, t, g, unknown or other
  misc_feature (386)..(386): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagcctggggcctcagtgaaggtctcctgcaaggtcttcgtggttatacctttagctaattatggtatctaacgtgggtncgacgacggccctggacaggccagtggagtggagtgggatgggatcgagcgacttaacaataataacacacatatgcacagagtccgagggcagatcaccgtnaccacagactacactaccagacgacacacgacctaacagtagggacgcgtacggacggacgaccgtagaacgtatcgtaggaaccgtaccgtaccgggttccggtttacggtttttaacgtggtcggacggtaaggtacgtaactaaggtaatttacgttagtaaacgttacggactttacgggcggggtacccgtaaccgggg

SEQ ID NO: 67577 - DNA, 612 bp, Homo sapiens
  misc_feature: GYAE6OF01BJNPZ.37.37.D04.1.454.CMB.1.raw
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacgtgggtgcgacacggcccctggacaaggccatgagtggagtgggatggatcgagcgtcttaanaataactaacacacactaatgacaanagtaagttccgagggcaggacgtccaacctcgaccacaagactacactacccgaacgacgaccaaccacgaccctaacgagttacgggacgtacgtagggaacggaacgcccgttagaacggacttcgtacggaccgaaccgtaccgggtcccgtttagttttaacctggcggtacggaaggtagttaacgaagtaacttagttacgttaaagtggtaaacctcgggttagggggcccgtaaaccgggg

SEQ ID NO: 67578 - DNA, 578 bp, Homo sapiens
  misc_feature: GYAE6OF01DQ6Q8.37.37.D04.1.454.CMB.1.raw
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctctgcaaggcttctggttatacctttagcaattatggtatcaactgggtgcgacacggccctggacaaggccatgagtggatgggatggatcagcgacttaacaataaataacacacactatgcaacagaacgttccagggcagacgtcacctgaccacagaactacaatcccatacgacacagacctacagtggagctaggaggacgaccgtggagagttccgtaggaaccgacgaccgggtccgtttacgtttttaacgtggttgacggtacgtaagtacgtaaagtaaattagttaacggttaagtacgggtaacttaaccgggtcggggaccgtaaacccggggg

SEQ ID NO: 67579 - DNA, 269 bp, Homo sapiens
  misc_feature: GYAE6OF01AN12T.37.37.D04.1.454.CMB.1.raw
  modified_base (248)..(269): a, c, t, g, unknown or other
  misc_feature (248)..(269): n is a, c, g, or t
tcagtagtgtagatcacgaccggtgctcgatttagtagcatactggttgggtttgggtgcccaagctgctggagggcacggtcaccacgctgctgagggagtagaggtcctgaggactgtaggacagcccatcggtcttccccctggcaccctcctccaagagcacctctgggggcacagcggccctgggctgcctggtcaaggactacttcatctacactactgagcgggctggcaaggcgcatagnnnnnnnnnnnnnnnnnnnnnn

SEQ ID NO: 67580 - DNA, 588 bp, Homo sapiens
  misc_feature: GYAE6OF01EF3O9.37.37.D04.1.454.CMB.1.raw
  modified_base (285)..(285): a, c, t, g, unknown or other
  misc_feature (285)..(285): n is a, c, g, or t
  modified_base (340)..(340): a, c, t, g, unknown or other
  misc_feature (340)..(340): n is a, c, g, or t
  modified_base (400)..(400): a, c, t, g, unknown or other
  misc_feature (400)..(400): n is a, c, g, or t
  modified_base (431)..(431): a, c, t, g, unknown or other
  misc_feature (431)..(431): n is a, c, g, or t
  modified_base (509)..(509): a, c, t, g, unknown or other
  misc_feature (509)..(509): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggtttatacctttagctaattatggtatcaacgtgggtcncgacgacggcccctggacaaggccagtgagtggatgggatggatcagcgcttaanaataaactacacacactatgacagaagtacgtccgagggcagacgtccaccgtcgaccanacgatacactccacgacgacacacgacctanacgtaggacgcgtagacgggacgcccgtagaacgtctacgtacggaccgaaccgtaccgggtccgtttagttttacgnggtcgacggtaagtacggtaacagtaattagttagtaacgttaggtaaccgttacggtccggggtacgtaaacccgggg

SEQ ID NO: 67581 - DNA, 247 bp, Homo sapiens; identical to SEQ ID NO: 67450
  misc_feature: GYAE6OF01E18GZ.37.37.D04.1.454.CMB.1.raw
  modified_base (247)..(247): a, c, t, g, unknown or other
  misc_feature (247)..(247): n is a, c, g, or t

SEQ ID NO: 67582 - DNA, 579 bp, Homo sapiens
  misc_feature: GYAE6OF01BOZQH.37.37.D04.1.454.CMB.1.raw
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
  modified_base (415)..(415): a, c, t, g, unknown or other
  misc_feature (415)..(415): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggagtgggatggatcagcgcttacaataataacacacactatgcanagaagtccagggcagatcacctgaccanagatacatccacgagacacagcctacagtggacncgtaggaagggacgcctaggagacttacgtggaaccgaacgaccgggtccgtttgttttaaccgtcggttacggtacggtaacggtaagtaacggtaaggtaaattaagtttacggtaaagttacgggaacttaaccgggtcgggggacccgtaaacccggggg

SEQ ID NO: 67583 - DNA, 295 bp, Homo sapiens
  misc_feature: GYAE6OF01BQ7HU.37.37.D04.1.454.CMB.1.raw
  modified_base (236)..(236): a, c, t, g, unknown or other
  misc_feature (236)..(236): n is a, c, g, or t
  modified_base (253)..(295): a, c, t, g, unknown or other
  misc_feature (253)..(295): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagtcacctctgggggcacagcggccctgggctgcctggtcaaggactacttccgatcctacactactgacggcgggntggcaacggcgcatagnnnnnnnnnnnnnnnnnnnnnnnnnnnnnnnnnnnnnnnnnnn

SEQ ID NO: 67584 - DNA, 318 bp, Homo sapiens
  misc_feature: GYAE6OF01B7Y1H.37.37.D04.1.454.CMB.1.raw
  modified_base (296)..(318): a, c, t, g, unknown or other
  misc_feature (296)..(318): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccccgtgccaccctcctaccaagacgccacctcggtggggccacgacggccggcccgtgggcctcgccgttggtaccgaaacggtaccttaccttccacttacctaacctacttacgtggacggccgggcgtcggaccgaacggggccacaagtagnnnnnnnnnnnnnnnnnnnnnnn

SEQ ID NO: 67585 - DNA, 668 bp, Homo sapiens
  misc_feature: GYAE6OF01BZZ7N.37.37.D04.1.454.CMB.1.raw
  modified_base (204)..(204): a, c, t, g, unknown or other
  misc_feature (204)..(204): n is a, c, g, or t
  modified_base (504)..(504): a, c, t, g, unknown or other
  misc_feature (504)..(504): n is a, c, g, or t
tcagtagtgtagatcacgaccggtgctcgatttagtagcatactgttgggtttgggggaggaactgctcagttaggacccagacggaaccatggaacgccccagcgcagcttctcttcctcctgctactctggctccagataccactggaagaaatgtgatgacgcagtctccagccacctgtctgtgtctacgaaggggaaancgcccaccctctcctgcgacgggccagtcgagtagtgttagcagactaacttagcctacggtaccagcaacgaaaccgtcggaccacggcctcccgaggcctcctcattctagtcggtcacactaccgaacgacgggcctacgtcggtactcccgagtccgtaggttcgaggtcggcgtagggtgggtcgtagggactacgggttacgtccacgttccacgtaccacgtacacggtaccacgtccctagaccgttagtctaagtaacgttcgttttgacgtttagtttttaactcggttntacgtacgtacttagttaaactttaccgtacgttaccggttcccgttacgttccgggtacggtaaccgttccgggaaacgtaagggaacccgtaaagggtacgtaaaccgaacggtaaacgtacgtggtacggtacctcgaacccgttactacgttgttacccg

SEQ ID NO: 67586 - DNA, 565 bp, Homo sapiens
  misc_feature: GYAE6OF01BYTQO.37.37.D04.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttagcctggtaccagcagaaacctggccaggctcccaggcctcctcatctatggtncatccaccgagggccacgtggtactcccagccaggttcagtggcaggtgggtctgggacaggtacgttcacgtcctacaccatcagccacgtcctgctagtctagtaagtattttgcttagttttactttcgtgttactagtctaagttattaacgttcgtcggtaccttccgtacggtacggtacgttccggaccgtaacgggaccgtaagggtacgtaaactacgaaacgtacgtaggtcgtctacgaccacgtgtcgtacg

SEQ ID NO: 67587 - DNA, 549 bp, Homo sapiens
  misc_feature: GYAE6OF01DWJI3.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggccctggacaaggccatgagtggatgggatggatcagcgcttacaataataacacaacactatgcacagaagttccagggcagagtcacctgaccacagatacactccacgacgacacacgcctacataggagctaggaggacgacctgagtactcgtaggaacgacgaccggtccgtttcgttttacgtgttacggcgtaaggagttaacgagtaaattagttagttaagtaggtaactacggtggggcccgtaaaccggggg

SEQ ID NO: 67588 - DNA, 634 bp, Homo sapiens
  misc_feature: GYAE6OF01CLGCK.37.37.D04.1.454.CMB.1.raw
  modified_base (438)..(438): a, c, t, g, unknown or other
  misc_feature (438)..(438): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagcgcccaccctctcctgcgagggccagtcagagtgttagcagctaacttacgcctcggtaccagacaacgaaaccgtcggaccaggcctccgaggcctcctcatctagtcggtcgcactcccgacgacgggcctacgtggtacctcccgagccgtaggttccaggtcggcgtaggtgggtctagggactaggtcgttcacttcacacatcagcacgcctgctagtctagagttntttcgctttagtttactttcgttagtctaagtcttaaagttaacttaacgttaccgtcggtccctttacggtaacggttccgggttaaccggttacgggaacccgtaaacgggtaaccgtaaagggtacggtaaacgtaaccggtaaaacgtacgtggtaccggtacgtacgacccttaaccgtgttccgttaccg

SEQ ID NO: 67589 - DNA, 647 bp, Homo sapiens
  misc_feature: GYAE6OF01B3SIC.37.37.D04.1.454.CMB.1.raw
  modified_base (410)..(410): a, c, t, g, unknown or other
  misc_feature (410)..(410): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctctgcaaggcttctggttatacctttagctaatttatggtatacaacgtgggtgcgacacggcccctggacaaggccagtgagtggagtgggatggatcagcgtacttaacaaagtaaataacacaacacttatcgacacgaagaacgttccgagggcaaggacgtacaccctagaaccanagactacactacgacgacgacaacacgacctaacgagtgggaactcgtaggacgggtacgccgttagaacggtaacttccgaaggaaccggtaccgaccgggtcccggttttaggtttttaaccgtgggttaacggaccggtaagtaacggttaacgaagttaaagtttaagttacggtttaaaacgtcgggtaaacccgtttacgggtacggggggtaacccgttaaacccggggg

SEQ ID NO: 67590 - DNA, 603 bp, Homo sapiens
  misc_feature: GYAE6OF01EIGIZ.37.37.D04.1.454.CMB.1.raw
  modified_base (346)..(346): a, c, t, g, unknown or other
  misc_feature (346)..(346): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (483)..(483): a, c, t, g, unknown or other
  misc_feature (483)..(483): n is a, c, g, or t
  modified_base (528)..(528): a, c, t, g, unknown or other
  misc_feature (528)..(528): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtctggagctgaggtgaagaagccgtgggcctcgagtgaaggtctcctgcaaggtcttcgtggttatacctttagctaattatggtatcgaacgtgggtgcgacgacggcccctggacgaaggccagtgaggtggagtgggatggatcgagcgacttaanaaataaactaacaacacactatgacaacgaagtaacgtccgagggcaagtacgtaccacccgtagaaccaacgaagaactaacactacccgaacgacgaccaacgacgtcccaanagtcggacncgtagggagtacnccgtagagtacgtcgacgaccgacgtaccggtcgtttagtttcgnggtacgagtaagtagtacgaagttaacttagtaacggttaagacggaacgttcgggaccggaccggtaaaccggg

SEQ ID NO: 67591 - DNA, 532 bp, Homo sapiens
  misc_feature: GYAE6OF01EK4BG.37.37.D04.1.454.CMB.1.raw
  modified_base (410)..(410): a, c, t, g, unknown or other
  misc_feature (410)..(410): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggcccctggacaaggccatgagtggatgggatggatcagcgcttacaataataacacacactatgacacagaagttccagggcaggagtcacctgaccacagatacatccacgagcacagcctanagtggagactgaggagcctaggacgactcgtagaccgacgtaccggtcgttgtttacgtggtagcggagtagtacagtaattagttagttaagtaggaactacggtggggaccgtaacgggg

SEQ ID NO: 67592 - DNA, 595 bp, Homo sapiens
  misc_feature: GYAE6OF01DSXKS.37.37.D04.1.454.CMB.1.raw
  modified_base (355)..(355): a, c, t, g, unknown or other
  misc_feature (355)..(355): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagcctggggcctcagtgaaggtctcctgcaaggcttctggatacaccttcaccaattatgatatcaactgggtgcgacaggccactggacaagggcttgagtggagtgggatggatgaaccctaacagtaataacacaggactatcgcaanagaagttccagggcaggagtcaccgttgaccaaggaacacctaccaactaaacccacaacgacctacagtggacgctagacgacagcctgagtatcgtaggacggacgaccgggtccgttagttaacgtttaccgtggtacggaccggaaggtaacgggtacctaaggttcccttaaagttacggaaccgtaagggttacgggaccgtttacgggtaaccgtaacggtttaccccggggg

SEQ ID NO: 67593 - DNA, 717 bp, Homo sapiens
  misc_feature: GYAE6OF01CH1V9.37.37.D04.1.454.CMB.1.raw
  modified_base (204)..(204): a, c, t, g, unknown or other
  misc_feature (204)..(204): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcagaaacctggccaggcctccgaggcctcctcactctagttcggttactactcccgtacgaacgggccctacgtcgggacctacgtaccccccgaacgtacgggttaccgaggttcgggttcgggttacggggtcgtacggggaacctacggtacctttcgaccttccgtacaacccgtataccgaagctaaggtaccgttaacggacggaaccgggtaaagaccttcgtacgcgtaggttcgtttaactttccgtaggttaccagtaccgtaaggttagtcgggtaccgtacgtcctacccgtacccgttacccgggtaaccgggtttcccgggaacccggtaaacggggtaacccgtaaagggggtaacggtaaaacgtacccgtaaaaaccggtaacgttgggtaccggtaccgtagtaccctaccctaagttcccgttggttccttacccg

SEQ ID NO: 67594 - DNA, 250 bp, Homo sapiens
  misc_feature: GYAE6OF01DVXKP.37.37.D04.1.454.CMB.1.raw
  modified_base (245)..(250): a, c, t, g, unknown or other
  misc_feature (245)..(250): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctgcaccctcctccaagagcacctctggggcacagcggccctgggctgcctggtcaaggactacttccatctacactactgagcgggctggcaaggcgcatagnnnnnn

SEQ ID NO: 67595 - DNA, 591 bp, Homo sapiens
  misc_feature: GYAE6OF01CG55Q.37.37.D04.1.454.CMB.1.raw
  modified_base (418)..(418): a, c, t, g, unknown or other
  misc_feature (418)..(418): n is a, c, g, or t
  modified_base (450)..(450): a, c, t, g, unknown or other
  misc_feature (450)..(450): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagctaattatggtatcaacgtgggtgcgacgacggcccctaggacaaggccagtgaggtggagtgggattgggactcgagcggtacttaacaaataaactaacacaacaactatgacacagtaacgttaccgagggacaggacgtaccaccctagaccaanagactacatcccacgacgacacgacgacctangtaggagcgtggagacgcctaggacgtacgtcgacggacgacgtacgggtccgtttagtttacgtgacggtaggacgtaagaagtacgaagtttacttaggttaacgtcggtaacgtacgggtcgggaccgtaacccgggg

SEQ ID NO: 67596 - DNA, 907 bp, Homo sapiens
  misc_feature: GYAE6OF01C2OP9.37.37.D04.1.454.CMB.1.raw
  modified_base (804)..(804): a, c, t, g, unknown or other
  misc_feature (804)..(804): n is a, c, g, or t
tcagtagtgtagatcacgaccggtgctcgatttagtagcatactgttgggtttgggacccaaaaccgacaccctccttgggtagaatccctagatcacgagcgtcctcaccgatggactggacctggagcactcctttctggtggcagcaggctaaccaggtgtccccacgtcttcctagggttcctagtctggtgcgagtccgttgggacgtcctaggaggtagaaggaacgccgtggggccctaccgagtcgtaagggttcctccgtcgacgaaggtcttcgtaggtactacctttagcctaaatttgtaggtagtactaaacgttacggggttgaccgaaccaagggtcccccttagggtaaccgtaaaggggtccctaagttacggaaggttcggggaccgttagggggactttcggggaaccttcgtaacggttccgggtactttaaaccgtaaaagttaaaacttaaaaccgaacgtaaaccttaaaccgttaaacgttccgggacccttaaaccgtaagggtaaaaccggttttcccccgaacgggggtaccggtaacggtaacggtttacccctaaccccgtttgggaaccccctaaaccgtaaccgggtaaacctttaaaccggaaccgttaaccccgaacgggtaacgacccgttaaccgaaccgggtaccccttaaacgtacgtacggggaccgtaccgttacgggaacggtacggtacccgtagggtaacggtagttaccgtaggtaacccgtaacggttaccgggtaccgtttaaggtttttaacccgggnggttaccggaacgggtaaacggtaagttaacggtaaagttaacgttaggttacgggtaaacgggtacgggtaacgtaacgggtccggggtacccgtaaacggg

SEQ ID NO: 67597 - DNA, 612 bp, Homo sapiens
  misc_feature: GYAE6OF01CQS02.37.37.D04.1.454.CMB.1.raw
  modified_base (335)..(335): a, c, t, g, unknown or other
  misc_feature (335)..(335): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtgggcctcagtgaaggtctctgcaaggtcttctggttatacctttagactaattatggtatcaacgtgggtgcgacaggcccctggacaaggccatgagtggatgggatggatcgagcgacttaanaaataataacacactaactatacgacaactacggtaacgttccgagggacaaggtacgtccaacccgttacgaaccctaacacgtactaacgactacccaacggacaccacacgacctaacagtaggacgcgtaggacgggacgaccgtagacgtacgtcgtacgaacgaccgtaccgggtccgttttaggtttacgtggtaggacggtagagttaacagttaacttaagttagtaacggtacggtaacgtacgggtccggggtacgtaacccgggg

SEQ ID NO: 67598 - DNA, 273 bp, Homo sapiens
  misc_feature: GYAE6OF01BJKBD.37.37.D04.1.454.CMB.1.raw
  modified_base (247)..(273): a, c, t, g, unknown or other
  misc_feature (247)..(273): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnnnnnnnnnnnnnnnnnnnnn

SEQ ID NO: 67599 - DNA, 671 bp, Homo sapiens
  misc_feature: GYAE6OF01E22H2.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaaggaagccgtggggcctcgagtgaaggtctccgtgacgaaggtcttcgtaggttactaccttttagctaattagtggtatcaacgtgggtgcgacacggcccctggacaaggccagtggagtggagtggggatggactcgacgctacttaacgaataaactaacgacaacgtactagtcgacacaagtaacgttacgaggacagtacgtccacctacgaaccacgaagtactaacactaccgaacgacgacaacgacgaccgtaacagtggacgcgtaggaacggtacgtccgtaggaacgtacgtacgtacggaaccgtaaccggtaccggttacccggttttgtttaaccgtgggtacggacgggtaacggtaaggtaaaccgtaagttaaacgttaggtttaaacggttaaggttacggttaacccgggttaaccgggttacgggggaacccggtaaacccgggg

SEQ ID NO: 67600 - DNA, 555 bp, Homo sapiens
  misc_feature: GYAE6OF01B8XV6.37.37.D04.1.454.CMB.1.raw
  modified_base (331)..(331): a, c, t, g, unknown or other
  misc_feature (331)..(331): n is a, c, g, or t
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatgggatcagcgcttanaataataacacacactatgcaacagaagttcgagggcagagtcacccgtgaccanagatacatccacgagcacacgcctagatggancgtagnggacgcgtagagatctaggacgacgaccggtccgttggtttaacgtgtcggcgtaaggtaggttaacaaggtaagttaacttaggttaaacgtcgggtaacgtaacggttgggggacccgtaaaccggggg

SEQ ID NO: 67601 - DNA, 301 bp, Homo sapiens
  misc_feature: GYAE6OF01CTJDG.37.37.D04.1.454.CMB.1.raw
  modified_base (275)..(275): a, c, t, g, unknown or other
  misc_feature (275)..(275): n is a, c, g, or t
  modified_base (278)..(301): a, c, t, g, unknown or other
  misc_feature (278)..(301): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtccttcccccgtggccaccctcctccaagagccaccgtcgtcgggggcacgaggccggcccgtggggcctggcccttagggtacaaggtactaccttccatctacgactacgtggacggccgggctcggacaagggctacanagnnnnnnnnnnnnnnnnnnnnnnnn

SEQ ID NO: 67602 - DNA, 534 bp, Homo sapiens
  misc_feature: GYAE6OF01DF70R.37.37.D04.1.454.CMB.1.raw
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (467)..(467): a, c, t, g, unknown or other
  misc_feature (467)..(467): n is a, c, g, or t
tcagtagtgtagatcacgaccggtgctcgatttagtagcatactggttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcaggtgaaggtctcctgcaaggcttctggttatacctttagcaattntggtatacaactgggtncgacacggccctggacaaggccatgagtggatgggatggatcagcgcttaacaataataacacacactatgacacagaagttccagggcagagtcaccctgaaccacagatacatccagagcacagcctacagtgancgtgagngcctagagatcgtagacgtacgacggtcgttcgtttaacgngttagcgtaagagtacgaagtaaatagttagtaattagggacttaacggtggggcccgtaaccgggg

SEQ ID NO: 67603 - DNA, 510 bp, Homo sapiens
  misc_feature: GYAE6OF01EOCTI.37.37.D04.1.454.CMB.1.raw
  modified_base (308)..(308): a, c, t, g, unknown or other
  misc_feature (308)..(308): n is a, c, g, or t
  modified_base (419)..(419): a, c, t, g, unknown or other
  misc_feature (419)..(419): n is a, c, g, or t
tcagtagtgtagatcacgaccggtgctcgatttagtagcatactgttggggtttgggggaggaactgctcagttaggacccagacggaaccatggaagccccagcgtcagcttctcttcctcctgctactctggctcccagataccaccggcagaaattgtgttgacacagtctccagccaccctgtctttgtctccgaggggagagagccaccctctcctgcagggccagtcagaatgttagcagtcattagcctggtacacagagacctggccaggcccaggctcctcatctatgctgcttcctcngggccactggcatccagccaggttcagtgcagtggtctgagacagcttcgactctcaccatcagcagtctagagcctagaagtattttagctacgtttatatctgtacaanagcgtacacaccgtggtcggaccttcggaccgagggacctaaggtcgactttccgtacgtactggtcgctgcctaccatctcgtctctacc

SEQ ID NO: 67604 - DNA, 741 bp, Homo sapiens
  misc_feature: GYAE6OF01BROO7.37.37.D04.1.454.CMB.1.raw
  modified_base (321)..(321): a, c, t, g, unknown or other
  misc_feature (321)..(321): n is a, c, g, or t
tcagtagtgtagatcacgaccggtgctcgatttagtagcatactgttgggtttgggggacccaaaaccgacaccccgtccttgggacgaatcccctaggatccacagctcctcaccagtggactggacctggagcatcctttcctggtggaccagcgagtcgaacaggtgcccacgttctcgtaggttcagtacgtggtcgctagtctggagctggaggtggaaggaagccggtgggccttgacgtggacgggtcctccgtagcaaggtcttcgtggttactaccgtttagctaagttagtcggtaatctaacgtggggtnacgtacgacggtccccttaggaccgaagggcccagtcggtaggtcgggacgtagggattgggattcgagtcggtaccttaagaaagtaaactaacgacgactaacgtagcgacaacgtaagaacgttccgaggcgaagtacgtaccaccgtacgaacctacgaacgtactaacgacgtacgaacgagtaccgaaccgtacgacctaacgacgtacggacgtcgttacgggacgacgtaccgtaaggaacgtacgtaccgtaacgggaaaccgtacggtacccggtaccggtttacgttttaacgtcggttacggacggtaacgtaacggtaacgtaaacgtaactttaaccggtttaacggttaaggtttaccgggttaacgtttaacccgggtgggggttaccccggtaaaacccgggg

SEQ ID NO: 67605 - DNA, 663 bp, Homo sapiens
  misc_feature: GYAE6OF01C0FN6.37.37.D04.1.454.CMB.1.raw
  modified_base (404)..(404): a, c, t, g, unknown or other
  misc_feature (404)..(404): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggcccctggacaaggccatgagtggatgggatggatcagcgcttaacaataataacacacactatgacacagaacgttccagggcaagacgtcaccctgaccacagatacatccacgancacagcctacgagtggacgcgtaggacggacgtcctaggaacgtacgtaccgtacggaacccggtaaccggtaccggggttcccgttttacggtttttaaccgtacggggttaggacccgggtaaacggtaacggttaaacccggtaaagggttaaaacgttttaacgggttttaacgggttaaaacgtttaaccggggttaaacccggtttaaccgggttaccggggggggtaaaccccgttaaaaccccgggggggg

SEQ ID NO: 67606 - DNA, 547 bp, Homo sapiens
  misc_feature: GYAE6OF01BB9B1.37.37.D04.1.454.CMB.1.raw
  modified_base (331)..(331): a, c, t, g, unknown or other
  misc_feature (331)..(331): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcgagcgcttanaataataacacacactatgacacagaagttcaggcagagtcacctgacacagatacataccgagacgacacacgacctacagtcggagcgtagaggacgcctaggacgatcgtagaaccgacgacgggtccgttggtttactgtaggacgtagtagtaaccgtagtaacttagttagtaaagtagggaacctacgggtcggggccgtaaaccgggg

SEQ ID NO: 67607 - DNA, 622 bp, Homo sapiens
  misc_feature: GYAE6OF01DN1AN.37.37.D04.1.454.CMB.1.raw
tcagtagtgtagatcacgaccggtgctcgatttagtagcatactgttgggtttggggacccaaaaaccacaccctccttgggagaatcccctagatcacagctcctcaccatggactggacctggagcatccttttcctggtggcagcagcaacaggtgcccactctcaggttcagctggtgcagtctggagctggaggtgaagaagcctggggcctcagtgaaggtctcctgcaaggtcttttggtatacctttagctaattatggtatcaactgggtgcgacacggcccctggacacggccagtgagtggatgggatggatcgagcgtactaacaataataacacacactatagacaacagtaacgttccgaagggcagtacgtactaccctagaccaacagactaacctactacccgaacgtacgaccaacgacgtaccctaacacgtagggacgtcgtagggacggacgtccgtaggagtacgttccgtacggaaccggtaccggtaccgggttccggtttagttttaccgtggtccggacgtaggtaacgtaacgtaggtaaacttagttagtaaagttcgggaacttagggtacggggaccggtacgggtaacccg

SEQ ID NO: 67608 - DNA, 556 bp, Homo sapiens
  misc_feature: GYAE6OF01EW4FC.37.37.D04.1.454.CMB.1.raw
  modified_base (284)..(284): a, c, t, g, unknown or other
  misc_feature (284)..(284): n is a, c, g, or t
  modified_base (407)..(407): a, c, t, g, unknown or other
  misc_feature (407)..(407): n is a, c, g, or t
  modified_base (423)..(423): a, c, t, g, unknown or other
  misc_feature (423)..(423): n is a, c, g, or t
  modified_base (444)..(444): a, c, t, g, unknown or other
  misc_feature (444)..(444): n is a, c, g, or t
  modified_base (493)..(493): a, c, t, g, unknown or other
  misc_feature (493)..(493): n is a, c, g, or t
  modified_base (541)..(541): a, c, t, g, unknown or other
  misc_feature (541)..(541): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgaggtgaaggtctctgcaaggcttcgtggttatacctttagctaatttatggtatcaactgggtncgacacggccccgtggacaaggccagtgagtggagtgggatggatcgagcgtacttaacaattaacaacaacacactatcgacacgagtaacgttcgagggcagtacgtcacctgaccacganactacactccacgacncgacacgacctacagtggacncgtaggagagcctagacgtatcgacgacgacgtacgggtcttgtttacnggtgcgtagtaacgttcgaagtattagtagtaacgtcggtaactcggngggtccgtaaccggg

SEQ ID NO: 67609 - DNA, 668 bp, Homo sapiens
  misc_feature: GYAE6OF01D08EJ.37.37.D04.1.454.CMB.1.raw
  modified_base (371)..(371): a, c, t, g, unknown or other
  misc_feature (371)..(371): n is a, c, g, or t
tcagtagtgtagatcacgaccggtgctcgatttagtagcatactgttgggtttggggacccaaaaccacacccctccttgggagaatcccctagatcacagctcctcaccatggactggacctggagcattccttttccgtggtggcagcagcaacaggtcgcccactctcaggttcagctggtgcagtctggagcgtggaggtagaaggaacgccgtggggcctcgagtggtaacggtctccgtgacaaggtcttcgtggttacttaccttagctaattagtggtatcgaacggtgggtcgacgacgacggtccccgtaggaacgtaacggccagtggaggtggagtgggagtggatcgagctacttaanaataactaacacactatatcgacgactaagtacgtccgagggacagtacgtccaccgtacgaactacgagtaacgtacacgtaccgacgtaacacgtaacacgtaccgtagaggtacgacgtcgtaggaaggacgtaccgtaggacgtactaccggtaaggacccggtaacggttaccgggttacgtttagtttaccggtcgtacggacggtaaggtaagtacgtaaagttaacgtttagggtaacgtaacgggtacgttaaaccggtacggggtcgggaacccggttaaaccgggg

SEQ ID NO: 67610 - DNA, 716 bp, Homo sapiens
  misc_feature: GYAE6OF01EBZDE.37.37.D04.1.454.CMB.1.raw
  modified_base (366)..(366): a, c, t, g, unknown or other
  misc_feature (366)..(366): n is a, c, g, or t
tcagtagtgtagatcacgaccggtgctcgatttagtagcatactgttgggtttgggggacccaaaaaccacacccctccttgggagaatcccctagatcacagctcctcaccatggactggacctggagcatccttttcctggtggcagcagcaacagggtgcccactctcaggttcagctggtgcagtctggagctggaggtggaacgaacgccgtggggcctcaggtggaaggttctccgtgacgaacggtcttcgtggttatacctttagactaattatggtatcaacgtgggtgcgacgacggcccctagggaccaaggccagtggaggtggatgggatggatcgagcgacttaacaataanaacacacactatcgacacgaagaagttccgagggtacaggtacgtaccacccgtagaacccaagtacgaacttaaccgacgttacccaaacgggtacgaccgtaacgacggtaccccttaagtacgttacgggaacgtaccgttagggaacgggtacgcccgttaaggacgtacgttaccgtagggaaccccgtaacggtaccccggggttccgtttaacggtttttaccgacgggttacgtacgggggtaacgtaaggttaaaccgaaggttaaaactttaaggttagggttaaaacgtcggggttaaacccttaccggggttgggggaaccccggttaaacccggggg

SEQ ID NO: 67611 - DNA, 551 bp, Homo sapiens
  misc_feature: GYAE6OF01CFUGA.37.37.D04.1.454.CMB.1.raw
  modified_base (281)..(281): a, c, t, g, unknown or other
  misc_feature (281)..(281): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (421)..(421): a, c, t, g, unknown or other
  misc_feature (421)..(421): n is a, c, g, or t
  modified_base (479)..(479): a, c, t, g, unknown or other
  misc_feature (479)..(479): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcgagtgaaggtctcctgcaaggcttctggttatacctttagctaattatggtatcaactgggtncgacaggcccctggacaaggccatgagtggatgggatggatcgagcgacttacaataataacacacaactangacaanagaacgttcagggacagacgtcaccctgaccacagatacactccacgagcacacgcctaacntaggacgctaggaaggacgcctagaagattcaggacgacgacggtccgttgttttacngtggacgagtaagtaacgagtaaattagtttaggtaaagtacggtactaacggtgggggacctaaacggggg

SEQ ID NO: 67612 - DNA, 694 bp, Homo sapiens
  misc_feature: GYAE6OF01CJA91.37.37.D04.1.454.CMB.1.raw
  modified_base (202)..(202): a, c, t, g, unknown or other
  misc_feature (202)..(202): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgagggaangccaccctctcctgcagggccagtcagagtgttagcagcaacttagcctggtaccagcagaaacctggccaggcctcccaggcctcctcatctagtggtgcactccaaccgacgggccacgtcggtactcccgagccgtaggttcaggtcggctaggtgggtcgtagggactaggtacgttacaccgttcctaccgaacctagtaccgacggtaccacggtcccgtggacctaacggttccgtaaggtaaacggtttacgtttttacggacctttaaggttttttaactttccgttacggttaccgtaacggtacttaagtttaaacgtttaaacgttttacccggtcggttacccttacccggttaacgggttaccgggttaccggtttaccggaaccggtaaacgggtaacccgtaaaggggtacggtaaactaccgtaaaacggtacgttaggtacggtacctacggacctaaccgtagttccgttacg

SEQ ID NO: 67613 - DNA, 564 bp, Homo sapiens
  misc_feature: GYAE6OF01C2TEJ.37.37.D04.1.454.CMB.1.raw
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
  modified_base (519)..(519): a, c, t, g, unknown or other
  misc_feature (519)..(519): n is a, c, g, or t
  modified_base (536)..(536): a, c, t, g, unknown or other
  misc_feature (536)..(536): n is a, c, g, or t
tcagtagtgtagatcacgaccggtgctcgatttagtagcatactggttgggtttgggacccaaaaaccacacccctccttgggagaatcccctagatcacagctcctcaccatggactggacctggagcatccttttccgtggtggcaggcagcaaacaggtcgcccactctcgaggttcagctggtgcagtcgtggagctgaggtgaagagccgtgggcctgagtgaaggtctctgcgaggtcttctggttactactttagctaattatggtatacgaagtggtcgcgacgacggcccctggacaaggcagtgacgtgagtgggagtcggatgagtcgattaacaattaanaacacaacactangactacgaagtacgtccaaggacgtagagtaccacgtagaaccacgagactacagtaccacgacacacgtacncctanagtagcgtagngagacgtcaggntacgtcagaacgcgacggtcctttagttaccgngtaccggngtaacagttaancggttaatgttaaacgngttacgactacggtgggacgtaaccggg

SEQ ID NO: 67614 - DNA, 713 bp, Homo sapiens
  misc_feature: GYAE6OF01C00KP.37.37.D04.1.454.CMB.1.raw
  modified_base (205)..(205): a, c, t, g, unknown or other
  misc_feature (205)..(205): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctcctgcagggccagtcagagtgttagcagactaacttacggccttaggtacccaaggaccaacgaaaacccgtcgggacccacgggcctaccccgaaggtcctccctcattcctagtggtgaccaacgtcccaaccggacggggaccctaacgtacgggtacctaccccgacggcccgtaacgggtttccgaagggttcggggaccgtaaggggttcgggggtaccgttaggggggaacctaaggtacggtttaccaccttccgtaccaacccgtatacgaacgccaacggtccctgaccgtaggttacgtaggtaacttagtttttgactttacgttttattttcgtagttacaggtactaagttaattaacgttactcggtacccttcgttaaccggtgggtacccggtttaccggaccggaaagggtaccgtaaagggtacggaaataccgaaaacggtacgttggtacggtctacggaccaactgttcgtacg

SEQ ID NO: 67615 - DNA, 601 bp, Homo sapiens
  misc_feature: GYAE6OF01CGPAR.37.37.D04.1.454.CMB.1.raw
  modified_base (218)..(218): a, c, t, g, unknown or other
  misc_feature (218)..(218): n is a, c, g, or t
  modified_base (336)..(336): a, c, t, g, unknown or other
  misc_feature (336)..(336): n is a, c, g, or t
  modified_base (449)..(449): a, c, t, g, unknown or other
  misc_feature (449)..(449): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctnagtgaaggtctcctgcaaggcttctggttatacctttagctaattatggtatcaactgggtgcgacaggcccctggacaaaggccagtgagtggagtgggagtggatcagcgcttaanaataataacacaacaactatagacaacgaagtaacgttcgagggtacagacgtccacctgaccacagacgactactaccaacgagaccaacgacgaccctaacgagtgggacncgtagacgggacgtccgagaagtactcgtaggaacgtacccgacgggtcccgttaggttttaccgtaggttcggacggaacggtagtaccgtaagggtaaattagttaagttaagtacggtacgttacggtcggggtacggtaaacccgggg

SEQ ID NO: 67616 - DNA, 628 bp, Homo sapiens
  misc_feature: GYAE6OF01EQO1T.37.37.D04.1.454.CMB.1.raw
  modified_base (418)..(418): a, c, t, g, unknown or other
  misc_feature (418)..(418): n is a, c, g, or t
  modified_base (540)..(540): a, c, t, g, unknown or other
  misc_feature (540)..(540): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttcgtggttattaccttagctaattagtggtatacgaacgtgggtgcgacgacggcccctggacaggcctagtgagtggagtgggatggatcgagtcgtacttaacgaaataaactaacacaacactatcacacaagtaacgtaccgagggacagacgtccacccgtacaacccgtanaacgtataccgaactcccgaaggacaccaaccacgaccctaacgagtaggcgtacgaggtacgggactccgtaaggacgtactaccgacggaaccgacgtaccggttccgtttagtttacgnggtacgacggtaacgtagtactaaaggtaacttagttaacgtaaaggtcggtaaactacccgggtggggaaccccggtaaacccgggg

SEQ ID NO: 67617 - DNA, 261 bp, Homo sapiens
  misc_feature: GYAE6OF01CIBD0.37.37.D04.1.454.CMB.1.raw
  modified_base (245)..(261): a, c, t, g, unknown or other
  misc_feature (245)..(261): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctgctccaggagcacctccgagagcacagcggccctgggctgcctggtcaaggactactccatctacactactgagcggctggcaaggcgcatagnnnnnnnnnnnnnnnnn

SEQ ID NO: 67618 - DNA, 651 bp, Homo sapiens
  misc_feature: GYAE6OF01CQQM6.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaggtctcctgcaaggtcttcgtggttataccgttttagctaatttatggttatctaaacgtgggtcgcgacgacggcccctggacgaaggccagtggaggtggagtagggagtgggatcgagcgtacttacaaataataacacaacactatgacacagacgttcgaggacagactcaccctcgaaccacagaactacactacacgacgacacacgacctacgacgtaggactacgtggaagggacgacccgtaggaacgtaacgttccgacggaaccggtaccgtaccgggtacccggtttacggtttttaaccgcggttacggtacgggaacgttaacggtaaccggtaagtaaaagtttagtttaaggtttaacggtaacggttaccggttaaacgggtaccggggtaccgggtaaaaccccgggg

SEQ ID NO: 67619 - DNA, 655 bp, Homo sapiens
  misc_feature: GYAE6OF01DKK1P.37.37.D04.1.454.CMB.1.raw
  modified_base (417)..(417): a, c, t, g, unknown or other
  misc_feature (417)..(417): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtagaagagccgtggggcctcgagtgaaggtctcctgacaggcttcgtggttatacctttagctaattatggttatcaacgtgggtgcgacgacggcccctaggacaaggccatggaggtggagtgggatggatcgagcgtacttaacaaataaactaacacaactactaatcgacaacgagaacgttccgagggacaagacgtacaccctagaaccanacgactacactaccaacgacgaccacacgacctacagtaggacgtacgtaggaacgggcgaccctagggaagtacgttaccgtaggaaccggaccgtaccgggttaccggtttacgttttaacggtcggtacggaaccggtaaggtaacggttaacgtaaaggtaaacgtttaacgttaaggttaaacggtacgggtaaacggtttaccgggcgggggtaaccccgtaaaaccggggg

SEQ ID NO: 67620 - DNA, 674 bp, Homo sapiens
  misc_feature: GYAE6OF01DG2I7.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcgagtggaaggtcctctgacaaggtctttcgttggttaattaccttttagactaaatttagtaggttaatacgtaacgttggggtgacgacacgggtcccctaggacaaggccagtggaggtggagtgggagtggatcgagcgacttaacaataataacacaacactatcgacaacagtaacgtcgagggacaggacgtaccacctacgaaccaacacgaactaacactacccgaacgacgaccaaccgacgtacctaacgtacgtacggacggtacgtacgggacgggtacgtaccgtaggaacgtacgtccgtacggaaccgaacggtaccgggtaccgtttacgttttacgtcggtacggacggtaaagtaacggtaacgtaaagttaacgttaagttaacgttaaacgtacggtaaccggttacgggtccggggtaccggtaaacccgggg

SEQ ID NO: 67621 - DNA, 607 bp, Homo sapiens
  misc_feature: GYAE6OF01D88YG.37.37.D04.1.454.CMB.1.raw
  modified_base (205)..(205): a, c, t, g, unknown or other
  misc_feature (205)..(205): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagcagcaacttagcctggtaccagcaagaaacctggccaggcctcccgaggcctcctcatctagtggtcgcactccaccgagggcccacgtggtactcccagccgaggttcaggtggctaggtgggtctaggagacacgtacttcacttctacacctatcacgcagtacgtagacgtcctagtaagttacttttcgaccttaacttttactacttacgttagtaccaacgcggtaccgtaccaaccgtaccggttgggtaccggtaccgttaccggggaccgaaagggacccgtaagggttcggttaacgtttacccgaacgtacggttgtacgggtactcggacctaccgtattccttgtccttaccg

SEQ ID NO: 67622 - DNA, 598 bp, Homo sapiens
  misc_feature: GYAE6OF01A6FRP.37.37.D04.1.454.CMB.1.raw
  modified_base (534)..(534): a, c, t, g, unknown or other
  misc_feature (534)..(534): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagcctggggcctcagtgaaggtctcctgcaaggcttctggttatacctttagctaattatggtatacaacgtgggtgcgacacggcccctggacgaaggccatggaggtggagtgggatgggatcgagcgtacttaacaaataaactaacaacactaactatcgacaacgaaggtaacgttccgagggacaggtacgtaccgacccgtagaaccctaacgaacgtaactacaacgtacccgaacgacgaccaacacggtaccctaacgagtacggagcgtagggacgacgccgtagacgtactcgagacgacgtacgtccgttagtttcncgtgacgagtagacgagtaagttacgttagtacgtaggaacgtcggtcggggaccgtaaccggg

SEQ ID NO: 67623 - DNA, 256 bp, Homo sapiens
  misc_feature: GYAE6OF01C65CP.37.37.D04.1.454.CMB.1.raw
  modified_base (249)..(256): a, c, t, g, unknown or other
  misc_feature (249)..(256): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggccaccctcctccaagagcacctcgtgggggcacagcggccctgggctgcctggtcaaggactacttccatctacactactgagcggctggacaaggcgcatagnnnnnnnn

SEQ ID NO: 67624 - DNA, 588 bp, Homo sapiens
  misc_feature: GYAE6OF01EK9OI.37.37.D04.1.454.CMB.1.raw
  modified_base (280)..(280): a, c, t, g, unknown or other
  misc_feature (280)..(280): n is a, c, g, or t
  modified_base (509)..(509): a, c, t, g, unknown or other
  misc_feature (509)..(509): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagcctggggcctcagtgaaggtctcctgcaaggcttctggttatacctttagctaattatggtatcaacgtgggtncgacacggcccctggaccgaaggccagtggaggtggagtggggatggatcgagcgtacttaacaataaactaacacaacactatcgacaacgagtaacgttccgagggcagacgtccacctgaccacgagactacactccgaacgacacacacgacctaacgagtggactcgtaggacggacgtccagacgtatccgtaagaccgtaccgacgggtccgtttgtttacnggtacgacggtaacgtagtactaagtaagttacgttaggtaacgtacggtaacgtacgggtcgggaccgtaaaccgggg

SEQ ID NO: 67625 - DNA, 597 bp, Homo sapiens
  misc_feature: GYAE6OF01BMJLC.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaggccagtgagtggagtgggatggatcaggcgacttaacaataataacacacactatgcacagagtccgaggcagacgtacaccctgaccacagactacatcccaacgacacaacacgcctacgacgtaggacgtcgtaggagggacgccgtagacgacgttacgtagaacccggacgaccgggttcccggttacgtttttaccgtggttacggaccgtaaggtaacggtaacgaaggtaaacttagttaacggttaaagtacgggtaaccgttacggtcgggggtacccgtaaaccggggg

SEQ ID NO: 67626 - DNA, 691 bp, Homo sapiens
  misc_feature: GYAE6OF01EMAOV.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcgaggttcagctggtgcagtctggagctggaggtgaagaagccgtgggcctcgagtgaaggtctcctgcaggtcttcgtggttacttacctttagactaattagtaggtatcgaagttggggtcgacgacgacggtcccctaggaacgaaggccagtcggaggtggagtgggatggactcgaggtcgtacttaacaaataacgtaaccaacgactaactatacgacaagaacggtaacgttaccggaagggactaacggtactacctaacccgtagaaccaacgtaacgtaactaactaacgtaccgaacgtaacgaccaaccgacggtacctaacgacgtacgggactacgtaggacggacgcgtaagagtacgtcgtacggaccgtacgtaccgggttacgtttacggtttacgtggtacggtacgaagggttaacgtaacgtaaggttaaagttaaggtttacggtaaacgttacgggtaaccgttaacggggtcccggggtaaccggtaaaccccgggg

SEQ ID NO: 67627 - DNA, 601 bp, Homo sapiens
  misc_feature: GYAE6OF01EG5RT.37.37.D04.1.454.CMB.1.raw
  modified_base (403)..(403): a, c, t, g, unknown or other
  misc_feature (403)..(403): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacacggcccctggacaaggccatgagtggagtgggatggatcagcgcttaacaataataacacactactatcgacacgaagtaacgttccgagggcaagacgtaccacccgtagaacccanacgaactacactacccgacgacgcaacacgtacctaacagtcggagctagacgggacgcctgaacgtgtacgtacgaaccgacggtaaccggtccgtttaggttttaccgaggtcgacggtaaggaagttaacgaacggtaaattacgttacgtaaaggttcggaacgttacgggtcggggaacccgtaaaccggggg

SEQ ID NO: 67628 - DNA, 671 bp, Homo sapiens
  misc_feature: GYAE6OF01CQXI1.37.37.D04.1.454.CMB.1.raw
  modified_base (204)..(204): a, c, t, g, unknown or other
  misc_feature (204)..(204): n is a, c, g, or t
  modified_base (445)..(445): a, c, t, g, unknown or other
  misc_feature (445)..(445): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcacttagctggtaccagcagaaacctggaccaggctcccgaggcctcctcatctagtggtgcatcccacgacgggccacgtcggtactccccgagcctaggttcaggtcggacgtaggtgggtcgtgggactaggtcgtttcacctcctacacctatcgaacgccgaacgtccgtgaccgtagttaccgtaggtaaacgtttntttttgggaccttttaagtttttacttttcgttacgttacagttcgttaattaagttaacgttaccgtcgggtacccttaccgttaacgggtcgggttaacccgtttaccggggacccgtaaacggggtaaccggtaaacgggtaacggtaaaataacccggtaaaaacggtaccgttagggttacggtaccgtacggtaccctaaccctcggttcctttacccgg

SEQ ID NO: 67629 - DNA, 702 bp, Homo sapiens
  misc_feature: GYAE6OF01BWFXQ.37.37.D04.1.454.CMB.1.raw
  modified_base (297)..(297): a, c, t, g, unknown or other
  misc_feature (297)..(297): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgttactctggctcccagataccactggagaaatagtgatgacgcagtctccagccaccctgtctgtgtctccgaaggggaaagacgccaccctctccgtgcagggccagtcagagtgtagcagcaacttgcctggtaccagcaagaacctgacccaggcctcccgaggcctcctnatgtatggtcgctactccaccgcgggaccacgtcgggtactcccgagccgtaggttccaggtcgcgagggtcgggacgtggggaactaggtacgttcgaacgttacctaaaccagttacgacggaccacgtccctacggacctaggtccgtaaggtaacgtttagtttttaggggtatttttaacgtttctacggttacaggttacttaaggtttacgttacggtttccgtacggggtcccgttagggtacccggtttccgggacccggtaacggggtaaccgtaagggtaacggtaaaactaccggtaaaaaccgtacggttcgggtccgggacttacgggaccctaacgttccgttccgttacggtttaccccttaccgttaaccgttccccgttacccccgg

SEQ ID NO: 67630 - DNA, 282 bp, Homo sapiens
  misc_feature: GYAE6OF01CW8V4.37.37.D04.1.454.CMB.1.raw
  modified_base (254)..(282): a, c, t, g, unknown or other
  misc_feature (254)..(282): n is a, c, g, or t
tcagtagtgtagatcacgaccggtgctcgatttagtagcatactgttggggtttgggtgcccaagctgctggagggcacggtcaccacgcctgctgagggagtagagtcctgaggactgtaggacagcccatcggtccttccccctggcaccctcctccaagagcacctcgtgggggcacacgccggccctgggctgcctggtcaaggactacttccatctacactactgagcgggctggcaaggcgcagtagnnnnnnnnnnnnnnnnnnnnnnnnnnnnn

SEQ ID NO: 67631 - DNA, 557 bp, Homo sapiens
  misc_feature: GYAE6OF01EXN2Y.37.37.D04.1.454.CMB.1.raw
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggcccctggacaaggccatgagtggagtgggatgggatcgagcgcttacaataatacacacactatgcacagaagttcgagggcagagtcacctgaccacaganacactccacgancacagcctanagtggacncgtaggaggacgccgtagacgatcgtagaccgacgacgggtccgtttaggttttaccgtgtcggtacggaacggtagtacgaagtaaattagttaggtaaagtcggtaaccgttacggtcgggggcccgtaaacgggg

SEQ ID NO: 67632 - DNA, 613 bp, Homo sapiens
  misc_feature: GYAE6OF01A6NNW.37.37.D04.1.454.CMB.1.raw
  modified_base (362)..(362): a, c, t, g, unknown or other
  misc_feature (362)..(362): n is a, c, g, or t
  modified_base (473)..(473): a, c, t, g, unknown or other
  misc_feature (473)..(473): n is a, c, g, or t
  modified_base (588)..(588): a, c, t, g, unknown or other
  misc_feature (588)..(588): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtccgtgtctccgaggggaagagccaccctctcctgcacgggccagtcagagtgttagcagcaacttagccgtggtaccagcaagaaaccctggaccaggcctcccgaggcctcctcatctagtggtcgcacgtcccaccgacgggccacgtgtactcccagtccaggttcaggtggacngggtcggtctgggactaggtacgttcacgttcaccacactgacgcacggtcctggactacgttctaggtaacgttattttcgactttaacttttacttacgtgtacgtacngtaaacttagttaaccgtacgtccgggtaccccgggtagttccggaaccggaacggacgtaagggagtaaacgtaaacctaacggtaacgttggacggtctaagacctacccgtnttacttgtacgttcctgttaccccg

SEQ ID NO: 67633 - DNA, 735 bp, Homo sapiens
  misc_feature: GYAE6OF01AYTOD.37.37.D04.1.454.CMB.1.raw
  modified_base (342)..(342): a, c, t, g, unknown or other
  misc_feature (342)..(342): n is a, c, g, or t
  modified_base (603)..(603): a, c, t, g, unknown or other
  misc_feature (603)..(603): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttcgtggttatacctttagctaattatggtatcgaactgggtgcgtacgacggccccgtggacaaggccagtggagtggagtgggatggatcagcgacttanaataactaacacacactatcgactacgaacgtaacggttaccgagggactaacggtacgttacccgaacccgttacgaaccctaacgtaacgtaaccgtaaacctaacgttacccgaaacggtaacgacccgaaccgaaccgtaccctaaacgaacgtacgggtaacgaccgtagggaacgggtaaccgaccgttaaggaacgtacgttcgtaacgggaaccggtaccgtacccgggtaccgttttacggtttttaaccgngggttaccggaaccggtaacggtaagttaaccggtaaacgttaaaaggtttacggtttaacggttaaaacggttacggggttaaaacccgttcggggttaaccggggggaacccgttaaaacccccgggggg

SEQ ID NO: 67634 - DNA, 512 bp, Homo sapiens
  misc_feature: GYAE6OF01BQIKM.37.37.D04.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
  modified_base (491)..(491): a, c, t, g, unknown or other
  misc_feature (491)..(491): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttagcagcaacttagcctggtaccagcagaaacctggccaggctccaggctcctcatctatggtgcatccaccagggccactggtactcccagccaggttcagtgcagtgggctgggacaggagttcactctcacatcagcagccctgcagtctagaagtnttttcgactactttatactgtcagcagtaataatacgtcgggaccccgtagttccgacaagggacgaaggtagaataccgaaacgtactgtggcngacactatctgttctctaccg

SEQ ID NO: 67635 - DNA, 605 bp, Homo sapiens
  misc_feature: GYAE6OF01D5KPG.37.37.D04.1.454.CMB.1.raw
  modified_base (364)..(364): a, c, t, g, unknown or other
  misc_feature (364)..(364): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggttatacctttagctaattatggtatcgaacgtgggtgcgacgacggcccctggacaaggccagtggaggtggagtgggatgggatcgagcgtacttaacaataataacacacactancgacaacacgtaagtccgagggcaagtacgtccaccctagaccacgagaactacacgtacccaacgacgacaacacgacctaacgagtaggactcgtagagggacgcgtagacgtactcgtagaccgacgtaccgggttcgtttagtttacgtggtacgacggaacgtagtaacgtaagtaagtttagttaagtaacggttacggtaaccggttacgggcggggtacccgtaaacccgggg

SEQ ID NO: 67636 - DNA, 693 bp, Homo sapiens
  misc_feature: GYAE6OF01A9PF2.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggtcttgttggttattacctttagactaagtttatggttatcaacgtggggttgcggacgacggccccgtggacaaggccagtgagtggagtgggatggatcgagtcgtacttaacaataactaacacacatagtcgacaactaggaacgttccgagggcaaggacgtacccacccgtacgaacccacgaacacgtaacactaccgaaccggacgccaacgaccgtcctaacgtacggtaggacgacgtacggaagggtacgaccgtagtacgtacgttaccgtacggaaccgaccggtacccggttacggttttaccgttttacggtggttaaccggtacggtaacggtaaagttaaaccggttaagtaaagttttaaccggtttaaggttaaacgggttacggtaaaccggttaccggggttaaccgggggtaacccgggtaaaccccggggg

SEQ ID NO: 67637 - DNA, 627 bp, Homo sapiens
  misc_feature: GYAE6OF01E5J7J.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtctggagctgaggtgaagagccgtggggcctcagtgaaggtctctgcaaggcttcgtggttattacctttagctaattatggtatcaacgtgggtgcgacacggcccctggacaaggccagtgagtggagtgggatggatcgagcgtacttaacgaaataaactaacaaccaactaactatgaccaacgtaagtaacgttccgaaggggacaaggacgtaccacccgtagacccacaagactacactccaacgaacgcaacgacgtacctaacgagtaggacgacgtaggagggacgcctaggacgtacgtacgtacggaaccgacgtaccgggtaccgtttaggttttaccgtggtacgacgggtagaaggtacgaagttaaattagtttaacgtaacgtacgggtaaccgttacgggtcggggacccggtaaccgggg

SEQ ID NO: 67638 - DNA, 686 bp, Homo sapiens
  misc_feature: GYAE6OF01DT27S.37.37.D04.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (463)..(463): a, c, t, g, unknown or other
  misc_feature (463)..(463): n is a, c, g, or t
tcagtagtgtagatcacgaccggtgctcgatttagtagcatactgttgggtttgggggaggaactgctcagttaggacccagagggaaccatggaagccccagctcagcttctcttcctcctgctactctggctcccagatacccaccgcagaaattgtgttgacacagtctccagccaccctgtctgtgtctccgaggggaaanagccaccctctcctgcagggccagtcagagtgttagcagctaacttagcctaggtaccagacaagaaaccctggacccaggcctcccaggcctcctnactctatggtcgctatcccaccgtacgggccctaacgtcgggtactccccgaagtcccgtaggttccaggtcggactagggtgggtcgtggggactaggtacgttcacttccgtacacccatccgagccacggtcctgacctaggttctaggtaacgtttnttttcggactttaggtttttactttcgtgttacacgtacgttaagtttaacttaacgtttaccgtccgggttacccttaccggttacggtttacgggtaccggtttacccggggaacccgtaaacggggtacccgtaaaggggttaacgtaaaacgttaaccggaaaacggtaacgttgggtacggccgttacggaccctaccgtacgttccgttcgttaccc

SEQ ID NO: 67639 - DNA, 254 bp, Homo sapiens
  misc_feature: GYAE6OF01AB1R7.37.37.D04.1.454.CMB.1.raw
  modified_base (247)..(254): a, c, t, g, unknown or other
  misc_feature (247)..(254): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctcgtggggcacagcggccctgggctgcctggtcaaggactacttccatctacactactgagcgggctggcaaggcgcatagnnnnnnnn

SEQ ID NO: 67640 - DNA, 656 bp, Homo sapiens
  misc_feature: GYAE6OF01C4EPB.37.37.D04.1.454.CMB.1.raw
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
  modified_base (577)..(577): a, c, t, g, unknown or other
  misc_feature (577)..(577): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagcgtggaggtagaaagaaggccgtggggcctcgaggtgaaggtctccgtgacaaggtctttcgtaggtttaacttaccgttttagactaaatttagtggttaatcgtaacgtgggtagacgacgacggccccgtaggaacgaaggccagtggagtggagtgggatggatcgagcgtacttaaanaaattaaanaaccacaactaactanagacaanaggaacgttcgaggacaaggtactaccgaacctagaacccaacgaagtaactaacgaactcccgaaacgaacgacaacgacgtacctaacgagtagacgtcgtaggacggacgtccgaagacgtataccgtacgaacgaccggtacggttcccgttagttttaaccggnggtacgagtaacgtaagtaacgtaagtaagttagttaaggtaacgtacggtaacgtacgggtacggtaccggtaacggg

SEQ ID NO: 67641 - DNA, 654 bp, Homo sapiens
  misc_feature: GYAE6OF01BUIP6.37.37.D04.1.454.CMB.1.raw
  modified_base (378)..(378): a, c, t, g, unknown or other
  misc_feature (378)..(378): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtagaagaagccgtggggcctgagtgaaggtctcctgacaaggtcttcgtggtttactaccttttagactaattagtggtatacaacgtgggtgcgacgacggccccgtggacaaggccagtgaggtggagtgggagtggatcgacgcgtacttaacaataaactaacacaacactagngacacgaagtaacgtaccgagggacaagtacgtaccaccgtacgaccaacgaagactacactacccgaagtacgacaacgacgacctacgagtggacgtcgtaggtacgacgtaccgtaggagtacgtcgtaacggtaaccggtaaccgtaccgggtccggttttacgtttacgtcggttacgggacgtaaacggtaacgtaacggtaaagttaaccgttaagtttaacggtaagttacgggtaacgtaacgggtcgggggacccgtaaaccgggg

SEQ ID NO: 67642 - DNA, 617 bp, Homo sapiens
  misc_feature: GYAE6OF01BPB3W.37.37.D04.1.454.CMB.1.raw
  modified_base (546)..(546): a, c, t, g, unknown or other
  misc_feature (546)..(546): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttataccttagctaattagtggtatcaacgtgggtgcgacgacggcccctggacaaggccagtggagtggagtgggatggatcgagcgtacttaacgaataaataaccacaacactatcgacaacaaggtaaacgttccgaagggtaccaaggtacggttacccaacccgttacgaacccaacgtaacgaactaaccactacccaacgacgacaaccgacgacctaacgagtacgggacgcgtaggacggtacgccgtagacgagtcgacggaccgacgaccgggtccgttagtttacgnggtagacggagtagtaacgaagtaagtagttagttaagtacgtaacgtacggtcggggaccgtaaaccggg

SEQ ID NO: 67643 - DNA, 657 bp, Homo sapiens
  misc_feature: GYAE6OF01DG2JW.37.37.D04.1.454.CMB.1.raw
tcagtagtgtagatcacgaccggtgctcgatttagtagcatactgttgggttggggacccaaaaaccacacccctccttgggagaatcccctagatcacagctcctcaccatggacgtggacctggagcatccttttcctggtggcagcagcaacaggtgcccactctcaggttcagctggtgcagtctggagctgaggtgaagagcctgggcctcagtgaaggtctctgcaggtcttcgtggttactacctttagctaattataggtactcgtaacgttgggtcgcgacgacggtccccgtgggacgaacggcccaagttcggacggtacggagtgggatgggatcgaggcggacttaacgaattaaagtaacacgtaacacttacgtggaccaaagtacggaagtttacccgaggggtaccgaacggaacgttcccgaacccgttcgaacccaacgacgaactaacgtactacccgaacgacgactaacgacgtcctaacgtagaggacgtcgtaggacggacgtaccgtaggacgacgttcgtaggaccgtacgtacggtccgtttacgttttacgcggttcgacggtaagagttaacgaagtaagttagttacggtaagtacggtacgtacggtcggggtaccgtaaccgggg

SEQ ID NO: 67644 - DNA, 622 bp, Homo sapiens
  misc_feature: GYAE6OF01BR8K9.37.37.D04.1.454.CMB.1.raw
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
  modified_base (475)..(475): a, c, t, g, unknown or other
  misc_feature (475)..(475): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttataccttagctaattatggtatcaacgtgggtgcgacgacggcccctggacgaaggccatggaggtggagtgggatggatcgagtcgtacttaacgaataaataaccacaactactatcgacaacgaagtaacgttaccgaggggacaagtacgtaccacccgtacgaaccacaaagtactaacacgtacccgacggaacnccaaccncgaaccctacgatacgggngtcgtaggaggaccgcgtagactactcggtacgaccgtacgtaccggtcgtttagtttaccgtgtagaccggtagtaagtacgaagttaaattaagttaggttaacgtacgggtaacctaccgggttacgggacccggtaaccgggg

SEQ ID NO: 67645 - DNA, 614 bp, Homo sapiens
  misc_feature: GYAE6OF01DJF5D.37.37.D04.1.454.CMB.1.raw
  modified_base (220)..(220): a, c, t, g, unknown or other
  misc_feature (220)..(220): n is a, c, g, or t
  modified_base (537)..(537): a, c, t, g, unknown or other
  misc_feature (537)..(537): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctnagtgaaggtctctgcaggcttcgtggttactacctttagctaattatggtatcaacgtgggtgcgacacggcccctggacaaggccagtgagtggagtgggatggatcgagcgtcttaacaataataacacactactatcgacaacgagtaacgttccgaggggtacaaggtacgtaccgacccgttagaacccaacgaacgtaactaacactacccgaacgaacgaccaacgacgtaccctaacgagtaggacgtcgtaggacgggagccgtaggacgtacgtcgtacgacgacgtaccggtcgttagttttacgnggtacgacgtaagtagtaacgtaagtaattattaggttaacgtacggtacgttacgggcggggaccgtaaaccgggg

SEQ ID NO: 67646 - DNA, 272 bp, Homo sapiens
  misc_feature: GYAE6OF01AO0GR.37.37.D04.1.454.CMB.1.raw
  modified_base (241)..(241): a, c, t, g, unknown or other
  misc_feature (241)..(241): n is a, c, g, or t
  modified_base (247)..(272): a, c, t, g, unknown or other
  misc_feature (247)..(272): n is a, c, g, or t
tcagtagtgtagatcacgaccggtgctcgatttagtagcatactgttgggtttgggtgcccaagctgctggagggcacggtcaccacgcctgctgagggagtagagtcctgaggactgtaggacagcccatcggtcttcccctggcaccctctccaagagcacctctggggcacagcggcctgggctgcctggtcaaggtactacttccatctacactactgagcgggactggcaaggcgntatagnnnnnnnnnnnnnnnnnnnnnnnnnn

SEQ ID NO: 67647 - DNA, 672 bp, Homo sapiens
  misc_feature: GYAE6OF01BILT3.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacgtgggtgcgacacggcccctggacaaggccagtgagtggagtgggatggatcgagcgtacttaacaataaactaacaacaacaactatcgacaacaagtaacgttccgagggacaaggacgtaccacccgtacgaacccaacaacgactaacactacccaacgacgaccaacgacgaccctacgagtaggacgcgtaggaagggacgccgtaggaacgtacgtccgtacggaaccgaaccggtacccgggtaccggttttacggttttaccggtcgggttacggtaccgggtaaggttaacggttaacgtaaaggttaaactttaacggtttaaggttaaacggttacggggtaaaccttaccggggttaccgggggtaccccggtaaacccgggggg

SEQ ID NO: 67648 - DNA, 644 bp, Homo sapiens
  misc_feature: GYAE6OF01CXRTP.37.37.D04.1.454.CMB.1.raw
  modified_base (496)..(496): a, c, t, g, unknown or other
  misc_feature (496)..(496): n is a, c, g, or t
  modified_base (514)..(514): a, c, t, g, unknown or other
  misc_feature (514)..(514): n is a, c, g, or t
  modified_base (625)..(625): a, c, t, g, unknown or other
  misc_feature (625)..(625): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtggggcctcgagtgaaggttctcctgacaaggtcttcgttggttataccttttagactaattagtggtaatcctaacgtggggttcgcggaaccgacgggtcccccgtagggaaccaacgggacccagttggaggtaggagtggggatggacttcgagcgtacttaactaaataaactaacacaacactatacgacacaagaacgttaccgacgggtacgaggtacgtacctacccgtacgaaccaacacgtaatacactacccaacgacaccacgacgacctaanagtggagtcgagacgggngaccgtagacgtgtcgtacgacgacgtaccggtccgttacgttttcgcgttggacggtaagtagtaacgtaggtaaattacgttaggttaacgagggtacgttaaccgggngggtaccggtaaaccgggg

SEQ ID NO: 67649 - DNA, 579 bp, Homo sapiens
  misc_feature: GYAE6OF01ES9WT.37.37.D04.1.454.CMB.1.raw
  modified_base (218)..(218): a, c, t, g, unknown or other
  misc_feature (218)..(218): n is a, c, g, or t
  modified_base (279)..(279): a, c, t, g, unknown or other
  misc_feature (279)..(279): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctnagtgaaggtctcctgcaaggcttctggttatacctttagcaattatggtatcaactgggtncgacaggcccctggacaaggccatgagtggatgggatggatcagcgacttacaataataacacacactatagcacagaagttcagggcagagtcacctgaccacagatacactccacgacgcaacacgacctaacataggacgcgtaggaaggacgtcccgtaggacgtacttcgtacggaacgaccgacgggtccgttagttttacgtggtacgaccggtaagtacggtaacaaggtaaacttagtttaacggtaagtacgggtaacttacggttcgggggtacccgtaaaccgggggg

SEQ ID NO: 67650 - DNA, 599 bp, Homo sapiens
  misc_feature: GYAE6OF01D0X1X.37.37.D04.1.454.CMB.1.raw
  modified_base (281)..(281): a, c, t, g, unknown or other
  misc_feature (281)..(281): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagctaattatggtatcaactgggtncgacacggcccctggacaaggccatgagtggatgggatggatcgagcgacttaacaataataacacacactatgacacagaagttccgagggcagagtcaccctgaccanagatacactccacganacacagcctacgagtggacgcgtggaggcgccgtaggaacgtatccgtaggaaccgaccggaccgggtacccggtttagtttttaaccgtggttacggacggtaaggtaacggttaactaaaggtaaatttaagttaaggttaaacgttagggtaaccgttacgggtcgggggtacccggtaaacccggggg

SEQ ID NO: 67651 - DNA, 549 bp, Homo sapiens
  misc_feature: GYAE6OF01DGZJY.37.37.D04.1.454.CMB.1.raw
  modified_base (229)..(229): a, c, t, g, unknown or other
  misc_feature (229)..(229): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (345)..(345): a, c, t, g, unknown or other
  misc_feature (345)..(345): n is a, c, g, or t
  modified_base (425)..(425): a, c, t, g, unknown or other
  misc_feature (425)..(425): n is a, c, g, or t
  modified_base (446)..(446): a, c, t, g, unknown or other
  misc_feature (446)..(446): n is a, c, g, or t
  modified_base (482)..(482): a, c, t, g, unknown or other
  misc_feature (482)..(482): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtcnctgcaaggcttctggttataccttttagcaaattatggtatcaactgggtncgacnggcccctggacaaggccatgagtggagtgggatggatcagcgctaacgaataatacacanaactatgcaactagaagttccagggcagagcaccctgaccacagactacactccagaacgcaacgacgcctacatcggancgtgacggagcctggaacgtntactacggacgacgtaccggtccgttagttttacgngtggacgtagtagtaacgtagtaaattattaggtaaattcggactacgtggggcccgtaaaccgggg

SEQ ID NO: 67652 - DNA, 748 bp, Homo sapiens
  misc_feature: GYAE6OF01C3YFU.37.37.D04.1.454.CMB.1.raw
  modified_base (218)..(218): a, c, t, g, unknown or other
  misc_feature (218)..(218): n is a, c, g, or t
  modified_base (631)..(631): a, c, t, g, unknown or other
  misc_feature (631)..(631): n is a, c, g, or t
tcagtagtgtagatcacgaccggtgctcgatttagtagcatactgttgggtttggggacccaaaaccacacccctccttgggagaatccctagatcacagctcctcaccatggactggacctggagcatccttttcctggtggcagcagcaacaggtcgccactctcaggttcagctggtgcagtatggagctgaggtagaaggaagcgtggggcctnaggtgacggtctcctgacgaggtctttcttggttaacttaccgtttagactaagttataggtatacgaacgttgggtcgacgacgacggacccctaggacgtaaggccagtaggtaggtaggaggtagggagttacggagtacgacgtcggaacttaacaaaactaaactaactaaccaactaacctaatacgacgaaacgtaacggtaacgttacggaacgggtacaacggtacgttacccaacccgttaggaacccctaagaacgtaaccttaacgactaacccggaacggacacccaaacgacgtaccctaagaggtacggaccgtagtagggaccggacgtacgaggaacgtacgtacgtaaccgggaacggtaacccggtacgggtttacccggttggttttaaccgngggttaacccggaggtaaacgggttaagtaaaccggttagtttaaaacgtttggttaacgtttaacggaacgggtaaaccttcgggggttaccggggaaccccggttaaacccgggg

SEQ ID NO: 67653 - DNA, 662 bp, Homo sapiens
  misc_feature: GYAE6OF01D7IYN.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagctaattatggtatcaacgtgggtgcgacacggcccctggacaaggccagtgaggtggagtgggatgggatcgagtcgtacttaacgaataaactaaccacaaccgtaactaatcgacaacgtaaggtaacgttcccgaagggcaaggacgttaccaacccgtcgaacccaacgaacgtaactaacctactacccaacggaacgaccaaccgacgaccctacgagtgggacgtcgtagggacggtacgccgttaggaacgtagttcgtacgaaccggtaccgtccgggttacggtttacggtttacgtcggtacgcggtaaggtacgttaaccgtaagtaaacgtttagttaacggttaacgttacggtaccgttaacgggtcggggaccggttaaaccccgggg

SEQ ID NO: 67654 - DNA, 601 bp, Homo sapiens
  misc_feature: GYAE6OF01A8HEZ.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcgaagcgacttaacgaaataactaacaacaactactatcgacaacagaagttccgagggacagacgtccacccgtgaccaacagaatacatacccaacgacgacacgacgacctaacagtacggacgcgtaggacgggagcccgtagaacgtactaccgtaggaaccgacgaccgggttccgttaggttttaacctggttacggcggaacggtagtaacgaagtaaacgttagtttaggtaaacgtggtaaccttacggtgggggtaccgtaaacccgggg

SEQ ID NO: 67655 - DNA, 659 bp, Homo sapiens
  misc_feature: GYAE6OF01EREVH.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagctaattatggtatcaacgtgggtgcgacacggcccctggacaaggccagtgagtggagtgggatggatcgagcgtacttaacaataaactaacacacaactatgacaacagtaacgttccgaagggcaaggacgtaccaacccgtagaacccacgaacgaactacaactcccaacgaacgaccaaccgacgaccctaacgagtacgggagcgttaggaacgggacgaccgtagaacgtacgttaccgtacggaaccgtaaccggtaccgggtcccggtttaggtttttaccgtggttacggaccggtaaggtaacggttaacgtaaggtaaagtttaagtttacggttaaacggttacgggttaaaccgttaccgggtacgggggacccgtaaaccggggg

SEQ ID NO: 67656 - DNA, 751 bp, Homo sapiens
  misc_feature: GYAE6OF01AX6RU.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttctggtggcagcagcaacaggtgcccactctcaggttcagctggtgcagtctggagctggaggtgaagaagccgtggggcctcagtgaacggtctctgacaggtcttcgtggttattaccttagctaattatggtatcaacgtggtgcgacacggccctggacaaggcctagtcgagtggagtgggatggatgagcgtacttaactaataaactaacgaacacgtaactacgtaggtaccaacgtaacggtaaacgtttcccggaaggggtaccgtaacggtaaccgtacccgtaaccccggttaacggaacccctaaccggtaaacgtaacgttaaacccgtaaccgttaaccccggaaccggtaacggacccaaaaccgtacccggaacccctttaaccgaagttaacggggaaccggtcggtaacgggaacgggaccggtaccggtaacggtaacggtacgttaccgggtaacggtaaccggacccggtaccggtacccgggtttagtttaccgttggaacggtacggtaacggtaacgttacggaaacttaaggttacttaaggttaacgtacggtaacggttaccggtaggggtcccggtaaacccgggg

SEQ ID NO: 67657 - DNA, 614 bp, Homo sapiens
  misc_feature: GYAE6OF01AO69H.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagcaattatggtatcaacgtgggtgcgacacggcccctggacaaggccagtgagtggagtggggatggatcgagcgtacttaacaaataataacaacacaactatgcaacagaacgttcgagggtcagagtccacccgtagacccacaagataccactacccgaacgacgaccacgacgtaccctaacacgtacggactcgtaggagggacgccgtaggacgtacgtccgtacgaaccggtaccgaccgggtccgtttagttttaccgtggtcggaccggtaaggtacgttaacagttaaagttagtttaggtaaacgtcgggtaaccgttacgggtcggggacccggtaaaccgggg

SEQ ID NO: 67658 - DNA, 614 bp, Homo sapiens
  misc_feature: GYAE6OF01CLBQQ.37.37.D04.1.454.CMB.1.raw
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (517)..(517): a, c, t, g, unknown or other
  misc_feature (517)..(517): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaacgtgggtgcgacacggcccctggacaaggccatgagtggatgggatggatcgagcgacttaacaaataataaacacaacaactangacacagaagttcgagggcaagacgtccacctagaccaanagactacataccacganaccacacgcctaacgagtaggagcgtaggaacgggacgtaccgtaggagtacgttcgtacggtaaccgaaccggaccggttacccggtttaggttttaccgnggttacggaccggtaagtacggtaactaaggttaaacttagtttacggtaaacgttcgggtaacgtttaccggcgggggtaacccgtaaaccggggg

SEQ ID NO: 67659 - DNA, 621 bp, Homo sapiens
  misc_feature: GYAE6OF01AYUGY.37.37.D04.1.454.CMB.1.raw
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtggggcctcagtgaaggtctctgcaggcttctggttatacctttagctaattatggtatcgaacgtgggtgcgacacggcccctggacaacggccagtgaggtggagtgggatggatcgagtcgtacttaacaaattaaacaacacacactangacacgagtaacgtcgaggnaagtacgtccaccctgaaccananactacactaccacgacacacacgacctaacagtacggacgtcgtaggacgggacgccgtaggacgtacgtacgtacggaaccgtaccggtaccggttccgtttacgtttacgtggtacggacggtaacggtaacggaacgtaaggtaagtttaacgttaaggtaacggtacgggttaaccgtacggggtaccggggtaacccggtaaacccgggg

SEQ ID NO: 67660 - DNA, 691 bp, Homo sapiens
  misc_feature: GYAE6OF01CK3V1.37.37.D04.1.454.CMB.1.raw
  modified_base (608)..(608): a, c, t, g, unknown or other
  misc_feature (608)..(608): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtctggagcgtgaggtagaagacgccgtgggcctgagtgaaggtctccgtgaccgtaaggtcttacgtggttactaccgttttagactaattagtaggtactacgtaacgtgggtagaccgtacgaccggtccccgttaggaaccgaacggcctaagtaggaggttaggagtaggggataggactacgagtacgtactaaataaataactaacaacgtaactaacgtaagtcgaacaagtaacggtaaccggttacgaacgggtacaaacggtaacgttacccgaaccgtacgaaaccctaacgtaagtaacctaacgaacgtaacccgaacgagaaccctacgaacgtcctaaccgagtacggactacgaggacgacgtacgtagacgtactgacggacgacgtacggtcttaggtttacncggtagacggtaacggtaagaagtaacgtaagttagttaacggtaatacggtaccgtacggtacggggtaccgtaaaccgggg

SEQ ID NO: 67661 - DNA, 590 bp, Homo sapiens
  misc_feature: GYAE6OF01D83LJ.37.37.D04.1.454.CMB.1.raw
  modified_base (381)..(381): a, c, t, g, unknown or other
  misc_feature (381)..(381): n is a, c, g, or t
  modified_base (454)..(454): a, c, t, g, unknown or other
  misc_feature (454)..(454): n is a, c, g, or t
  modified_base (485)..(485): a, c, t, g, unknown or other
  misc_feature (485)..(485): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccacttgagaaatagtgatgacgcagtctccagcccaccctgtctgtgtctccgaggggaaagagcccaccctctcctgcgacgggccagtcagagtgttagcagcaacgttacgccgtacggtaccagacaagaaaccgtcggccaggcctaccccgaggcctccctcactctagtggtcgctactcccgacgacgggccacgttggtactcccgagtccgtacggttcaggtcgggngaggtgggtcgtagggactaggtacgttcactcaccactatccgaagccaacgtctgacagtctagtaagttnttttagtcttagttttcttcgtcgtcgagtnaagtttaatacttacgtcgtaccttccgtaggtcggtacggtcgacgaacgggtacgaaggtacgaaactacggaaagtacgtgtacgcgtacacgactgtctcg

SEQ ID NO: 67662 - DNA, 577 bp, Homo sapiens
  misc_feature: GYAE6OF01DVAXA.37.37.D04.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (423)..(423): a, c, t, g, unknown or other
  misc_feature (423)..(423): n is a, c, g, or t
  modified_base (470)..(470): a, c, t, g, unknown or other
  misc_feature (470)..(470): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagagtgtagcagcaacttgcctggtaccagcagaacctggccaggcctcccgagcctcctcatctagtggtcncagtccaccgagggcccacgtcggtactcccgagcccgaggttcaggtgcgtaggtcgggtactgggacagtcgttaccacttctacaccatccgagcacgcctgctagtctagtaattntttgacttagttttcttcgtgtacagtactaagttataacgtttcgngtacccttcgtacggtcggtacgttccggacgtaaacgggtaccgtaaggtacggtaaactaccgaaacgtacgtgggtacggtctacggaccaacgtgttcgttcg

SEQ ID NO: 67663 - DNA, 616 bp, Homo sapiens
  misc_feature: GYAE6OF01ALLF6.37.37.D04.1.454.CMB.1.raw
  modified_base (194)..(194): a, c, t, g, unknown or other
  misc_feature (194)..(194): n is a, c, g, or t
  modified_base (276)..(276): a, c, t, g, unknown or other
  misc_feature (276)..(276): n is a, c, g, or t
  modified_base (411)..(411): a, c, t, g, unknown or other
  misc_feature (411)..(411): n is a, c, g, or t
tcagtagtgtagatcacgaccggtgctcgatttagtagcatactgttgggtttggggacccaaaaaccacacccctccttgggagaatcccctagatcacagctcctcaccatggactggacctgggagcatccttttcctggtggcagcagcaacaggtgcccactctcaggttcagctggtgcagtctgganctgaggtgaagaagcctggggcctcagtgaggtctctgcaagcttctggttatcctttagcaattatggtatcaagtgggtncgacaggcccctggacaggccatgagtggatgggatggatcgagcgtacttaacaataacgtaacacaactacgtatcgacaacgagtaacgttacccgaagggcacggactccgacccgtagaccacagactanactaccacggacgacacgacgacctaacagtacggagcgtacggaacgggtacgccgtaggacgtagtccgtaggaaccgaccggtaccggttaccgtttacgtttacgtcggtaggacggtacgaacgttaacggaacgttaaagttcgttaacgtaaagtttacgggaacgttacgggtacggggtacccggtaaacccgggg

SEQ ID NO: 67664 - DNA, 677 bp, Homo sapiens
  misc_feature: GYAE6OF01ARMA5.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggtcttctggttatacctttagctaattatggtatacaacgttgggtgcgacgacggccccctaggaactaagggccagtggagtggtagtgggatgggatacgagtcgtacttaacgaaataaactaacaacaactaactatcgacaacgtaagtaacgttacgagggtcaacggtacgtacccaacccgtagaacccaacgaagtaactaaccgacttaccccgaaacggacgaccaacgaaccggtaccctaacgtacgttacgggaacggtctacgggaaggtaaccgtccgttaaggagtaactccggtacggaaccgtaccggtacggtaccgtttaggtttaccgtggtacgaacggtaagtacgtaacgaaagttaagttagttaacggtaagttacggtaaccgttacggtacggggacccgtaaaccggg

SEQ ID NO: 67665 - DNA, 576 bp, Homo sapiens
  misc_feature: GYAE6OF01C1GXH.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggtcttcgtggttataccttttagctaattatggtaatcaactgggtgcgacacggcccctggacaaggccatgagtggatgggatggatcagcgcttaacaataataacacaacactatgcacagaagttccgagggcaagacgtccaccctgaacccaacagaactacactcccaacgagacacagaccttacatggacgtctggaagggcgacccgtggaagtactacctaggaacgaccgacggtaccgtttggttttacctggtgacggtaggagttaacgaagaaattaagttgttaaagtaggtactaacggttggggacccgtaaccggggg

SEQ ID NO: 67666 - DNA, 703 bp, Homo sapiens
  misc_feature: GYAE6OF01CXJKW.37.37.D04.1.454.CMB.1.raw
  modified_base (139)..(139): a, c, t, g, unknown or other
  misc_feature (139)..(139): n is a, c, g, or t
  modified_base (232)..(232): a, c, t, g, unknown or other
  misc_feature (232)..(232): n is a, c, g, or t
  modified_base (328)..(328): a, c, t, g, unknown or other
  misc_feature (328)..(328): n is a, c, g, or t
tcagtagtgtagatcacgaccggtgctcgatttagtagcatactgttgggtttgggacccaaaaaccacacccctccttgggagaatcccctagatcacagctcctcaccatggactggacctggagcatccttttccnggtggcagcagcaacaggtcgcccactctcgaggttcagctggtgcagtctggagctgaggtgaagagccgtgggcctcgagtgaaggtctcngcgaggtcttcgtggttactactttagctaattgtggtatcaacgtggtacgcgacacgcccgtaggacaaggcagtgagtgatgggatggatcgngacgtacttaacaaataataaccaacgactaacttaagcggaaccaaacgaaggtaaccgttacggacggggacctaaaggaccgttacccgaacccttacgggaacccaacgtaagaaccgtaacctacgtaacccgaacggaactaacccgaacgaaccgtaccgttaaacgacgttaacgggacgacccgttaggaaccgggtaccgtacccggttaggaaccgtaacgttaccaccgggaaccgtaccggtaacccgggttccgtttagggttttacacgggttacgaaccggtaagtaacgtaacgtaacgtaatttagtacggtaaagtaccggaacggttacgggtcggggaacccgtaaacccgggg

SEQ ID NO: 67667 - DNA, 693 bp, Homo sapiens
  misc_feature: GYAE6OF01CKPYF.37.37.D04.1.454.CMB.1.raw
  modified_base (244)..(244): a, c, t, g, unknown or other
  misc_feature (244)..(244): n is a, c, g, or t
  modified_base (282)..(282): a, c, t, g, unknown or other
  misc_feature (282)..(282): n is a, c, g, or t
  modified_base (417)..(417): a, c, t, g, unknown or other
  misc_feature (417)..(417): n is a, c, g, or t
  modified_base (589)..(589): a, c, t, g, unknown or other
  misc_feature (589)..(589): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtggggcctcagtgaaggtctcctgcgaaggcttntggttactactttagctaattatggtatcaagtgggtncgacgacggcccctggacaaggccagtcgagtagggagtggggagtgggatacgagccgtacttaaacaaagttaaactaaaccacaaacctaactagtacgacaacgtaaggaacgttaccgagggctaaaggngtacccaacccgtgaacccaagacgaactacgactacccgaagacgaccaacgacgtaccctaactaggtacggtagccgttaagggacggggtaccggccgtaagggtacgtaacgttaccgttacggaaccgtaaccgggtacccggtttacggtttcgtttttaaccgngggttacggaccggtaaggtaacggttaacaaaggttaagttaacgtttaggttaaaggtacgggtaagtttaaccggggtacggggcccggttaaacccgggg

SEQ ID NO: 67668 - DNA, 562 bp, Homo sapiens
  misc_feature: GYAE6OF01E0NLM.37.37.D04.1.454.CMB.1.raw
  modified_base (417)..(417): a, c, t, g, unknown or other
  misc_feature (417)..(417): n is a, c, g, or t
  modified_base (435)..(435): a, c, t, g, unknown or other
  misc_feature (435)..(435): n is a, c, g, or t
  modified_base (496)..(496): a, c, t, g, unknown or other
  misc_feature (496)..(496): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctctgcaaggcttctggttatacctttagctaattatggtatcaacgtgggtgcgacacggcccctggacaaggccagtgagtggagtgggatggatcgagcgacttaacaataactaacacacaactatcgacacaagtaagttccgagggcagagtccacccagaccacagatacactaccacgacncacacgcctagatggganctaggacgggacgccgtaggagactcgtagaaccgaccggtacggttccgttgttttacgngtcgacgagtagtaacgagttaattagttacgtaagtaggaccgtaggtcgggaccggtaaccggg

SEQ ID NO: 67669 - DNA, 679 bp, Homo sapiens
  misc_feature: GYAE6OF01D9KRF.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagagccgtgggcctcgagtgaacggtctccgtgcgaaggtcttcgtaggtttacttaccgtttagctaattagtggtatacgtaacgtgggtgacgacgacggcccctggaacgacggcctagtggaggtggagtgggatgggatcgacgtcgtacttaagaaataactaacaacactactacgtcgacaacgtaacggtaacgttccgagggcgtaaggacgtacccaccgtacgaacctacgaacgtataccaactaccgaacggacgtaccaaccgtaccgtaccctaagtacggtacggacgtacgtagggaacgggaccgtacgtaggacgtacgtacgtaccggtaccggtaaccgtaccgggttaccgtttacggtttaacgtggttacggtacgaggttaacgtacgtaagtaaacgtttagttacgttaagacggtaccgttacgggcgggtaccggtaacccgggg

SEQ ID NO: 67670 - DNA, 643 bp, Homo sapiens
  misc_feature: GYAE6OF01DNM3Z.37.37.D04.1.454.CMB.1.raw
  modified_base (560)..(560): a, c, t, g, unknown or other
  misc_feature (560)..(560): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtggggcctcgagtgaaggtcctcgtgcaaggtcttctggttacttacgtttagctaatttagtggtactacgtaacgttggggtacgcgaacgcggtaccccctagggaacgaacggccaagtcggaggtgggtagtgggacgtggactcgagcgtactaacaaataacgaacacaactactatcgacaacgtagtacgttacgaggcaagtacgtaccaccgtagaccacgaagactaacactacgacgacgtacaacgacgacctaacgagtacggacgtcgtaggaacgacgtccgaaggagtacgtcgtacgaaccgaccggtaccggttcgtttacggtttacgngttacgacggtacgtaagtacgtaagtaacgttagttacgtaacggttacggaccgttacgggtacgggccgtaaacccgggg

SEQ ID NO: 67671 - DNA, 690 bp, Homo sapiens
  misc_feature: GYAE6OF01BD6GN.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctcagtgaaggtctcctgcaaggtcttcgtggttactacctttagctaattatggtatacaagtgggtgcgacgacggccctaggacaggccagtggagtggagtagggatgggactcgaggtcgtacttaaacgaaattaacgaaacctaactaactaacttaagtcgaaccaaacgtaaggtaaacgttccgaaggggtaccaaggtaacgtccctaacccgtacgaaccaacgaacgtaacttaacaacgttacccaaacggtacgacaaccgacgtaccctaaagacgtaggacgcgtacggaacggtcgaccgtaggagtacttaccggaacggtaacccgtaaccggtaccggttacgtttacgttttacgtacgggtacgtacggtaacggtagttaaacgaggttaaagttagttaacgtaacggtacggtaacgttacgggtacggggaaccggtaaaccccgggg

SEQ ID NO: 67672 - DNA, 672 bp, Homo sapiens
  misc_feature: GYAE6OF01A07M6.37.37.D04.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtgttagcagcaacttgcctgtaccagcagaacctggccaggcctccgaggctccnatctatggtcncactccgaccgacgggcctacgtcggtactcccgagtcccgtaggttcaggtcggactaggttcgggtctggggactaggtacgtttcccaacgttcgtaccaacctataccgacgtccgaacggtccctggacccgtaacggttacccttaaggtaaacgtttacgtttttacggaccgtttaagtttttacctttcgttacggttactacggttacttaaggttaactttaacgtttaccgtcgggttacccttaccggtacggttccggtaccggttccggaaccgtaacgggtaccgaagggtacgtaaactaccggaaaacggtacgttcggtacggtaccgtacgaccgtaccctagtcgttacg

SEQ ID NO: 67673 - DNA, 613 bp, Homo sapiens
  misc_feature: GYAE6OF01BT22O.37.37.D04.1.454.CMB.1.raw
  modified_base (205)..(205): a, c, t, g, unknown or other
  misc_feature (205)..(205): n is a, c, g, or t
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
tcagtagtgtagatcacgaccggtgctcgatttagtagcatactgttggggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaangccaccctctcctgcagggccagtcagagtgtagcagcaactagcctggtaccagcaacgaaacctggccaggcctacccgaggtcctcctcactctagtggtcgccactcccaccgacgggccacgtggtactcccagccgaggttcaggtcgggcaggtgggtcgngggacaggtcgttcgactctacgaccnctacacgcagcctgcgtagtcgtagaagttatttcgtacttagttttacttcgtcgtactagactaagttaattaacttccgttcggtacccttcgtacgggttaccgggttacggttaccgggaaccgaaaggggtaaccgtaagggtaggtaaaacctacggaaaacggtaacgttcgggtacggtcttcgaccacccgttagtcgttacg

SEQ ID NO: 67674 - DNA, 684 bp, Homo sapiens
  misc_feature: GYAE6OF01CWJW5.37.37.D04.1.454.CMB.1.raw
  modified_base (272)..(272): a, c, t, g, unknown or other
  misc_feature (272)..(272): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggtcttcgtggttataccgtttagactaaattntaggtatcaagtgggtgcgacacggcccgtggaccaaggccatggagtggagtgggatgggatcgagcgtacttaacgaaataaactaaacacaactaactatcgacaagaagtaacgttaccgaggggacaaggtacgtaccaccctagaacccaacgacgaactaaccgactacccaacggacgaccaaccgacgaccctaacacgtaggacgtcgtagggaacgggacgtccgtaggaacgtaacgttcgtaacggaacccggtaacccggtaccgggttaccggttttaggttttaccggtaggtcggaacggtaaggtaacgtaacggtaaagttaaagtttaagtttaacgggtaaacgttacgggtaaccgtttacggggtcgggggtacccgggtaaaccgggg

SEQ ID NO: 67675 - DNA, 813 bp, Homo sapiens
  misc_feature: GYAE6OF01DZ29F.37.37.D04.1.454.CMB.1.raw
  modified_base (139)..(139): a, c, t, g, unknown or other
  misc_feature (139)..(139): n is a, c, g, or t
  modified_base (194)..(194): a, c, t, g, unknown or other
  misc_feature (194)..(194): n is a, c, g, or t
tcagtagtgtagatcacgaccggtgctcgatttagtagcatactgttgggtttgggacccaaaaaccacacccctcttgggagaatcccctagatcacagctcctcaccatggactggacctggagcattccttttccnggtggcagcagcaacaggtcgcccactctcgaggttcagctggtgcagtctgganctggaggtgaagacgccgtgggcctgaggtgagtctcgtgcaggtcttcgtggttacttacctttagacttaagttagtaggtactactaacggttgggtacgacgaccgtacggtccccgtaggaaccgaacggcctagttaggaggtagggagtagggagtaggatacgaggtcgtaacttaaacaaacttaaactaaccaactaacctaacgttaacgtaccggaactaaacggtaaaggttaaccgttacgggaacgggtaccgtaaggtacccggtaaccctacccggtaacggaacccctaacgaaacggtaactaaccgaaccgttacccggaaaccgaacgacccgtaaaccgaacgtaccccgttaagaaggttaccggggaacaccgggttaacgggaaccgggtacgtaccggttaaacggacgttaaccggtacctaacggggaacccggtaaccgggtaccgggttttaccggttttaacgtttcggtacgtaaccggggtacgtaaacggttaacggtaaacgtaaggttaaacgtttaagttaacgggtaacggttacgggttaaccgttccggggtaaccgggtaaccgggttaaccccgggg

SEQ ID NO: 67676 - DNA, 597 bp, Homo sapiens
  misc_feature: GYAE6OF01BIEUY.37.37.D04.1.454.CMB.1.raw
  modified_base (280)..(280): a, c, t, g, unknown or other
  misc_feature (280)..(280): n is a, c, g, or t
  modified_base (385)..(385): a, c, t, g, unknown or other
  misc_feature (385)..(385): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtncgacacggccctggacaaggccatgagtggatgggatggatcagcgcttacaataaactacacacactatgcacagaagttccagggcagagtccacctgaccanagatacataccacgagccacacgacctacatggaagcctaggacggtacgccgtaggaaggtactcgttaggaaccgtaaccgtaccgggtcccgtttaggttttaaccgtggtaggaccggaagtaacggtaactaaggtaaacgttagttaacggttaaaagttacgggtaaacgttacgggttcggggggtaacccgtaaacccggggg

SEQ ID NO: 67677 - DNA, 652 bp, Homo sapiens
  misc_feature: GYAE6OF01ESSU3.37.37.D04.1.454.CMB.1.raw
  modified_base (354)..(354): a, c, t, g, unknown or other
  misc_feature (354)..(354): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggttactacctttagctaattatggtatcgaacgtgggtgcgacacggcccctaggacaaggccagtgaggtggagtgggatggatcgaggcgtacttaacaaataaanaacaacaactaactatacgacaacgaagtaacgttcgacgggacaggtacgtaccacccgtagaaccacgaagtactacactacccgaacgacgacaaccacgtaccctaacgaacgtgggacgtacgtacgggaagacgaccgtaggacgtagtacgacggaaccgtaccggaccggttcgttacggtttacgtcgggtacgacggtaacgtaaggtaaacgtaacgtaaagtttaagttaaggttaaacggtacggtaaaccggttacgggtacggggacccggttaaacccgggg

SEQ ID NO: 67678 - DNA, 649 bp, Homo sapiens
  misc_feature: GYAE6OF01DPNMN.37.37.D04.1.454.CMB.1.raw
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtgggcctgagtgaaggtctctgcaaggtcttcgtggttactacgtttagactaattagtggtatctaacgtggtgcgacgacggccccgtaggacgaacggccagtgagtggagtgggagtggagtacgagcgtacttaacgaaataaacgtaaccaactactaacgtanagacaacgaagtaacgttaccgaaggcgtaagaccgtaccacccgtanacccgactaagaaccttaacgactacccgaagacgacccaacgaccgtacctaaccgagtacggaactcgtaggacggaacgccgtaaggacgtactcgacgaccgtaacgtccggttacgttttcgtttacgtcggtaggtacggtaggtaagtaaacgtagttaattaagtttcggaaacgttgggaaaccttccgggtaccgggaacgttaacccgggg

SEQ ID NO: 67679 - DNA, 742 bp, Homo sapiens
  misc_feature: GYAE6OF01C161C.37.37.D04.1.454.CMB.1.raw
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
tcagtagtgtagatcacgaccggtgctcgatttagtagcatactgttgggtttggggacccaaaaccacaccctccttgggagaatcccctagatcacagctcctcaccatggactggacctggagcatccttttctggtggcagcagcaacaggtgcccactctcaggttcagctggtgcagtctggagctgaggtgaagagcgtgggcctgagtagaaggtctcctgacaaggtcttcgtaggtttacttacctttaggactaattagtaggtatcgaagtggggtanccgacgacggtccccgnggaacgaaggccagtgaggtgagtgggactaggactgaagcgtacttaaaanaaactaanaaccaacaactaactagacgactaacggaacgtaacggtacgacgggacgaagtaaccgtacccgtaccgacgaaccaacgaacgtaacctaacgtaaccgtaccgaaccggaacgaaccaacgtaaccgtaccgtaagaacggtacggaacgtacggtaacggaacgggtacgtaccggtaaggaacgtacgtaccgtaaccgggtaaccggtaaccggttaccgggtttacgttttaacggtttacgtaccggggtacgtaaacgggtaacggtaacggttaaacgtaaaggttaaacgtttacggttaaacggttaaacggtacgggttaaaccggtaaccggggtaaccgggggtaacccggtaaacgggg

SEQ ID NO: 67680 - DNA, 260 bp, Homo sapiens
  misc_feature: GYAE6OF01DARGV.37.37.D04.1.454.CMB.1.raw
  modified_base (243)..(260): a, c, t, g, unknown or other
  misc_feature (243)..(260): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggccaccctcctccaagagcacctctggggcacagcgccctggctgcctggtcaaggactactccatctacactactgagcggctggcaaggcgcatagnnnnnnnnnnnnnnnnnn

SEQ ID NO: 67681 - DNA, 542 bp, Homo sapiens
  misc_feature: GYAE6OF01EMR51.37.37.D04.1.454.CMB.1.raw
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccagtgagtggagtgggatggatcgagcgacttaacaataataacaacacaactatgcacagaagttccagggcagacgtcacctcgaccacagatacactaccacgancacagcctaanagtggacgctaggacggagccgtagagactcgtacggacgacgaccggtcgttcgtttacgtgtgcgtagtagtaacgtagaaattagttagtaagtaggactacggtcgggccgtaaccggg

SEQ ID NO: 67682 - DNA, 257 bp, Homo sapiens
  misc_feature: GYAE6OF01AGWZV.37.37.D04.1.454.CMB.1.raw
  modified_base (249)..(257): a, c, t, g, unknown or other
  misc_feature (249)..(257): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctcgtgggggcacagccggccctgggctgcctggtcaaggactacttccatctacactactgagcgggctggcaaggcgcatagnnnnnnnnn

SEQ ID NO: 67683 - DNA, 253 bp, Homo sapiens; identical to SEQ ID NO: 67478
  misc_feature: GYAE6OF01AZ2NV.37.37.D04.1.454.CMB.1.raw
  modified_base (247)..(253): a, c, t, g, unknown or other
  misc_feature (247)..(253): n is a, c, g, or t

SEQ ID NO: 67684 - DNA, 129 bp, Homo sapiens; identical to SEQ ID NO: 67470
  misc_feature: GYAE6OF01AV02S.37.37.D04.1.454.CMB.1.raw

SEQ ID NO: 67685 - DNA, 665 bp, Homo sapiens
  misc_feature: GYAE6OF01B4JZK.37.37.D04.1.454.CMB.1.raw
  modified_base (299)..(299): a, c, t, g, unknown or other
  misc_feature (299)..(299): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagataccactggagaaatagtgatgacgcagtctccagccaccctgtctgtgtctccgaagggaaacgacgccaccctctcctgcacgggccagtcgagagtgtagcagctaatgcctggaccagacaacgaaacctggaccacggctaccgaggcctccncatcgtagtcggtcaccacgtaccacgacggccagtcgtactccgagtccaaggttcgagtcggcgtaggttcggggtactagggaactacggtacgtttaccacgttccctaccaaccctagtaccaacggcgtacgtcccgttaggacccgttacgggttacttaaggtaaacggtttatttttacggacctttaaggtttttacttcgttacgtacgtacgtacgttaacgttaacttaacgttacgtcgttccttacggtacggtacggtaccgtccgggaaacgaacgggtaaaccgtaaggtacggtaaactaacggaaacggtacgtcggtcggactacgaacctcctaagtcctacgg

SEQ ID NO: 67686 - DNA, 845 bp, Homo sapiens
  misc_feature: GYAE6OF01DBONF.37.37.D04.1.454.CMB.1.raw
tcagtagtgtagatcacgaccggtgctcgatttagtagcatactgttgggtttggggacccaaaaaccacacccctctgggagaatccctagatcacagctcctcaccatggactggacctggagcattccttttcctggtggcagcagcaacgaggtcgcccactctcaggttcagctggtgcagtcgtggagcgtggaggtaggaagaacggccggtggggcctcgaggtaggaacggtcctcgtggacgaagggtctttcgtaggttacttacgttagactaagttagtggtactcgaacggttggggtcgacgacgaccgggtcccctagggaaccaacggccagtcggaggtggaggtagggatagggactcgaggtccgtaacttaaacgaaaataaactaaaccaacgtaacctaacgtacgtacgaacaaaccggtaaaggtaaccggttaccggaaaggggtaccgtaaaggacccggttacccaaccccggttagaaaccccgaaacgaacggtaactaaccgttaaccgaaccccgaacggtaaacgaccgttaaaccgaaccggtacccgttaaacgaacgggttacgggaacgtcggtaacgggaacgggtcccggtaaccgtaagggacgtaccgttaaccggtacgggaaacccgtaccggtaaccgggttcccggtttttaggtttaaccgggcggttacgggaaaccgggttaacgggttaaagtaaaccgttaaacgggttaagttttaaacggttagggttaaaccggttaacgggtaacccggtttacgggggtaacccgggggtaccgttaaaacccccggggg

SEQ ID NO: 67687 - DNA, 661 bp, Homo sapiens
  misc_feature: GYAE6OF01CJB6Z.37.37.D04.1.454.CMB.1.raw
  modified_base (587)..(587): a, c, t, g, unknown or other
  misc_feature (587)..(587): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcgaggttcagctggtgcagtctggagctggaggtgaagaacgccgtgggcctcgagtgaaggtctcgtgcaggtcttcgtggttactaccgtttagactaatttagtaggtactacgtaacgtgggtcgaccgtacgaccgggtccccgtaggaaccgtaaacgggccaagttggaggtaggagtgggagttggatacgagcgtactaacgaaataacaacacacgtactagtcgacaacgtagtaacgttcgagggacaacgtacgtaccacccgtagaccctaagacgtaactaacgactacccgaacgtacgacacgtacgtaccgtacaggtacggagacgtaggacgtacgtaccgtagggtaactaccgttaccgagtaacccggtaccgtacgggttaccgttgtttacgnggttacgacggtaactagtaacgaagtaacttgttaacgtacgtacgtagttacggacgggaccgtaaaccggg

SEQ ID NO: 67688 - DNA, 781 bp, Homo sapiens
  misc_feature: GYAE6OF01DS2KD.37.37.D04.1.454.CMB.1.raw
  modified_base (616)..(616): a, c, t, g, unknown or other
  misc_feature (616)..(616): n is a, c, g, or t
  modified_base (621)..(621): a, c, t, g, unknown or other
  misc_feature (621)..(621): n is a, c, g, or t
  modified_base (718)..(718): a, c, t, g, unknown or other
  misc_feature (718)..(718): n is a, c, g, or t
  modified_base (731)..(731): a, c, t, g, unknown or other
  misc_feature (731)..(731): n is a, c, g, or t
tcagtagtgtagatcacgaccggtgctcgatttagtagcatactggttggggtttggggaacccaaaaaccacacccctccttgggagaactcccctagatcacagctcctcaccatggactggacctggagctattcccttttccgtgggtgggcagcagacaacagggtcaccctactcctcgtaggttcagtcgtgggtcgctaggttcgtagggagtccgtaggtagggtaggaacggaacgggtcccgggtaggggtcccttaggaaggggttacggtaaccgggttccctaccgttaggacgtaacgggttcctttacggttaggttaacttttacgttagaactttaaagtttaggttggtaacgttaccgtaacgggttgggtacgaccggtaccgaaccggggtccccgaagggaaccggtaaccggactaggtagggttaggtaggtaagggtaggtacgtaggtacttacggacgttacgtaaactttaaacgaaaacttaaacgaaccgtaaactaacgtacgtagtacgactaaacgaagggttaccgtacggacgacgaacggacctaccctcgaacgactacgataaccgcaacgacacgnactanaccgtactagacgtggactacggtaggaccgtagctaggacgtactacggtacggacgtaccgtacggtttcgttacttggccgtaagacgggtaanacgtagttaaacncgttaaggtatacgggtacgtacgggttcgggaacgggtccgggtaacgg

SEQ ID NO: 67689 - DNA, 652 bp, Homo sapiens
  misc_feature: GYAE6OF01CLFBD.37.37.D04.1.454.CMB.1.raw
  modified_base (281)..(281): a, c, t, g, unknown or other
  misc_feature (281)..(281): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggttatacctttagcaattatggtatcaactgggtncgacacggcccctggacaaggccagtgagtggatgggatggatcgagcgcttaacaaataataacacacactatgacacgagaagttccagggtcaaggactaccaccctagaccaacagaatacactaccgacgacgacaacgacgtacctaacacgtggaacggccttagggaacgggacgcccgtaggtaacggacttccgtaacggaaccgtaaccgtaacccgggtaccggttttacggttttaccgtggttaggaccggtaaaggtaaggttaaacgtaaaggttaaagtttaaagtttagggttaaaacgttacggggtaaaccgtttaccgggtacgggggggtacccgtaaaacccgggggg

SEQ ID NO: 67690 - DNA, 645 bp, Homo sapiens
  misc_feature: GYAE6OF01DSKZF.37.37.D04.1.454.CMB.1.raw
  modified_base (381)..(381): a, c, t, g, unknown or other
  misc_feature (381)..(381): n is a, c, g, or t
  modified_base (571)..(571): a, c, t, g, unknown or other
  misc_feature (571)..(571): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtcgcccactctcaggttcagctggtgcagtctggagtcgtgaggtagaagaacgccgtggggcctcgaggtgaaggttcctccgtgcgaaggtcttcgttggttacttacctttagactaaatttagtaggtaactcgtaacgtggggtcgacgacgaccgggccctaggacctaaggccagtcggaggtggagtagggatggatacgacgtcgtacttaaanaattaaactaacactaactactaagcgacaagtagtaacgtccgagggacagtacgtaccaaccgtgaacctaacgagactaacacgtacccgaagacgactaaccgacgtaccctacagtgggaacgtcgtaggagaccgtcgtagaagtcgtcgtaacgacgtaaccgacggttaccgttgtttacgnggtagacgtaacgtaagtactaagtaattaggttaagtaggtacggtaacgtacgggtcgggaccgtaaccggg

SEQ ID NO: 67691 - DNA, 891 bp, Homo sapiens
  misc_feature: GYAE6OF01EDYJK.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggcctccagactaccacgtggaagaaatagtgatggacgcagtctccacgcccaccgtgtcgtgtcgtcctaccggaaggggaacgacgacccaccctctccgtcggaccggacgggaccagtacgaggtagttaggttacgactacggactaacgttacggccgttacggaaccagacgaacgtaaccgtcggaccacggcctccgacggtcctcctactactacgttaggtcggtacacctaccgtacccgaccggaccgggtacctacggttaccggtacctcccggaacgtacggttaacggttacggacggtacgggacggttacggggtcgggtacggtaacgggtaacgtaggttacccgttaccgaacgttacccacccgtaacgtacccgtacgtacccggaccgtacggtacccgttacggaccgttaacggttacgggtaacgttaacggttttacgttttacgttacgtttttacgtttttaacgtttcggtacgttaacgtacgtaacccggttaagtttaaaccgttaccggtttaccggttacccggtttaaccccgtttacgggttaacccggggttaaccggggttaacccggttaaccggggaaaacccggggttaaaccgggtaaacggggttaaccgggttaaacggttaaaacccgtaaccggtaaaacccgggttggttacccggttacgggtaaccgtaccgtaaacctttaaccgtaaccggtttcgtttaacccgg

SEQ ID NO: 67692 - DNA, 712 bp, Homo sapiens
  misc_feature: GYAE6OF01EVZ51.37.37.D04.1.454.CMB.1.raw
  modified_base (183)..(183): a, c, t, g, unknown or other
  misc_feature (183)..(183): n is a, c, g, or t
  modified_base (267)..(267): a, c, t, g, unknown or other
  misc_feature (267)..(267): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccatctcaggttcagctggtncagtcgtggagctgaggtgaaggagccgtggggcctcgagtgaaggtctcctgacgaaggtcttgtggtttacttaccgtttanactaattagttggtatacgaacgttgggtcgaccgacgacggtcccccgtaggaaccaaggcctagtggaggtgggagtgggagtggactgacggtacgtacttaaacaaagtaaactaacactaacgtaactatacgacaaacgtaacgtaacgttccgaaggggacaacggtaaccgtcccgaaccgtacggaaccaacgtaacgaacgtaacctaacgtacccgaaacggtacgaaccgtaaaccgtacgtaccctaaagacggtaaggacgtacgtaaggaacgggacgtccgtaagacgtactacggtaacggaaccgtacggtaccggttaccgtttacggtttacggtcggtacggtacggtaagtaacgttaacgaaagttaacgtttagtaagttaacgtcgggaacttacggggaaccgggtcggtaaacccggg

SEQ ID NO: 67693 - DNA, 646 bp, Homo sapiens
  misc_feature: GYAE6OF01AREA4.37.37.D04.1.454.CMB.1.raw
  modified_base (441)..(441): a, c, t, g, unknown or other
  misc_feature (441)..(441): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaggtctcctgcaggcttctggttatacctttagctaattatggtatcaactgggtgcgacacggcccctggacaaggccagtgagtggagtggggatggatcgaggcgtacttaacaaataataaccaacacaactatacgacaacgagtaacgttccgagggacagacgtccaccctgacccacagactacactcccacgacgaccacacgaccctanacgtaggacgtacgtggaacgggacgtccgaggacgtacgttaccgtacggaccggaaccggtacccgggttaccggtttacggttttacgttcgggttacggacgggtaacggtaacggtaacggtaaaggttaaattaaggttttagtaaacggttacgggtaaccggttaccgggtacgggggtacccggtaaacccggggg

SEQ ID NO: 67694 - DNA, 591 bp, Homo sapiens
  misc_feature: GYAE6OF01CJQAA.37.37.D04.1.454.CMB.1.raw
  modified_base (246)..(246): a, c, t, g, unknown or other
  misc_feature (246)..(246): n is a, c, g, or t
  modified_base (404)..(404): a, c, t, g, unknown or other
  misc_feature (404)..(404): n is a, c, g, or t
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtagaagaagccgtggggcctcagtgaaggtctcctgcaaggtcttntggttactactttagctaattatggtatactaagtgggtagcgacgaccggtccccgtggacgaacggccagtggagtggagtgggatagggatcgaggaccgtacttaacaataaactaaacacaacactaatgaccaacgaagtaacgtcaggganaggactccaccgtcgacacagactacacgtacacgagaccacgacgacctacgagcggancgtaggacggcgtacgtagacgtntacgtacgacaccggtacgtccgtttgtttagcgttagacggactagaacgtagtaagttagttacgtaagtacggtaacgtcgggtcgggaccgtaaccggg

SEQ ID NO: 67695 - DNA, 613 bp, Homo sapiens
  misc_feature: GYAE6OF01BMVGO.37.37.D04.1.454.CMB.1.raw
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (467)..(467): a, c, t, g, unknown or other
  misc_feature (467)..(467): n is a, c, g, or t
  modified_base (539)..(539): a, c, t, g, unknown or other
  misc_feature (539)..(539): n is a, c, g, or t
tcagtagtgtagatcacgaccggtgctcgatttagtagcatactgttgggtttgggggacccaaaaccacacccctccttgggagaatcccctagatcacagctcctcaccatggactggacctggagcattccttttcctggtggcagcagcaacaggtgcccactctcaggttcagcgttggtgcagtcgtggagcgtggaggtcgaagaagccgtggggctacgaggtgaaggtctcagcgaaggtcttcgtggttactacctttagactaattataggtatacgaacgtgggtacacgacgacgcccgtaggacaggcagngagtggagtgggatggancgacggctactaagaactaacgaacncaacgctagtcactacgaacgtacgtcgacggactagtcgtaccgtagtactaacacaagtaacgtactacaaccgtacgacgacaacgacgacctanacgtaggacgtagacggagacgacgtagacgagtcgttacgaacgtcgtaccggtacggttagttttaccgngtacgtacgtagtacggtaatagttaactagttaagtacgtacggtaccgtacgggtcgggacggtaacccggg

SEQ ID NO: 67696 - DNA, 706 bp, Homo sapiens
  misc_feature: GYAE6OF01DCPOO.37.37.D04.1.454.CMB.1.raw
tcagtagtgtagatcacgaccggtgctcgatttagtagcatactgttgggtttggggacccaaaaaccacacccctccttggggagaatcccctagatcacagctcctcaccatggactggacctggagcatccttttcctggtggcagcagcaacaggtgcccatctcaggttcagctggtgcagtctgggagcgtggaggtagaagacgccgtaggacggccctgagttaggaacggttcctcctggactaagggtctttcgtaggtttactaaccgtttagactaatttagtggtatactaacgttgggtcgacgacgaacggtccccgtaggaacgaacggccagtggaggtggagtagggatcggatcgacgtcgtaacttaacaaataaactaacaaccaactaactagtagacaaacgaaggtaaccgttccggaagggaccgtaacggtacgtaccccgaccgtaaccggaacccaacgaacgtaactaacgacctaccgaacggacgaccaacgacgtaccctacgaggtaggacgcgtagggacggtaaccgtcgaagtacgtactacgtacggaaccggtacggtacggttaccggttttaggttaccgtgggacggtaacggtaggtaagtaacgaagttaaagttagttacggtaaacggtacggttaaccgacgggtcggggtaaacccggg

SEQ ID NO: 67697 - DNA, 261 bp, Homo sapiens
  misc_feature: GYAE6OF01CSHLZ.37.37.D04.1.454.CMB.1.raw
  modified_base (249)..(261): a, c, t, g, unknown or other
  misc_feature (249)..(261): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctcgtgggggcacagcggccctgggctgcctggtcaaggactacttccatctacactactgagcgggctggcaaggcgcagtagnnnnnnnnnnnnn

SEQ ID NO: 67698 - DNA, 773 bp, Homo sapiens
  misc_feature: GYAE6OF01AGWIX.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtaggaagaacggccgtcggggcctcgaggtagaacggttcctccgtggacgaaggtctttcgtggtttaacttacctttagactaaattacgtaggttactacgtaacgtggggtcgacggacgaccggccccgtaggacaacggcctagtggaggtggagtgggagtggaactcgacgtcgtacttaacgaaactaactaaccgaactaaccgtaactagtacgaacgtaaaccgtaaggtaaccggttccggaagggtacctaacggtacgtacccacccggtacgaacccgtaacgaacgtactaaccacgtaaccccgaacgaacgaccgaaccgtaaccgaccgttaagacggtacggaccggtacggtacgggaacggacgtaaccgtaaggtaccgtacgttaaccgacggacccgggtaacggtaccgggtttaccggtttacgttacggtacggtcggaacggttaacggaacgttaacggtaaacgttaaagttaacgttaagggtaaccggttcgggaaacccggtttcgggggaaccccgggtaaccggttaaacccgggg

SEQ ID NO: 67699 - DNA, 923 bp, Homo sapiens
  misc_feature: GYAE6OF01BKA5Q.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagcgccaccctctctgcgagggccagtcagagttgtagcagactaacgttacgccgttaggtaaccaagacgaacgaaaaccgtcgggacccgtaacggccttacccccgaacgggtcccttcccgtactaacgtttaccgtaaggttcgggttacgacctacgttaacccccaacccgggaacggggtcccctaacggttacgggttaaccctacccccgaacggtacccgttaaggggtttccgaaggggttcgggaccggtaacggggttcgggggttacccgttaacggggggaacctaacgggttacggtttaccctaacccgttccgttaacccaacccgttaacgtacgtaaccggtacccgtaacgtaccccgttacggacgtaacggttcgttaacggttaaaggtttacgttttacgggttaacgttttaagttttttacgttttacgtcgggtttaactacggttaaccggtaaagtttaaaccgttaaaaccgttaaccgggttaccccggggtacccccggggtttaaacggtttaccccgggaacccggtaaaaccgggggtaaaccccggtaaagggtttaaaaccgggtaaaaaccgtaaaccggtaaaaacccggttaacgggtaacccgggtttacgggaccccgttaggaacccttaaccggtactttaccgtcggttttaacccttccggttaaccccgg

SEQ ID NO: 67700 - DNA, 855 bp, Homo sapiens
  misc_feature: GYAE6OF01DCJFP.37.37.D04.1.454.CMB.1.raw
tcagtagtgtagatcacgaccggtgctcgatttagtagcatactgttgggttggggacccaaaaaccacaccctccttgggagaatccctagatcacagctcctcaccatggactggacctggagcatccttttcctggtggcagcagacaacgaggtcgccctactctacgtacgttacagcgtggtcgctagtcgtgggagtcgtggaggtaagaaggaacggccggtacggggtcctacgtaggtaggtaacggttccgtccgtggtaccgaacggttctttacgttacggttaactttaccgttagtacttaacttaggtaggtactacgtaacggtcgggtacgaccggacgtacccgggacccgtaggaaccgaacggacctaggtagggaaggtgggtaaggtaggggtagtacggtacgtacgtacgggtacctaacgttaaaactaaaacgttaaactaaacaaccgtaaacttaaccttaagtaccggaacctaacggtaaacggtaaaccgttacccgggaacgggtacgaaacggtaccgtaaaccccgtaacccggttaaccaaaccgaacggtaacgaaaccttaaccaaccgtaacccgacgtaactaaaccgaacccgaacgtaaccgttaccgaagggttacggtaacgtacggaagggaccgggtaactcggtaagggaacttaccggtgtaaccggaaacgtacccggttacggtttaccggttttaggttacctagggtacggaacggttaacggtaaataagtaaacgttaattaggttaaacgttaccggtaaggtacccggttacgggtaacgggtaacccggtaaaccggg

SEQ ID NO: 67701 - DNA, 701 bp, Homo sapiens
  misc_feature: GYAE6OF01D1LMR.37.37.D04.1.454.CMB.1.raw
  modified_base (163)..(163): a, c, t, g, unknown or other
  misc_feature (163)..(163): n is a, c, g, or t
  modified_base (194)..(194): a, c, t, g, unknown or other
  misc_feature (194)..(194): n is a, c, g, or t
  modified_base (424)..(424): a, c, t, g, unknown or other
  misc_feature (424)..(424): n is a, c, g, or t
tcagtagtgtagatcacgaccggtgctcgatttagtagcatactgttgggtttggggacccaaaaaccacacccctccttgggagaatcccctagatcacagctcctcaccagtggactggacctggagcattccttttctggtggcagcagcaacgaggtcncccatctcaggttcagctggtgcagtctggncgtggaggtgaagacgccggtgggcctgaggtgaacggtcctcgtgactaaggtcttcgtagttaacttaccgttagacttaattagtgtactacgtaacggtgggtcgacgacgacggtccccgtaggaaccgtaacggacctagtacggtaggtaggaggtacggggatcggactacggagtacgtaacttaacgaaacttaaacgaaacctaaccaactaacgttanaccggaacaacgtaagggtaacccgtaccggaggtacaacggttaccgaccccgtaccgtaacgaacccgagtaaaccgtacaaccgtaacaaccccggaacgaacaccgaacccgtaaccgaaccttaacgacggtacggtaacgcgtaggaccgaggtaccgtagacgtcgacgtccgaacgtccgtaccgtacgtttgtttacgcggtgacggtagtacaagtaatattaggttacgtaacgtcggtaaagtccggtacgggcggtaacccggg

SEQ ID NO: 67702 - DNA, 690 bp, Homo sapiens
  misc_feature: GYAE6OF01C7A4X.37.37.D04.1.454.CMB.1.raw
  modified_base (210)..(210): a, c, t, g, unknown or other
  misc_feature (210)..(210): n is a, c, g, or t
  modified_base (333)..(333): a, c, t, g, unknown or other
  misc_feature (333)..(333): n is a, c, g, or t
  modified_base (443)..(443): a, c, t, g, unknown or other
  misc_feature (443)..(443): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagataccactggaagaaatagtgatgacgcagtctccagcccacctgtctgtcgtcctccgaaggggaaacncgcccaccctctcctgcgacgggccagtcagtagtgttagcagctaacgttcgccgtaggtaccagcaacgaacctggacccaggtccctaccgacggtcctcctactacttctagtcggtcncactcccgaacgaccggtccaacgtcggtactacccgacgccgtaggttcgaggtcggacgtaggtcgggtcgtacgggactagtcgtttaccacgttctaccgacgtanacgacgccacgtccgtacgactacgttacgaagttaagtttacgtttggtactttaaggtttttctttcgtacgtagtaagtacgttaagttaacttaacgtttaccgtacgttacccttcggttaaccggtcggttaaccggttaccgggacgggtaaaccgggtaaccggtaagggtaaacgaaacgttaacggaaaccggtacggttaggtccggtacgtacgacctaccgtgttccgtttacg

SEQ ID NO: 67703 - DNA, 647 bp, Homo sapiens
  misc_feature: GYAE6OF01BNIIO.37.37.D04.1.454.CMB.1.raw
  modified_base (284)..(284): a, c, t, g, unknown or other
  misc_feature (284)..(284): n is a, c, g, or t
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
tcagtagtgtagatcacgaccggtgctcgatttagtagcatactgttgggtttggggacccaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaggtcttcgtggttactacctttagctaattagtggtatcaacgtgggtncgacacggccctggacagccagtgagtggagtgggatggatcgagcgtacttaacaataactaacacacaatangacacgtaagtaacgtccgagggctaggactaccgaccctgaaccanacgtatacatacccgaacgacacctaacacgtacctacgaagtagggactacgtaggacgggacgtccgtagggaacgtacgttacgtacgaaccggtacccgtaccgggttaccggtttacgggttttactcggggtacggtacggtaacggtaaacgttaacggaacgttaaatttaggttaacggttaaggttacgggtaaccgttaccgggttccgggggacccgtaaacccgggggg

SEQ ID NO: 67704 - DNA, 747 bp, Homo sapiens
  misc_feature: GYAE6OF01DPDYA.37.37.D04.1.454.CMB.1.raw
  modified_base (379)..(379): a, c, t, g, unknown or other
  misc_feature (379)..(379): n is a, c, g, or t
tcagtagtgtagatcacgaccggtgctcgatttagtagcatactgttgggtttggggaacccaaaaaccacacccctccttgggagaatcccctagatcacagctcctcaccatggacgtggacctggagcattccttttccgtggtggcagcagcaacgaggtcgcccactctcgaggttcagcgtggtgcagtcgtggagtcgtaggagggtagaaggaacggccggtcggggcctacgaggtacggtaggtcctcgtgacgaggtctttgtacgttacttaacgttagactaagttagtagtactacgtaggtggtcgacgacgaccggccgtacggaacgacggcgtagtggtaggtaggaggtgggagtggacncgtagacttaacgtaaactaaactaactaaaccaactacaacttagaccgtaacgaacggtaaacggtaccggtacggaacggtacgaacgtaacgtaccctacccgtacgaaccgtaacgtaacgtaactaaccgtactaacccgaaaccggacaacgaaccgtaaccgtaccctaagaccggtacgggtacggacgtaagggacggtaccggtactagggacgttacgtaccgaacggacgttaaccgggtaccggtttcggtttattacgggagtacggaaggtaaacgtaaagaagttaacgtaagttaaggttaacggtaaggttcggaaaccggttcgggaccgggtaaccgtaaaccgggg

SEQ ID NO: 67705 - DNA, 597 bp, Homo sapiens
  misc_feature: GYAE6OF01A08BD.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatcctttttcctggtggcagcagcaacaggtgcccactctcaggttcagctggtgcagtctggagctgaggtgaagaagccgtggggcctcagtgaaggtctcctgcaggcttctggttactactttagctaattatggtatcaacgtgggtgcgacgacggcccctggaacaagggccagtgagtggagtgggatggatcgagcgtacttaacaataactaacacacactatacgcacaagtaacgttccgagggcaaggtacgtaccaccctagaacccacaagactaacactacccacgacgaccaacacgtacctacgagtcgggacgcgtaggacgggtacgccgtaggagactcgaacggaccgacgtacgggttacccgtttgtttaccgtggtacgacgtacggtagtaacgagtaatagttagtaacgtgggtactacgggtcgggaccgtaaccgggg

SEQ ID NO: 67706 - DNA, 565 bp, Homo sapiens
  misc_feature: GYAE6OF01EKYN9.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggcccctggacaaggccatgagtggatgggatggatcagcgcttacaataataacacacactatgcacagaagtcgagggcagacgtcaccctgaccacagatacactaccacgagcacacgacctacagtggagcgtagaggacgccgtggaacgtatacgtaggaccgacgtaccgggtccgtttagttttaccgtggtcgacggaaggtagtaacgaagtaaattagtttagtaacgttaggaaccgttaccggtcgggggacccgtaaaccggggg

SEQ ID NO: 67707 - DNA, 833 bp, Homo sapiens
  misc_feature: GYAE6OF01BI29X.37.37.D04.1.454.CMB.1.raw
tcagtagtgtagatcacgaccggtgctcgatttagtagcatactgttgggtttgggacccaaaaaccacacccctccttgggagaatcccctagatcacagctcctcaccatggactggacctggagcattccttttcctggtggcagcagcaacaggtcgcccactctcaggttcagctggtgcagtcgtggagcgtggaggtagaaagacgccggtacgggcctacgtagtagtaacggttcctccgtggacgtaaggtcctttacggttaggtttaacttaaccgtttagacttaaagttacgtaggtactacgtaacggttgggtcgaccgacgaccggcccgtaggaacacggtctagtggaggtaggaggtcgggattacgggactacggacgtaccgttaaacttaaacgaaaagttaaacctaaccgaaccgtaactaactaacgtacggaacctaaacggtaaacggttaacggtacccggaaaggggtaaccctaaggtacccgtaacccgaacccggttacgaaacccgtaacgtaaacggtaacctaaccgtaaccgtaaccccggaaacggaaccgtaaccgtaaccgtaaccgtaaccggtaaccggtacgttaacgggtacgtacgggtaacggacgggtaccggtaacggtacggtaacgtcgttaacggaccggtaaccgaccggttaccgggttacgtttacggttaccgtcgggtacgtacggtaacgtaaagtaacggtaaagtaacgtttaaggttaaacgtaacggttaccggtaacgggtaccgggttaccgggaacccggtaaaccggg

SEQ ID NO: 67708 - DNA, 762 bp, Homo sapiens
  misc_feature: GYAE6OF01C5PEG.37.37.D04.1.454.CMB.1.raw
  modified_base (137)..(137): a, c, t, g, unknown or other
  misc_feature (137)..(137): n is a, c, g, or t
  modified_base (158)..(158): a, c, t, g, unknown or other
  misc_feature (158)..(158): n is a, c, g, or t
  modified_base (188)..(188): a, c, t, g, unknown or other
  misc_feature (188)..(188): n is a, c, g, or t
tcagtagtgtagatcacgaccggtgctcgatttagtagcatactgttgggtttggggacccaaaaccacacccctcttgggagaatccctagatcacagctcctcaccatggactggacctggagcattccttttcnggtggcagcagcaacaggtcncccatctcgaggttcagctggtgcagttcnggagctggaggtgaaagacgcgtgggcctgagtgacggtctcgagacaggtcttacgtaggtttaataccgtttagactaaagttagtggtaattacgaacggttggggacgaccggacgaccgggtccccgttaagggaaacgaaaccgggcctaagtagggaaggttaggagttaggggtattagggactacgaacggcgtaaaccgtttaaacaaacttaaaactaaaccaaccgtaaacgaactttaacgaacggaccaaaggtaacggtaacgtttcccggaaaggggtacaaacggtacccgttaacccgaacccgttaacgaaccgaaacgaacgtaactaaccgtacgaacccgaacgacggaactaacgaacgacccttaagacgtaggacgtacgaggaacggacgtacgttaagacacgttcaaacggaaccgacccggtaacggtttcccgttttaggtttaacgcggtaacgtaacgggaaacggtaataaacgtaagttaaacgtggtttaaacgtaacggacggttaacggacgggttacggggaacccgtaaaccggg

SEQ ID NO: 67709 - DNA, 260 bp, Homo sapiens
  misc_feature: GYAE6OF01BOOX6.37.37.D04.1.454.CMB.1.raw
  modified_base (247)..(260): a, c, t, g, unknown or other
  misc_feature (247)..(260): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnnnnnnnn

SEQ ID NO: 67710 - DNA, 898 bp, Homo sapiens
  misc_feature: GYAE6OF01AMYC5.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtcgtggagcgtggaggtgaaggaacgccgtgggggcctcgacggtagaaggtcctccgtgaccaagggtcctttcgttaggtttaacttacccgttttagaccttaaagtttagtacgggttaataccgtaaacgggttcggggttacgccggaaccggtaaccgggtcccccggttagggaaacccgaacggggtcccctaaaggtttcgaggggttacgggaggttacgggggtacttagggtaacgtacgacgggtaccgtaccgttttaaaacgaacttaaaaccgtaaaccaaccggtaactaaccttaacgttacggaaccgaaacgtaaagggtaaccggtttaacccggaaaggggtacgtaaaccgggtaacgttaccccgtaaccccggttaacggaaaccctaaccgtaacggtaaacctaaccggtaaaccgttaaccccgaaacggtaccggtaaacccgtaaacgtaaccggtaccctaaacggtaacggtaacgggtaaccggtaacgggtacggtaaacgggaccggtaccgttacggaaggtaaccgtaccggaccgttaaccggacgtacccggttacggttaccggtttagtaccgggtaggaaccgtacggtaacgttaacggagttaacggttaacgttacggtaaacgttaccggaaaggttaccgggtaccggggtcgtaaacccgggg

SEQ ID NO: 67711 - DNA, 283 bp, Homo sapiens
  misc_feature: GYAE6OF01BAVP8.37.37.D04.1.454.CMB.1.raw
  modified_base (252)..(283): a, c, t, g, unknown or other
  misc_feature (252)..(283): n is a, c, g, or t
tcagtagtgtagatcacgaccggtgctcgatttagtagcatactgttgggtttgggtgcccaagctgctggagggcacggtcaccacgctgctgagggagtagagtcctgagactgtaggacagcccatcggtcttccccctggcacccctcctccaagagcacctcgtgggggcacgtgcggcctgggctgcctgggtcaaggtactacttccatcctacactactgagcggcgtggcaaggcactagtannnnnnnnnnnnnnnnnnnnnnnnnnnnnnnn

SEQ ID NO: 67712 - DNA, 260 bp, Homo sapiens
  misc_feature: GYAE6OF01C1C9K.37.37.D04.1.454.CMB.1.raw
  modified_base (246)..(260): a, c, t, g, unknown or other
  misc_feature (246)..(260): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggcctgggctgcctggtcaaggactacttccatctacactactgagcgggctggcaaggcgcatagnnnnnnnnnnnnnnn

SEQ ID NO: 67713 - DNA, 722 bp, Homo sapiens
  misc_feature: GYAE6OF01EUBOJ.37.37.D04.1.454.CMB.1.raw
  modified_base (374)..(374): a, c, t, g, unknown or other
  misc_feature (374)..(374): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcattccttttcctggtggcagcagcaacaggtgcccactctcaggttcagctggtgcagtctggagctgaggtgaagaagccgtggggcctcagtgaaggtctcctgcaaggcttctggttacttacctttagctaattatggtatacaacgtgggtgcgacacggccccgtggacaaggccagtgaggtggagtgggatggatcgaggcgtacttaacaaataaactaacacacactatgacanaagtaacgtaccgagggcaagacgtaccaccctacgaaccacagactaacacgtacccgaacgacgacaaccacgtaccctaacgacgtacgggaacgaccgttaggaacgggtaacggccgttaagggaacgtacgttaccggtaacgggtaacccggtaacccgttaaccgggggttacccgttttaacggttttttaaccggtcggggttaaccgggaacggttaaacgggtaaacggtaaacgttaaacgggttaaaactttaagggtttaaacggttaaacgggttaccgggtaaaccggttaaccggggttaaccggggggaacccggtaaaacccgggggg

SEQ ID NO: 67714 - DNA, 645 bp, Homo sapiens
  misc_feature: GYAE6OF01BICRV.37.37.D04.1.454.CMB.1.raw
  modified_base (308)..(308): a, c, t, g, unknown or other
  misc_feature (308)..(308): n is a, c, g, or t
  modified_base (634)..(634): a, c, t, g, unknown or other
  misc_feature (634)..(634): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagcccaccctgtctgtcgtctccgagggggaaaagcgcccaccctctccgtgcgagggccagtcagagtgttagcagcaacttgcctgaccagcagaaacctggccaggcctccgaggcctcctcatctagtggncatccacgacgggcctacgtggtactccccgagccctaggttcaggtcggcgtaggtcggggtacgtcggggactaagggtacgtttcaccgttccgtaccgaacctactccgaagtccaccgaccctcgaccgtaacgttccgtaaaggtaagtttacgttttacgactttaacggtttttaactttccgtaggttactagtactaaaggttacttaacgtttaccgtacggtcccttacgtacggttcggtaccgttcggaccgtaagggaacccgaaggggtacaaatacgaaacggtacgttaggtcggacgtcaccgtacncttccggtacg

SEQ ID NO: 67715 - DNA, 554 bp, Homo sapiens
  misc_feature: GYAE6OF01A5WKP.37.37.D04.1.454.CMB.1.raw
  modified_base (158)..(158): a, c, t, g, unknown or other
  misc_feature (158)..(158): n is a, c, g, or t
  modified_base (183)..(183): a, c, t, g, unknown or other
  misc_feature (183)..(183): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (403)..(403): a, c, t, g, unknown or other
  misc_feature (403)..(403): n is a, c, g, or t
tcagtagtgtagatcacgaccggtgctcgatttagtagcatactgttgggtttggggacccaaaaaccacaccctcttgggagaatccctagatcacagctcctcaccatggactggacctggagcatccttttcgggtggcagcagcaacagcgccnctctgagttcagcgtgtcgatgtgnggancgnggaggtcgaaagnccgtgggcctagagtgacggtntcgancggtancttgntacgtattgctaagtntacggacttgaatgggtncgaacgcggtacccnggacgagntagngngtagngaggngngnagagcgtagtagtaanacacacgacatanacacacgtagtacgacgacgcgacgacacacgacgacgagacgtaacacacacganacgacacgacacgacgtagcgacgagagacgacggacgacgtacgtacgtacgtacgacgtacgtacggtacgttacgtacggtacggtacgtacgacgtacggacggtagtacgtagtacgtacgtagtacggtacggtacggtaggacg

SEQ ID NO: 67716 - DNA, 884 bp, Homo sapiens
  misc_feature: GYAE6OF01C1NB5.37.37.D04.1.454.CMB.1.raw
tcagtagtgtagatcacgaccggtgctcgatttagtagcatactgtttggggttttgggggacccaaaaaccacgacccctccgttggggagaatacccctagagtcacagcctcctcacccagtggacctcggaccttggaccgtccatccttttcctggtggccagcagcaacgaggtcgcccctatcgtactaggttcagctcggtcgcgtagtctaggacgccgtggaggtaggaaggaacgccggtcggggcctacgtaggtacggtaacggttcctaccgtaggaccgtaacgggttccttaccgttagggtttaacttaccgtttttaggacgttaaagttagtaggtactacgtaaacggtgggtgaccgaccgaccggtacccgtaggaccaagtccagtgagtaggagtagggatagggactacgtacgacgtacgttactaaataagtaacacgacttacgtagtacgactaacgtaagtaacggtttaccggacgggacaacggtaccgtaccctacccgtacgtaacccgtaacgtaacgtaacgtaaccgtacggtacccgaaccgggaacgtaaccggaaccgaaccggtacccgtaacgtaacggtacgggtaaccgttacgggtaacgggtaaccggggtaccgttaccggtaaggaaaccggttacgttaacggttaacccggaccgggtaaacccgtaccggggttaaccgttttaacggttttaccggtcgggttacgggtaaccgggtaaacggtaaccggttaaacggaaccggttaaagtttaaccggtttaaggttaaacgggttaaccgggttaaccgtaaccgggggtacccggggtacccggttaaacccccggggg

SEQ ID NO: 67717 - DNA, 606 bp, Homo sapiens
  misc_feature: GYAE6OF01A6J0G.37.37.D04.1.454.CMB.1.raw
  modified_base (456)..(456): a, c, t, g, unknown or other
  misc_feature (456)..(456): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccatctcaggttcagctggtgcagtctggagctgaggtgaagaagccgtggggcctcagtgaaggtctcctgcaaggtcttctggttatacctttagctaattatggtatcaacgtgggtgcgacgacggcccctggacaggccatgagtggagtgggatgggatcgagtcgcttaacaaataaagtaacaaccacaactatagcaacagtaacgttaccgaagggacaggacgtccacccgtagacctaacaacggtataacaactacccaacgacgactaccacgtaccctanacgtacggagtacgtaggaacggtacgccgtacggaagtacgtcgtacgaccggtaccacgggtcgttcgtttacgtgtacggcgtacgtagtaacagtaacttagtaaggtaacgtacggtaagtacggtcgggggaccgtaaccgggg

SEQ ID NO: 67718 - DNA, 794 bp, Homo sapiens
  misc_feature: GYAE6OF01AODVQ.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtcgcccactctcgaggttcagcgtggtgcagtcgtggagcgtggaggtagaagacgcgtcggggcctcgagtgaacggtctccgtgacgaaggtcttcgttggttacttaccgtttagactaatttagtggttactacgtaacggtgggtacgacgaacgaccggtccccgtagggaaccgacggtaccgtagtcgggagtagggaggttggggagtacgggtactaccgaacgtccgtaacgttaaagaaaacttaaactaaacccgaacgtaactaaccttaaggtaccgtaactaaaccggtaaagtaaccggttacccgaaagggtaaccctaagtaccgtccgtaaccgtacgaacctaacggaatacctaacgtacacccgacgaacgtacgaccgtaaccgtaccgttaaacgaggtacgggacgttaacgtacgggagggtacgtcccggtaaggacgtaacgtccggttaacggaacccggttaccggtaccggggtttaccgtttagtttaccgggcggtaaccggtacggtaaagtacggttaaactaagggtttaactttaagtttaacggtacggttaaccggaggtttaacgggtacccggggaaccggtttaaccccggg

SEQ ID NO: 67719 - DNA, 251 bp, Homo sapiens; identical to SEQ ID NO: 67542
  misc_feature: GYAE6OF01A5106.37.37.D04.1.454.CMB.1.raw
  modified_base (247)..(251): a, c, t, g, unknown or other
  misc_feature (247)..(251): n is a, c, g, or t

SEQ ID NO: 67720 - DNA, 720 bp, Homo sapiens
  misc_feature: GYAE6OF01B1L9O.37.37.D04.1.454.CMB.1.raw
  modified_base (238)..(238): a, c, t, g, unknown or other
  misc_feature (238)..(238): n is a, c, g, or t
  modified_base (401)..(401): a, c, t, g, unknown or other
  misc_feature (401)..(401): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtcgtggagctggaggtagaagaacgccgtgggcctgagtgaaggtctccgngcgaaggtcttcgttaggttacttaccgtttagactaattatggtatacaagtgggtgcgacgaccggtccctaggaaccgaaggccgtagtaggtaggtacggagtagggactgggactcgaggtacgtacttaaactaaataaacaactacaacaacgtanagaacaacgaagtaacgtacgaggtacacgtactaccgaccgtacgaaccacaacggtaactaacgactaacccgaacgaacgaccgtaacgacgttaccctaacgtacgtacgggacgacgtagggaggaccgtacgaggtaacgtacgtaccgtacggaacccgaaggttacccggttacgttttacggtttaacgttcggtaacgggtaacggtaacgtaaacggttaaaccggtagtaaaacgtttaacggttaagttaaacgggttacggtaaccggttaacccggggtaacgggtacccggttaaacccgggg

SEQ ID NO: 67721 - DNA, 745 bp, Homo sapiens
  misc_feature: GYAE6OF01C5RP7.37.37.D04.1.454.CMB.1.raw
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagcgtggtgcagtctggagcgtggaggtgaagacgccgtgggcctcgaggtgaacggtctcctgcgaacggtcttcgtggttacttaccgttagactaatttagtggttactacgaaacgtggggtacgacgtacacgggtccccgtaggaaccgtaagggcctagttagggaggtagggtaggtacggggagttagggacgttacgaggtaccggtaacttaaactaaataaaacgtaaccaacctaactaaccgttaatacggaactaaacgtaacggtaacggtttacccggaggggacaacggtacgtaccccaacccgtacgaacccgtacgaacgtaacgttaacaccgtaacccgaacggactaaccacgacaccgtaacgagtacggacgtcgaggaacggtcggccaggtaagtaccgtacgtaggaacccggtaacgtacccgggttacggttttcgtttacggcggttaggaaccggtaaggtacggtaaactagttaaacgttagttaaggtaagtacgggtaaccgttacgggtacggggtcccggtaaaccgggg

SEQ ID NO: 67722 - DNA, 840 bp, Homo sapiens
  misc_feature: GYAE6OF01CWQCI.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttccgtggtggcagcagcaacgaggtcgcccactctcaggttcagctggtgcagtcgtggagctggaggtagaagaagccgtggggcctcgagtggaacggtcctccgtgacgaaggtctttcgttaggttaacttaccgtttagacttaaatttagtaggtaattaccgaacgttggggtacgaccggaacgaccgggtcccccgtagggaaccgaacgggtacccgaagtaggtaaggtgggtaacggtaggggtagttagggacgttacgaacgggtaccgttaacctttaaaacgaaaacttaaaacgtaaaccaacctaaacctaacctttaagaccgtaaccgaaaccgtaaacggtaaccggttacccgggacggggaacgtaaacggtaccgtacccccgtaacccggtacgaaacccgtaacgtaaactaactaaaccgtaccgtaaccccgaaacggaccgaaccgaacctaccggacccttaaacggagtaccggggaagtccggtagggaacgggtaccgtccgtaacggaacgtacgtaccggtacggaacccgggtaaccgtacccgggttcgttttaacggttttcggaggttacggaacggtagggttaacctaagtaacgttaaagttaagttacgtaaaaggtcggaaaccggtttacggggacggggtaacccggtaaacccgggg

SEQ ID NO: 67723 - DNA, 580 bp, Homo sapiens
  misc_feature: GYAE6OF01E0W4V.37.37.D04.1.454.CMB.1.raw
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagcctggggcctcagtgaaggtctcctgcaaggcttctggttatacctttagctaattatggtatcaactgggtgcgacgaggcccctggacaaggccagtgaggtggagtggggatggatcgagcgacttacaataatacaacacactatgcanagaagtcgagggnagatcaccngaccacagatacactaccaacgngaccaacacgcctaacgagtgacgngtcggaggacgcgtagagtaacgtcgtacggacgacgtaccgggtaccgttacgttttacgtggtacgacgggtagtaagttacggtaacgtaaacgttagttagtaaacgttagggtaaacttacgggtcggggacggtaaacccggggg

SEQ ID NO: 67724 - DNA, 739 bp, Homo sapiens
  misc_feature: GYAE6OF01C8IKA.37.37.D04.1.454.CMB.1.raw
tcagtagtgtagatcacgaccggtgctcgatttagtagcatactgttgggtttgggaccaaaaccacaccctcttgggagaatccctagatcacagctcctcaccatggactggacctggagcacttccttttcctggtggcagcagcaacaggtcgccactctcgaggttcagctggtgcgagtcgtggagtcgtaggaggtagaaggacggtccgtcgggcctgaggtggaggtctccgtgacgtaggtcttacgtggtttactaccgtttagactaagttagtacgtatacgtacggtgggtcacggacgccggtaccccgtaggaaccgaacgggtcctagtagggtaggtaggtacggtgggtaggttaggactacggacggtacgttaacctaaataaacttaaacgtaaccaacaacctagtacgtacacgaaacgacggttaacgacgggacgacgtaacgtaccggtaccacccggtaacaaccgtaacgaacgtaaccgtaacaaccgtacgaaccgacgaccgaaacgtacggacccttaaggagttaggacgggtactagggaaccggtactacggtaacggactaacgttacggaacggaaccgttacggtacccgggttacgtttgttaacgggtcgaaggtccgtaaagggtactaagtaaggttaaacgttagttaacgtaacgggtacgtacggtaacggtaggggtaccccggtaacgggg

SEQ ID NO: 67725 - DNA, 700 bp, Homo sapiens
  misc_feature: GYAE6OF01C54PM.37.37.D04.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (623)..(623): a, c, t, g, unknown or other
  misc_feature (623)..(623): n is a, c, g, or t
tcagtagtgtagatcacgaccggtgctcgatttagtagcatactgttgggtttggggacccaaaaaaccacacccctccttggggagaatcccctagatcacagctcctcaccatggactggacctggagcatccttttcctggtggcagcagcaacaggtgcccactctcaggttcagctggtgcagtctggagctgaggtgaagagccgtgggcctnagtgaaggtcncctgacaaggcttctggttattacctttagactaattataggtatactaacgtggggtagaccgacgacggcccctgggaccgtaaggccaagtggaggtagggacgtggggattggggacttcgaacggcgtaacttaacgaaataaactaacgacaacgactaagtcacgaactacggaacgtttccgaagggtcgaagtaccgtaccctacccgttacgaaccgtaacgaacgtaactaacgtaccgtaacccgaacggaacggtaccgaaccgtaaccgtacccgtaaacgtacggtacgggtacggtacgtacggggaaacggtacgccgtaaggtacgtacgttacgtacgaacgggtaaccgtacgggtcgtttacggttttacgnggttacgacggtacgtagtaacgtaagaacttagttacgtaacgtacggtaacgttacgggcgggtaccgtaacggg

SEQ ID NO: 67726 - DNA, 658 bp, Homo sapiens
  misc_feature: GYAE6OF01B8P14.37.37.D04.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtcgtctccgaggggaaancgcccaccctctcctgcagggccagtcagagtgttagcagctaacttagccgtacggtaccagacgaacgaaacctggaccaggccctaccgaggcctccnctactctagtggtcaccactcccgacgcggcctacgtaggtaccncccgagccgtaggttcgaggttcggacgtagggttcgggtacgtacggacgagtacgttacaccgttacaccacctactacgacgacgtacgccgtcggacgtacgtcgtaaggtacgttatttcggtatttacggttttatttcgtcgtacgtagtacgttaagtttaacttaacgttacgtacgttacccttacgttaccgggtacggttaaccggttcggaacccggtaaagggtaccgtaaagggtacggtaaactaccgggtaaataccggtgtaccgtagtaccgacgtactcgtcgttcg

SEQ ID NO: 67727 - DNA, 269 bp, Homo sapiens
  misc_feature: GYAE6OF01AQRBW.37.37.D04.1.454.CMB.1.raw
  modified_base (227)..(227): a, c, t, g, unknown or other
  misc_feature (227)..(227): n is a, c, g, or t
  modified_base (250)..(269): a, c, t, g, unknown or other
  misc_feature (250)..(269): n is a, c, g, or t
tcagtagtgtagatcacgaccggtgctcgatttagtagcatactgttgggtttgggtgcccaagctgctggagggcacggtcaccacgctgctgaggagtagagtcctgaggactgtaggacagcccatcggtcttccccctggccaccctcctccaagagccacctcgtggggcacagcggcccgtgggctgcctggtcaaggactacttccatctacactactgngcgggctggcaaggcgacagtgnnnnnnnnnnnnnnnnnnnn

SEQ ID NO: 67728 - DNA, 768 bp, Homo sapiens
  misc_feature: GYAE6OF01CUZFZ.37.37.D04.1.454.CMB.1.raw
  modified_base (208)..(208): a, c, t, g, unknown or other
  misc_feature (208)..(208): n is a, c, g, or t
tcagtagtgtagatcacgaccggtgctcgatttagtagcatactgttgggtttggggggagaactgctcagttaggacccagacggaaccatggaagccccagcgcagcttctcttcctcctgctactctggctcccagataccacgtggagaaactagtgatgacgcacgtctccacgcccacctgtctgtgtcctcgaagggaaanacgcccaccctctcctgccgacgggccagtcaggagtgttagcgagacaacttcgccttaggtaccagcaacgaaaccgtggaccaggcctacccgacggtcctccctcatccgtagtcggtcaccactcccaacgacgggccctaggtcggtacctcccgaggaccgtacggtttcaggttcggacgttacgggttcgggtacgtcggggaacctaaggtaccgtttaccgaaccttaccgtacccaacccgtagttcccgaaccgaccgtaccggtcccgtacgggtacccgtaacggttacgtaggttaaacgtttgttttaccggactttaaggttttctttcggttacgtacgtacgtacgttaaacgtttaacgttaacgtttcccgggtcgttaccccttacccggttaacgggttacgggtacccggtttacccgggacccgggtaaacgggtaacccggtaaaggggttaacgaaaccgttaaccggtaaaaccggtacgtaccggttacggtaaccttaacccgacttaccggttccgttccgtttaccg

SEQ ID NO: 67729 - DNA, 713 bp, Homo sapiens
  misc_feature: GYAE6OF01BRZ0H.37.37.D04.1.454.CMB.1.raw
  modified_base (505)..(505): a, c, t, g, unknown or other
  misc_feature (505)..(505): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtagaagaagccgtgggcctcgagtgaaggtctcctgacaacggtcttcgtggttattacctttagactaattataggtatacaacgtgggtacgcgacgacgcccgtaggacaaggccagtacggtaggtggtagtgggagtggatcgagtcgtacttaacaattaaacaacacctaacgactagtacgacaacgaagttaacggtaccgaggggactaaggtaccgtacccgtaccctacggtaacccaacgaacgtaactaaccgactaacccgtaacgacgaccaacgccgtaacctaacgngtaacggtacgacgtaacgggacgaacgcgtaggactatccggaacgtaccgtaccgggtaccggtttccggttacgttttacggtcggtaggtaccgggttaagtaaaccgggtacgttaaaggttaacgttaggtttaaacggtaacggttaaccgggttaaccggtttacggggcccgggttaaacccggggttaaaccccgggg

SEQ ID NO: 67730 - DNA, 1005 bp, Homo sapiens
  misc_feature: GYAE6OF01C57LT.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtggggcctcgagtagaaggtcctcgtgcgaaggtcttcgttggttacttaccttttagactaatttagtacggttatacgtaaccgttgggggtacgaccggaaccgtaccgggtacccccgttagggaaccgaaacgggtaccctaagttagggaggtttagggaaggttgggggaagttagggtactaccgacggtccgtacttaaaccgtaaaattaaaactaaccaacaaaccgtaactttaacgacgacgtaaaccgtaaacgggtaaccgtttaccgggaacggggtacgtaacggtaacgtaccccgtaacccgttacggaaccccgtaaacgacgtaaaccgttaaccctaaccgggttaaccccgaacgggtaaacccgtaaacccgaaacccggtaacccggtaacccgttaaaccccgtaaacggttaaccggggtaacggtaccccgggtttaagggggaaaccgggggttaccgtacccgggttaacggtaaaacggtttacccggtttacccgggtaacccggtaaacccgggggtaaaccccggtttaccccggggggttttaccgtttttaaacccgggggttttttacccggttaaaccggggtttacggggaaaccccgggtttaaagggtaaaccggttttaaacccgggtaaaaggtttaaaacgggtttttaaacgtttaaacgggttttaaacgggttaacccgggttttaccgggttaaaaccccggggggtttccggggggttaaacccccgggttaaaacccccggggggg

SEQ ID NO: 67731 - DNA, 665 bp, Homo sapiens
  misc_feature: GYAE6OF01DSXJL.37.37.D04.1.454.CMB.1.raw
  modified_base (377)..(377): a, c, t, g, unknown or other
  misc_feature (377)..(377): n is a, c, g, or t
  modified_base (450)..(450): a, c, t, g, unknown or other
  misc_feature (450)..(450): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattcctttcctggtggcagcagcaacaggtgcccatctcaggttcagctggtgcagtctgggagtctggaggtagaagagccgtggggcctcaggtgacggtcctcgtgactaaggtcttgtaggttacttaccgtttagactaattgtaggttactactaacggtgggtcgacgtacgaccggtcccgtaggaccgaacggcctagtggacggtggagtgggattggacttacgagtcgtacttaanaaactaacgaactacactaacgtagcgtaccgaatacggtaacgtacggagaccgtagtactaccgaaccgtnaaccgagaacgtacacactccgaagtacacgtacgactccgtaagcttacgggactcgtacgaccggtagtcgtagaacgttgtaccgtacgggaacccgtcggtaaccggtttcggtttacggttagtccggaggtacgaacggtacggttacgaaattacggttaacgttagttaacggacgtaagtcccgggtaggggtcgtaaacccgggg

SEQ ID NO: 67732 - DNA, 625 bp, Homo sapiens
  misc_feature: GYAE6OF01B00KJ.37.37.D04.1.454.CMB.1.raw
  modified_base (205)..(205): a, c, t, g, unknown or other
  misc_feature (205)..(205): n is a, c, g, or t
  modified_base (309)..(309): a, c, t, g, unknown or other
  misc_feature (309)..(309): n is a, c, g, or t
  modified_base (457)..(457): a, c, t, g, unknown or other
  misc_feature (457)..(457): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngcccaccctctcctgcgagggccagtcagagtgttagcagcaacttgcctggtaccagcaagaaacctggccacggctcccgaggcctccgtcatctagtggtncactcccgacgcgggcctacgtcgtactcccagccgtaggttcaggtcggcgtagggttcgggtcgtcgggactaggtacgttaccaccgtcctacacctataccgaggccgtacgtccgtggacttacgtaccgtagtaaacgtttnttttacggacttaaggttttacttacgtcgttaacaacgtaacgttaactaagttcggtaccgtcgttcccttcgttccgtacgggtttccggacgggtaacgggtaccgtaagggtgaacgtagtaacgaaacgtcgtggtacggtactcgaccacgtcgtgttacg

SEQ ID NO: 67733 - DNA, 781 bp, Homo sapiens
  misc_feature: GYAE6OF01D3CTA.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcgaggttcagcgtggtgcgagtagtggagcgtggaggtagaaggaagccggtggggacctcgaggtggaacggtcctaccgtgacgaagtcgtttcgttaggtttaacttaccgtttaagacttaaagtttagtacggtaactaccgtaacggttggggtcgaccggtaacgacccggtcccgtagggaaccaacgggccgtagtacgggaaggttggaggtgggatggactcgagtcgtactaagaaataacgtaaacacaactatagtacgacaacgaacgtaacggttcccggaaggacgaacggtacgtacccgtaacccgtacgaaccgaacgtaacgtacgtaacgaacctacccgaacggtacgaaccaaccgaccgtaccgtacgtaacggtacggacgtacggtagggaacggtacggtaccggaggtacgtacgtacgtaaccgggtaaccgtaacccggttaccggttaccggtttaacggttttcggtacgggttaccggaacgggtaacggtaacgtaaacggtaaagttaacgttaacgttaaggttaacggtacggtaaccggttacggggtaccgggtaccccgggtaaacccgggg

SEQ ID NO: 67734 - DNA, 633 bp, Homo sapiens
  misc_feature: GYAE6OF01AGA8N.37.37.D04.1.454.CMB.1.raw
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctctgcaaggcttcgtggttataccttagctaattntggtactcaacgtgggtncgacncggccccgtggacaaggccagtcgagtggagtggggatggatcgaggtccgtactttaacaaattaacgtaaccaccgtaactaactatgaacacaaggtaacgttaccgaagggtcagacgtccaccctagacccacagactacactaccgaacgacgacctaacgacgtacccttaagagtacggacgcgtaggacgggactccggtagacgtactaccggtacggaccggtaccgtaccgggttaccgtttacgtttacgtggtacgtacgggaggtagtaacgtagtaagttagttaagtaacgtacggtaacgttacgggtcgggtaccggtaacccgggg

SEQ ID NO: 67735 - DNA, 645 bp, Homo sapiens
  misc_feature: GYAE6OF01B33JI.37.37.D04.1.454.CMB.1.raw
  modified_base (289)..(289): a, c, t, g, unknown or other
  misc_feature (289)..(289): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctccgtgcaaggtcttcgtggttactacctttagactaattagtggtatcaacgtgggtncgacacggcccctaggacaggcagtggagtggagtgggatgggactcgagtcgtacttaacaaataactaacacaactaactatagaccaacgaagtaacgttccggaagggacaacggaacgtacccacccgtacgacccaagaacgtaataccaactacccgaacgacgaccaaccgaccgacctaacgagtacggacgtcgtagggaacggacgtccgtaaggacgtacgtacgtacggaaccgaccgtaccgggtcttttacggtttactggtacgacggtacggtacgtaagtaagtagttaagttagtaaggttacgtaacggtacgggttcgggacccggtaaccgggg

SEQ ID NO: 67736 - DNA, 653 bp, Homo sapiens
  misc_feature: GYAE6OF01E5HVX.37.37.D04.1.454.CMB.1.raw
  modified_base (141)..(141): a, c, t, g, unknown or other
  misc_feature (141)..(141): n is a, c, g, or t
  modified_base (157)..(157): a, c, t, g, unknown or other
  misc_feature (157)..(157): n is a, c, g, or t
  modified_base (527)..(527): a, c, t, g, unknown or other
  misc_feature (527)..(527): n is a, c, g, or t
  modified_base (596)..(596): a, c, t, g, unknown or other
  misc_feature (596)..(596): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttccnggtggcagcagcaacnggtcgcccactctcaggttcagtctggtgcagtcgtggagctggaggtgaaggaggccgtgggcctcagtgaggtctctgacgtcttcttgttattacttatactattagtagtacgtactacggtagggtcgcgacgaccgtcccgtcggacgaaggccgacgtggaggttaggacggtaggggtacgtaggtacgtacggacgtacgtaacttaaacaaattaaactaaaccacgtaacctagtaactacgaacaacgtaacgaacggttacgacgggacacgtacgtacccgaccacgaccacgacaacgtacaaccacgaacacgacctacggaacgcccgtaagcggtagaacgtcgtagggacncgtacgagtaccagtccgtaacggtcgaaccggtcggttacgttcgttagctagggactaggtagtaanaggttataagtttaggacgttacgggaccgtaggggccggtaacgacccgggttccg

SEQ ID NO: 67737 - DNA, 975 bp, Homo sapiens
  misc_feature: GYAE6OF01AP4KC.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccagtggactggacctggagctattcctttttccgtgggtggcaggcagcaacgaggtcgcccactctcgaggttcagcgtgggtgcagtcgtgggagcgtggagggtagaaggacggccggtaggggtcctgaggtacggaacggttcctccgtggacgtaaggtcgtttcgttaggtttaactttaccgtttagacttaagtttagtggttaactacgtaacggttggggcgtaccggacgtaccgggtacccgtaggaaccgaacggtaccgtaggtacgggtagggtacgggtaaggtaggggagttgggacttaccggacggttacgtaaacctttaaagaaaataaacctaaaccgtaactaacgtaaccgttaaggttaccgaaccgtaaacggtaaacgggttaaccgggtttacccgggaacggggtaccgtaaacgggtaaccgtaacccggtaaacccggtaaccggaaaccctaaccggtaaaacggtaaccttaaccccgaacgttaaaccccgggaaaccggtaacgaaacccgtaaccggtaacccgttaaccgttaacggaacgggtacgggtaacgcgggttaaccgggaaggtacccggtcggtaacggttaggtaacccgttaaccgggaccggttaaacccgggggccggtttaaccggttttaccgggtttaacgggtttaaccgggtggggtaaacccgggttaaagggttaacgggttaacggttaaaccggttaacggtttaaaaacgtttaaccggggtttaaacggttacgggttaacccggggttaaacgggttacccgggggttaaacccggggtaaacccggggtaaaccccggggg

SEQ ID NO: 67738 - DNA, 873 bp, Homo sapiens
  misc_feature: GYAE6OF01AU7HK.37.37.D04.1.454.CMB.1.raw
  modified_base (139)..(139): a, c, t, g, unknown or other
  misc_feature (139)..(139): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcnggtggcagcagcaacaggtgcccactctcaggttcagtcgtggtgcagtcgtgggacgcgtaggacgggtagaaacggaacggtccggtagggggcccttacgagggttacggtaacgggttccttccgtaggaccgtaacgggttcctttaccggttagggttttaaccttaacccgttttaagaacctttaagttttaagtacggggttaacttaccgtaaacgggtttcggggtacgaccggtaacccggtaccggggtccccgttagggaaaccgtaacggggtccctaggttacgggtacgggtgggtaacgggtagggtacgtagggtctacggtacggacgttaccttaaaacggtaaataaaaccgtaacgaactaaccgtaagttaagtaccgacgaaaccgtaaggttaaccggtacgggaacgggtaactacggtaaacgtccccgaacccgttacgaaccgtaacgaactaacgtaaccacgtaacccgacggtacaaccgtaccgactacccgtacgacggtacgtacggtacgacggtaggacgcccgtaagtaccggtaacgttaccgggaccgtaaccgggtaccggttacccgggttaggttaacgtttccgggttacggtcgtaacgggtaaacgtaacgtacgtaaaagttacgttaagttaaacgggtgttaaccggtacgggttaaccgggtcgggaaacccgggttaaccgg

SEQ ID NO: 67739 - DNA, 825 bp, Homo sapiens
  misc_feature: GYAE6OF01CXJYR.37.37.D04.1.454.CMB.1.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
tcagtagtgtagatcacgaccggtgctcgatttagtagcatactgttgggtttgggggaggaactgctcagttaggacccagacggaaccatggaacgccccagcgcagcttctcttcctcctgctactctggcctcccagataccacgtggaagaaatagtgatgacgcagtcctccacgccctaccctgtctgtcgtcctccggaagggaaacnccgcccacccgtctccgngacgacggtccaagtcgaagtaacgtgttacgcgtacgtcctacgttacgccgttacggaaccaacgacgacggtaccgacggcccgaccggaccccgacggtccctccgtactaccttaccttacgtccgtctccgtcccgttccccgtaggtaccggccctacgtccggacctaccgtacccgtaccggtccgtaacggtcgtaacgggtccgggtaacgtggtaccgggttacgtacggtaacggtaccttaaccggtccgttaaccctaccgttaccctaccgtaaacctctaccgtacgtaaccgtacggttaacccgtaaggaccgtaaccgttaggtttaaacgttcggttttacctaactttagtttacttccgtaacgtacgtaaaccgtacttaccggtctaacccgtaccggttacccggtacgggttacccgtaccggtacgggtaaacccggttaacgggtaacgtaaaccgggtttaccggtttaacccgttaacccgggtaagggttaccttcggggtccgttactaaccccggtacctaacttccgttaccggttttctaaccgttttacccccg

SEQ ID NO: 67740 - DNA, 874 bp, Homo sapiens
  misc_feature: GYAE6OF01BVCIN.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgctagtctggagcgtgaggtagaagagccgtgggcctcgagtgaaggtctcctgacaggtctttcgtggtttataccgtttagctaatttacgtgggttaactaccgaacggttgggggttacgaccggtaccgaaccgggtccccccggttaagggaaccgtaaaccggggccgtaagtacgggtaggttacggggaggttacggggtacttaggggaacttaccgtacgggtaccgtaccgtttaaaactaaaatttaaaacctaaaacctaaacgtaaaccctaacgttaaacgtccgaaccctaaacggtaaaacggttaaaccggttaccccgggaaacgggggtaccgtaaacggtaacccgggtttaccccaaccccccggttaacgggaaacccccgtaagtaaccggtaaacccgttaaaccccgtaacgttaacccccgaaacggtaacccggaccaaaccccggaacgtacccccgttaaacgtaaggtaccgggaacggtccggttaacggggaacgggtaaccggtcccgtaagggaacgttaacgtccggtaaccgaccgggtacgtaacccggttcgtttacggtttaccgtggtaaccggcggtaagtagtaacgaagttaaagttctaagggttaacgtacgggactttacgggtcggggtaccgtaacccgggg

SEQ ID NO: 67741 - DNA, 761 bp, Homo sapiens
  misc_feature: GYAE6OF01BE2QE.37.37.D04.1.454.CMB.1.raw
  modified_base (537)..(537): a, c, t, g, unknown or other
  misc_feature (537)..(537): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtcgcccactctcaggttcagctggtgcagtcgtggagcgtggaggtagaagaacgtccgtcggggcctcgaggtagaacggttcctccgtggacgtaacggtcctttcgttaggttttaacttaccgttttaagacttaaatttagttagggttacttacgaacggttgggtcgacggaccgtaccggtccccgtaggaaccgacggtaccgagtaggtaggtagggtaggtaggggtagtgggaacgttacgaacggtaccgtacgttaaaccaaaattaaaactaaaccaacgtaacgaacttagtaacgactaacggtaaacgtaaccgtacggtaacggggcgaacgtaccgtacctaccgtaacgaccgtaanacgtaacctacaccgtacgaaccgacgaccacgacgtacgtacaggtaggacgtacgtacggaggtacgacgtagtaaggtaccgtacgtacggaaccgaccggtacgttcggtttaacgtttcgagggtacggacgtaaggtaaggtaacgtaaagttaacgttagttaagttaacggttaccgggtaacgttaacggggaccggggtaggtaaaccccgggg

SEQ ID NO: 67742 - DNA, 729 bp, Homo sapiens
  misc_feature: GYAE6OF01C7QYM.37.37.D04.1.454.CMB.1.raw
  modified_base (141)..(141): a, c, t, g, unknown or other
  misc_feature (141)..(141): n is a, c, g, or t
  modified_base (459)..(459): a, c, t, g, unknown or other
  misc_feature (459)..(459): n is a, c, g, or t
  modified_base (709)..(709): a, c, t, g, unknown or other
  misc_feature (709)..(709): n is a, c, g, or t
tcagtagtgtagatcacgaccggtgctcgatttagtagcatactgttgggtttggggaacccaaaaaccacacccctccttgggagaatcccctagatcacagctcctcaccatggactggacctggagcatccttttcgnggtggcagcagcaacaggtcgcccactctcaggttcagcgtggtgctagtcgtggagctggaggtagaaagaagccgtggggcctagaggtagaacggtctccgtagaccgaaggtctttccgtaggttaacttaacgtttacgactaaagttaagttggtaactcgtaaacgtggggtacgacggaaccgacggtacccccgtagggaacgaaacgggaccgtagttaggaggttaggaaggtaggggagttagggacttacgacggtacgactttaaaacgaaaataaaacgtaacaaactaacgtaacttagacncgtaactaaaggtaccgtacgagggtacaggtacgtacccaccgttacgaaccaacgataacacgtaacctacgaacgacgaccaacgtacggtaccctaaagacgtaggacgtcgtaaggacgtacgacgtaggaacgtaacgttcgaacggtacgaactacccgggtacgtttaggtttacaggtataccggaagtaataacgaaggttaacttaggttacgttaaggtaacgacggtttaaccgggngggtaccgtaaaacccgggg

SEQ ID NO: 67743 - DNA, 748 bp, Homo sapiens
  misc_feature: GYAE6OF01AINWH.37.37.D04.1.454.CMB.1.raw
  modified_base (206)..(206): a, c, t, g, unknown or other
  misc_feature (206)..(206): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctccagataccacgtggaagaaatagtgatgacgcagtcctccagcccacctgtctgtgtctacgaagggaanacgccaccctctccgtgcgaggtccagtcgagagtgttagacagacctaacgttagcctagggtaaccagacaaaccggtaaccgtcggccacggccctaccgacgtccctcctacattcctagtcgtactcgtcccgtaccgacggtacggcctacggtacgacctacccgtccgaaccgtccggtacggttacggacgtcggacgttacggtcgggtactaggaacgtaaccgtacgtaaccgtttcctaaccgtcctaccgactaacgtcgacgtaccgtagtaacgtaggtaccgtacttaaggtaacgtttcgtttaccgaacctttagtttaccttaactcgtaacgtaacccgtaactacggtaccgttaaacctaccgttaaccggttcggtaacccgggtttacccggtaacccggaaaacggggttaaccggtaaaccggtttacgttaaccggtttaccgtttaacccggtaacggtaacgttgggttacccgtacgtacccgacgtacccttgttacccttggttacccc

SEQ ID NO: 67744 - DNA, 910 bp, Homo sapiens
  misc_feature: GYAE6OF01CHGH0.37.37.D04.1.454.CMB.1.raw
  modified_base (212)..(212): a, c, t, g, unknown or other
  misc_feature (212)..(212): n is a, c, g, or t
tcagtagtgtagatcacgaccggtgctcgatttagtagcatactggttgggtttgggggaggaactgctcagttaggacccagacggaaccatggaagccccagcgcagtcttctcttcctcctgcctactctggcctccagatacccatggagaaaatagtgatggacgcagtctccagcccacctgtctgtcgtctaccgaaggggaacncgccctaccctctccgtgaccgacgggcctagcaggtagtgttacgcagactacgttacgccttaggaaccagaccgaagtaaacccgtgggacccgacggccctacccggaggtcccctcctactaacgtttaccgttaaggtcgggttaccgaccgtaccgtaccccgaaaccgggcggggtcccctaacgtttaccggggtacccctacccggaacgggtaccccgttaggggtttaccgaaggggttcccgggtagggttacggggttccggggtttacggggacgggaaaccgtttacgggttaaccctttccgaacccgtttacccgaccgaaaccttccgtaacgaccggtccgtacgtcccggtagtaccgtaacggttagttacggtaaacgttttagtttacggttaccgttttaaggtttttacttacggtttacggttacgttaacggttaaccgtaatttttaaacccggttaaccgttttaacccgggtaccggtttaacccgtttaccgggtttaaccggttccgggggtaacccgggttacccgggtaaccgggtaaaaacgggtaacccggggtaaacgggttaaaaccggtaaacggttaaaccccggtaaacggttaaccgggttaggtacccgggtacgtaaccgttaaccaccgtttaacggtcccgttttaaccgg

SEQ ID NO: 67745 - DNA, 840 bp, Homo sapiens
  misc_feature: GYAE6OF01AEY5M.37.37.D04.1.454.CMB.1.raw
  modified_base (160)..(160): a, c, t, g, unknown or other
  misc_feature (160)..(160): n is a, c, g, or t
  modified_base (165)..(165): a, c, t, g, unknown or other
  misc_feature (165)..(165): n is a, c, g, or t
  modified_base (660)..(660): a, c, t, g, unknown or other
  misc_feature (660)..(660): n is a, c, g, or t
tcagtagtgtagatcacgaccggtgctcgatttagtagcatactggttggggtttggggacccaaaaaccacacccctcttgggagaatccctagatcacagctcctcaccatggactgggacctggagctatccttttcctggtggcagcacgcaacgnggtcncccactctacgtagggttcgcgtcggtgtcgacgtcgtggaggctcggtagggtaggtaacggaacggtccggtcggggtccggtacgtacggtagggtacggtacgtccgtacggtacgacggtacgttcgttcggtttacgtttaacctttacgtataacgtttagttaggtacgtacgtaacggtagggggttcgacccacggtaccggtaccgggtacgaaacgggaacgtccgtagtaggtagggtacggtaggtacgggggatacgttacggacgacgtacgtaacctttaaagaaacctaaacgtaacccaacgacctaactttaacgtcgaaccccggtaagtaaaaccgggtcggtttaaccgggaggggtacgagtttaaacccgaccctcccggtaaaccgacgaacgtaacgtaaccgtaaccaaccgtaccgaacggacgtacaaccgtaacgtaccctaagtacgggtacggtacgggtanaacggtacgggtaacgtaccggttgaaccggtataaccgggacgtaacccggtcggtaccggttacggttccgttacggcggtaaccgtggtaacggtcggtaaattaacgaggttttaggtaccggttagtacccggggtaacgtacggggttcccggaaacggtccgttaacccgggg

SEQ ID NO: 67746 - DNA, 353 bp, Homo sapiens
  misc_feature: GYAE6OF01DBB97.37.37.D04.1.454.CMB.1.raw
  modified_base (161)..(161): a, c, t, g, unknown or other
  misc_feature (161)..(161): n is a, c, g, or t
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (253)..(256): a, c, t, g, unknown or other
  misc_feature (253)..(256): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (262)..(267): a, c, t, g, unknown or other
  misc_feature (262)..(267): n is a, c, g, or t
  modified_base (269)..(270): a, c, t, g, unknown or other
  misc_feature (269)..(270): n is a, c, g, or t
  modified_base (272)..(353): a, c, t, g, unknown or other
  misc_feature (272)..(353): n is a, c, g, or t
tcagtagtgtagatcacgaccggtgctcgatttagtagcatactgttgggggtttgggtgcccaagctgctggagggcacggtcaccacgctgctgagggagtagagtcctgaggactgtaggacagcccatcggtcttccccctgccaccctctccaagngcacctcgtggggcacagccggccctgggntgcctggcaaggactacttcatctaanactgngacggcggctaggacgaaggcacagtacgnnnnancnannnnnnannannnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67747 - DNA, 639 bp, Homo sapiens
  misc_feature: GYAE6OF01CH029.37.37.D04.1.454.CMB.1.raw
  modified_base (279)..(279): a, c, t, g, unknown or other
  misc_feature (279)..(279): n is a, c, g, or t
  modified_base (494)..(494): a, c, t, g, unknown or other
  misc_feature (494)..(494): n is a, c, g, or t
tcagtagtgtagatcacgaccggtgctcgatttagtagcatactgttgggtttgggacccaaaaaaccacacccctccttgggagaatcccctagatcacagctcctcaccatggactggacctggagcatccttttcctggtggcagcagcaacaggtgcccactctcaggttcagctggtgcagtcgtggagctgaggtgaagaagccgtgggcctcgagtgaaggtctccgtgacaaggtcttcgtggttacttactttagctaattatggtactnaacgtgggtgcgacacggccctggacgaacggccagtgaggtggagtgggactggatcgacgtcgtacttaacgaaataaactaaacacaactaactagtagacaagagtaacgttccgagggacagaacgtccaccgtcgaaccgacaagactaactaactcccgaacgaacgacaacgacaccgtaacacgtaggacgtcgtaggacggtacncgtagaagacgtcgtacggaaccgtaccgtacggttaccgtttacgttttacgtacgtcggacgtaaggtaacgttacgtaagtaattaagttaacggtaaacgtacggtaccgtttacgggcgggtacccgggttaaacccggg

SEQ ID NO: 67748 - DNA, 832 bp, Homo sapiens
  misc_feature: GYAE6OF01C1S90.37.37.D04.1.454.CMB.1.raw
  modified_base (196)..(196): a, c, t, g, unknown or other
  misc_feature (196)..(196): n is a, c, g, or t
tcagtagtgtagatcacgaccggtgctcgatttagtagcatactgttgggtttggggacccaaaaaccacacccctccttggggagaatcccctagatcacagctcctcaccatggactggacctggagcatccttttcctggtggcagcagcaacaggtcgcccactctcgaggttcagctggtgctagtctggnctgaggtagaagagccgtgggcctcgagtaggaggtctaccgtgacgaaggtcttacgtaggttaactaccgtttagactaaagtttataggtaactacgtaacgtggggtacgacgaccgaaccgggacccttagggaaccaacgggtccaaggttggaggtaggaggtaggggacttggatacgaagtaccggtacttaaacgaaacttaactaaaaccactaaccgtaacttaacgtacgtaaccgtaaacgaaacgggtaaacggtttacccggaaaggggacctaaacggtaacccgttaaccccgaaccccgttacgaaaccccgtaaacgacggttaaacctaaccgtaaccgttaaccccgaaccggaacggaacccaaccggaacgtacccgtaacgtaacggtagggaaccgtcggtaagggaaccggaccgtacgtaacggtagtaccgtacggtaaccgtaacggtaccggttacccggttaacgggtttacgttttaacggcgggttaagtaccgggtaaacggtaacgttaaaccggtaaagttaacggttaagtttaacggtaaacggtttaccggaaaccgggttaaccggggtcggggtaacccgttaaaacccggggg

SEQ ID NO: 67749 - DNA, 693 bp, Homo sapiens
  misc_feature: GYAE6OF01ETS6D.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtgggcctcgagtgaaggtctccgtgcaaggtcttcgtggttataccgtttagactaattagtggtatcgaacgtgggtacgcggaacgacgggtacccccgtagggaacaacggcctaagtcggaggtgggagtggggagtggatcaggtccgtacttaacgaaataactaaccgaacaactaactaactcgtaccaagtaacggtaacggttaccgagggactaaggacgtacccacccgtacgaaccacgaagaacttacactacccaagacacaccagtaccctaacgtagcggacgtacgtaggaaccgggcgtaccgtaggtaacgcgttacgacggtaccggaacccgtaccgggtcccgtttagtttacgtcggtacgggtacgtaacggaaccggttacgaaaggttaactttaggttaacggtttaacggtaggtaaaccggttcgggtaccggggtaacccgtaaacccggggg

SEQ ID NO: 67750 - DNA, 800 bp, Homo sapiens
  misc_feature: GYAE6OF01BU7MD.37.37.D04.1.454.CMB.1.raw
tcagtagtgtagatcacgaccggtgctcgatttagtagcatactgttgggtttggggacccaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctctgcaaggcttctggttataccttagctaattatggtaatctaaacgtgggttcgacgacgtaggcccccttggaacctaacgggccaagttggaaggttcggtaagtggggaacgtcgggaattccgaggccgtacgttaaacaaaacgttaaacttaaaccgtaaccgaacgtaacccgttaagtacggacctaaacgaaggtaaacgtttcccgaaaggggtcaaacggtaggttacctaaccccgttagaacccgaactaacgtaaccgtaactaaccgttacccgaaacggtacggaaccggactaaccgaccgttaaccgaacgttacggggaaccgtaccgtagggtaaccgggacgtaccggttaacggtaacggggacctttacggaaccggtaaccggtaacctaccggggtacccggtttttaggttttaaaccggtccgggtttaacggccggtaaacgggtaaacgggttacaacgggttaaaccgttaagttttacgggttaaaacgttacgggtaaaccctttaacgggtcgggggtaacccgtaaaacccggggg

SEQ ID NO: 67751 - DNA, 673 bp, Homo sapiens
  misc_feature: GYAE6OF01B578I.37.37.D04.1.454.CMB.1.raw
  modified_base (370)..(370): a, c, t, g, unknown or other
  misc_feature (370)..(370): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcgagtgaaggtctcctgcaaggtcttctggttactacctttagactaattataggtatacgaacgttgggtcgacgacacggtccccgtaggaaccgaaggccagtggtaaggtggtaagtggggtaatgggatccgaagcgtacttaaanaaaataaactaaacaacaactaactatacgacaacaagtaacgttaccgaagggacaaggtacgtaccacccgtacgaaccacgaagactaacactacccgaacgacgaccaacacgtacccgtaaagacgtaggacgtacgtacggaaggacgaccaggtaacgtacgttacgacggtaaccgaaccgtaccgggttccgtttagttttaaccgtggtacgacgaaggtaacgttaagaaacgtaactttaagttaaggtaacttaggtaacccgttacgggtcgggacccggtaaaccggg

SEQ ID NO: 67752 - DNA, 659 bp, Homo sapiens
  misc_feature: GYAE6OF01CTIT1.37.37.D04.1.454.CMB.1.raw
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (485)..(485): a, c, t, g, unknown or other
  misc_feature (485)..(485): n is a, c, g, or t
  modified_base (508)..(508): a, c, t, g, unknown or other
  misc_feature (508)..(508): n is a, c, g, or t
  modified_base (559)..(559): a, c, t, g, unknown or other
  misc_feature (559)..(559): n is a, c, g, or t
tcagtagtgtagatcacgaccggtgctcgatttagtagcatactgttgggtttgggacccaaaaccacacccctccttggagaatcccctagatcacagctcctcaccatggactggacctggagcattccttttccgtggtggcagcagacaacaggtgcccactctcaggttcagctggtgcagtctggagctggaggtagaagagccgtgggcctgagtgaggtctctgacgagcttatggttatacttagactaattgtaggtaatacgaacgtgggtacgacgacgaccggccccgtaggaactaacggaccaatggaaggtggaagtgggaatggactacgaaggtccaacttaacaaaataacaacgtaacaactaacttagtacacgaaacgtagtaaccgttacgaaggacgaagtaccgtaccaacccgtnaacccgaanaagtaactaacaactccaaacggtacacccgtaanaacgtacctaacgtagtacggancgttaagggacgacgtacgtaaggacttacgtaccaggacccgtaaccggngtccggttttaaggtttacaggttacggcgtaaagtacgtaagactaaagtttcgtaaggtaccgtaggaccggttacggcggggtaaccgtaaaccggg

SEQ ID NO: 67753 - DNA, 828 bp, Homo sapiens
  misc_feature: GYAE6OF01CBA60.37.37.D04.1.454.CMB.1.raw
  modified_base (163)..(163): a, c, t, g, unknown or other
  misc_feature (163)..(163): n is a, c, g, or t
  modified_base (759)..(759): a, c, t, g, unknown or other
  misc_feature (759)..(759): n is a, c, g, or t
tcagtagtgtagatcacgaccggtgctcgatttagtagcatactgttgggtttggggacccaaaaaccacacccctccttgggagaactcccctagatcacagcctcctcaccatggactggacctggagcatcctttctggtggcagcagacaacgaggtcncccacgtctcgaggttcagcgtggtcgcgtagtcgtggacgcgtaggacggtagaacggaacggccgtacggggacctcgaggtacggtaacggttcctaccgtagaccgtaacggttctttcgttacggtttaaccttacgtttacgacttaaacgttagttaggttaactaccgtaacggttcggggttacgaccggtaaccgtaccggtaccccggtaggtaaaccgacggtacctaggtaggtaggtaggtaaggtgggtaacgttaggaccgtaccgtacggtacccgttacgttaaaaccgtaaaacgttaaacgtaaacccgtaacctaaccgtaacgttaacgttacgaaccgttaacgaaacggttaccgttaaccggggaggtaacgacgtaccgtacccgtaacccgtacgaacccgtaagacgtaaacctaccgtaacgtacccgtaaccgaacggtaacccaaccggtaaccgtccgtaaaacggtacgtacgggaccgtacgttagggaaccgaccgtttaccgaggtaacgtcgtacgggacggttaacccgcggtttaccgttaggttaccgtttacggngtacggtaagacgtaagtataagttcgtaagttggaacgtacggacgttacgggcgggtaacacccggg

SEQ ID NO: 67754 - DNA, 807 bp, Homo sapiens
  misc_feature: GYAE6OF01CG0B1.37.37.D04.1.454.CMB.1.raw
  modified_base (161)..(161): a, c, t, g, unknown or other
  misc_feature (161)..(161): n is a, c, g, or t
  modified_base (166)..(166): a, c, t, g, unknown or other
  misc_feature (166)..(166): n is a, c, g, or t
tcagtagtgtagatcacgaccggtgctcgatttagtagcatactgttggggtttggggacccaaaaaccacacccctccttgggagaatcccctagatcacagctcctcaccatggactggacctggagcattcccttttccgtggtggcagcagcaacgnggtcncccatctcgtaggttcagtcgtagggtgctagtcgtgggacgcgtaggaggtagaaggacgtccggtcgggtcctcgaaggttacggaacggttccttccgaggaccgtaaggttcctttacggttaggtttaacttactttagacttaagttacgtgtactacgtacggttggacgtccgacgtaccggtcccgtaggaacgacggtacctagtacggaggtaggaaggtcgggtagtaggtacgcgtaacggtaccgtaacttaaacgtaaattaaactaaccgactaaccgttaagttcgaccggactaaacggtacgttaaaccgtaccggagggtacaaacgtaccgtacccgtaaccgtacgaacccgtaaggtcctaactaccgtaacgaacccggaacgaccgaacgtaccgtaccgtaacctaacggtgtaacgggacctaggtaccgggaatacgtccgtaaggacttacggtaaccggtacggtaacccgggtactaccgggggtttcctttttaacggtaccggttgggtaacccgtaaaggtacggttaataacgttaaggttaactttacgggttaagaaaccgggtttggaccccggtttaacgggccggggtaacgtacccccgg

SEQ ID NO: 67755 - DNA, 835 bp, Homo sapiens
  misc_feature: GYAE6OF01CGG71.37.37.D04.1.454.CMB.1.raw
  modified_base (632)..(632): a, c, t, g, unknown or other
  misc_feature (632)..(632): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctggaggtagaagtaagccgtggggcctcgaggtgtaaggtcctccgtgacaaggtctttgtaggtttacttaccgtttagacttaaagtttagttggtaacttacgtaaaccggttggggttacggaccggtaaccgtaaccggtccccccgttagggaaaccgtaaacggggtcccgaagttacgggtaaggtaggggaaggtttaggggaacgttagggaacttcgtaacgggtaccgttaccgttaaacaaaagtttaaacaaacctaacgtaacctaaccgtaagtaccgaactaacgtaaacggtaacggttacccgaggggtactaaggacgttaacccacctacgaaccgtacgaagaacctaacaacgtacccgaaacggacgacaacgtaccaacctacgtaaggtaggactaccggaggtaaccggnggtacccgtaagtacggtacgttacggaaccggaccggttaacggtcccgggttaacgttttcggttttacgacggttccgggtaacgggttaacggtaaaggtaaccgtaaaggtttaaagtttaacgggtttaaacggttaaacggttcccgggttaaacggtaacggggtacccgggggttacccgggtaaaacccgggg

SEQ ID NO: 67756 - DNA, 579 bp, Homo sapiens
  misc_feature: GYAE6OF01A7JOH.37.37.D04.1.454.CMB.1.raw
  modified_base (397)..(397): a, c, t, g, unknown or other
  misc_feature (397)..(397): n is a, c, g, or t
  modified_base (439)..(439): a, c, t, g, unknown or other
  misc_feature (439)..(439): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttactacctttagctaattatggtatcaactgggtgcgacacggcccctggacaaggccagtgagtggagtgggatggatcgagcgacttaacaataataacacacactatcgacacgagaagttccgagggcagacgtccaccgtgaccanacgatacactaccgacgacgacacacgacctacgagtcggancgtagaggacgtccgtagacgattcgtacgaccgacgtaccggtccggttagttttaccgtggtcgacgaggtacgtaacgagtaaattagttacggtaacgttacggtaccgttacgggtcggggacccgtaaccgggg

SEQ ID NO: 67757 - DNA, 868 bp, Homo sapiens
  misc_feature: GYAE6OF01CUUFF.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagctattccttttccgtggtggcagcagcaacaggtcgcccactctcgaggtcagtctggtgcagtcgtggagtctggaggtagaaagacgccgtgggcctgaggtagacggtctacgtgacaggtcttcgtggttacttaccgttagactaattagtaggtatacgtaaggtggtacgacgtaccgacggccccgtaggaaccgtaacggccgaggtcggaggtggaagtggtaacgtgacgtcgacggtacctacttaacgtaaaattaaactaaaccgtaacctaacgtaacttaacggacgtaaaccgtaaacgtaaacgggttaaccggttaccgggaaggggtaacccgtaacggtaacctaaccccgtaacccgtacgaaccccgaaacgaaccgtaacctaaccggtaaaccctaacccggtaacccggaacgaacctaaacccgtaccggtaaccgtaacgtaacgggacggtaacggtcgtaacggggttacggaccgggtaccaggtaaacggtacccgtaacgtacgggaaccccggttaacgggtacccggtttacccgttttaagggtttaccggttaccggttcgggtaaacgggtaaaggttaaacccgggggttaaattaaagggttaaaccgtttaaaacggttttacgggtaaacgggttaccgggttaaacccgggtaacgggggttaaccccggggtaacccgggggttaaaaccccgggg

SEQ ID NO: 67758 - DNA, 602 bp, Homo sapiens
  misc_feature: GYAE6OF01EUXM9.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtgggcctcgagtgaaggtctcctgcaaggtcttgtggtttatacctttagactaattataggttatcgtaacgtggtgcgacgacggcccctaggacagccgagtggagtggagtgggagtggatcgagacgtacttaacaataactaacacacactatcacacgaagtacgtacgacgagagtacgaccacgtaccacgacagtacacgtaccacgacgacgacacgacctactagtacggacgactacgagggacgcgcgtaaggcgtacgtacgacgaaccggtacgtaccgttacgtttcgttgtaggtacggagtaacgtaagtaaggtaagttagttagttaacgttaggtacgttagggtacgggacggtaaccggtaacccgggg

SEQ ID NO: 67759 - DNA, 672 bp, Homo sapiens
  misc_feature: GYAE6OF01A4QMM.37.37.D04.1.454.CMB.1.raw
  modified_base (194)..(194): a, c, t, g, unknown or other
  misc_feature (194)..(194): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
tcagtagtgtagatcacgaccggtgctcgatttagtagcatactgttgggtttggggacccaaaaaccacacccctccttgggagaatcccctagatcacagctcctcaccatggactggacctgagcatccttttcctggtggcagcacgcaacacggtgcccactctcaggttcagctggtcgcagtctggngctgaggtgaaacggagccgtgggcctcgtaggtgaacggtctccgtgccaagggtccttcgtaggtttacttaccgtttagacgtaattatggtaatccaacggtgggtgcgacacggcccctggaactaggccagtgaggtgagtcgggaatggtatcgagcgtactacaaataacgtacacaacactagngacacganaacgttccgaggactagactaccacccgtacgacccagacgactacgactaccgaacgacgtacaaccgacgtaccctacgaagtacggacaccggtgacgggtaacgtcgtacggaagtctacgtacggaaccgtaccggtaaccgggttcccggttacggttttacgtaccgtagggtacgtaaacggtaacgtaacgtaaagtaaacgttaacgtttaacggaaacggtttcgtaacgggtaccggtttacggggaaccgttaaaccccggggg

SEQ ID NO: 67760 - DNA, 793 bp, Homo sapiens
  misc_feature: GYAE6OF01DSYWB.37.37.D04.1.454.CMB.1.raw
  modified_base (159)..(159): a, c, t, g, unknown or other
  misc_feature (159)..(159): n is a, c, g, or t
  modified_base (167)..(167): a, c, t, g, unknown or other
  misc_feature (167)..(167): n is a, c, g, or t
  modified_base (191)..(191): a, c, t, g, unknown or other
  misc_feature (191)..(191): n is a, c, g, or t
  modified_base (453)..(453): a, c, t, g, unknown or other
  misc_feature (453)..(453): n is a, c, g, or t
  modified_base (490)..(490): a, c, t, g, unknown or other
  misc_feature (490)..(490): n is a, c, g, or t
  modified_base (634)..(634): a, c, t, g, unknown or other
  misc_feature (634)..(634): n is a, c, g, or t
tcagtagtgtagatcacgaccggtgctcgatttagtagcatactgttgggtttggggacccaaaaccacacccctccttgggagaatcccctagatcacagctcctcaccatggactggacctggagctatcctttcctggtggcagcagcaacaggtncccactcnctaggttcagctggtgcagttcgnggacgctggaggtagaagacgccgtgggcctcgagtagacggtctaccgtagaccgtaaggctttacggttaggtttaacttaccgttttaagactaagttacgtagggtactttaccaacggttggtacgaccgtacgaccgggtccccgtagggaaccgtaacggcctaagttcggaaggtaggtagtaccggggtagttaggacgttcacggtacctacgttaaaacaaagttaaacttaaaccaacgactaacggtanaccgtaaccagtaaccgtaacgttccgaaaccggggnttaacggaccggtacctaacccccggagtaacccacgtaagaccgttaaccaccggtaacaacgttaacgaaccaacggttaactaaccgttaacgagttacggaacgttcggtaaacggtcggaacgtcgtaaccgggttaanaccggttactaaccggtaacaccgggttacccggttaaccgtttcgttaacccgtagggttaccgagtaacgggtaacggaacgtaaagggttaccttaagtttacgggaaacgtttcgggaaaccgtttaccgggaaacgggtccgggtaaaacccgg

SEQ ID NO: 67761 - DNA, 573 bp, Homo sapiens
  misc_feature: GYAE6OF01BJG00.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctctgcaaggcttctggttatacctttagctaattatggtatcaactgggtgcgacaggcccctggacaaggccatgagtggagtgggatggatcagcgcttaacaataactaacaacacactatgacaacagtaacgttccgagggcagagtccaccctgaccacagactacactcccaacgagaccaacgacgacctaacgagtcggacgcgtaggacggacgtccgtagagactcgagacgacgtaccggtcgttagtttacgtgtacggacgtacggtagtacgtagtaacgttacgtttagtaacgtacggaacttacggtcggggtaaccggtaacgggg

SEQ ID NO: 67762 - DNA, 660 bp, Homo sapiens
  misc_feature: GYAE6OF01EP361.37.37.D04.1.454.CMB.1.raw
  modified_base (264)..(264): a, c, t, g, unknown or other
  misc_feature (264)..(264): n is a, c, g, or t
  modified_base (481)..(481): a, c, t, g, unknown or other
  misc_feature (481)..(481): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctgggaaaacgtgaggtgaagaagccgtggggcctcagtgaaggtctctgcgaggcttcgtggttattaccgtttanctaattatggtatactaacgtgggtgcgacgacggccccgtaggacgaacggctagtggaggtggagtgggatggagtcgagcgtacttaacaaactaaataaccaacaccatactacgacaacgtaacgtaacgttaccgagggacaggaccgtaccacccgtacaaccaacaacgtactacaccctacgacggtacacctacgactacccgtaanacgtggaccgtgtacggacgggtagacccgttagaaccgtgtaccgtacggaccgtaacccgagggttcccggtttaagtttccgtagggttacgacggtaagaacgtaagtaagttaattaggttaaccggttaagtacggttaaccgtacggggtaccgggcggttaaaccccgggg

SEQ ID NO: 67763 - DNA, 617 bp, Homo sapiens
  misc_feature: GYAE6OF01AJKUA.37.37.D04.1.454.CMB.1.raw
  modified_base (332)..(332): a, c, t, g, unknown or other
  misc_feature (332)..(332): n is a, c, g, or t
  modified_base (361)..(361): a, c, t, g, unknown or other
  misc_feature (361)..(361): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcgtgcaaggcttcgtggttatacctttagacaattatggttatcgaacgtgggtgcgacgacggcccctggacaggccatgagtggagtgggatggatcgngcgtcttaacgaataataacacacactangacaacgagacgttcgaggcagacgtacaccctgaccacgagatacactaccgaacgagaccgacacgtcctaacgagtacggagtcgtagggaacggacgtacccgtagggtaactagtccgtaacggacccgaacggtaccgggttaccggtttacggtttaccgttaggacggtacggtagtaacggaagtaaagtaattagttacggtaaacggttcgggaaccttacgggtcggggtaccggtaaccgggg

SEQ ID NO: 67764 - DNA, 672 bp, Homo sapiens
  misc_feature: GYAE6OF01D6MPF.37.37.D04.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagataccactggagaaatagtgatgacgctagtctccagcccacctgtctgtgtctacgaggggaaacncgccaccctntcctgcgaggccagtcagagtgtagcagacaattcgctaggtaccagcaagaacctggaccaggtcctccgaggcctccgtacattacctagtggtcnctacgtcccacgacggtcctacgtcggtactccccgagtccgtaggtcaggtcgcgtacggtggtacgacgggaactacggtacgttaccaccgttacctcaactacgtaccagtacccagtcccgtacgtaccctaggttaccgttagaaacgttttacgtttaggtacctttaaggtttttacttacgttcgtacaacgttacgtaaagttactttaacgttaccggtcccgggtacccggttacgttccggaaccgtaacgggtaccgtaaagggtaaccgtaaagtaaccgtaaacgtacgagggttcaccggtacgtacccacggttactaccgttcttccgtccgtacccg

SEQ ID NO: 67765 - DNA, 737 bp, Homo sapiens
  misc_feature: GYAE6OF01BLTC0.37.37.D04.1.454.CMB.1.raw
  modified_base (142)..(142): a, c, t, g, unknown or other
  misc_feature (142)..(142): n is a, c, g, or t
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (584)..(584): a, c, t, g, unknown or other
  misc_feature (584)..(584): n is a, c, g, or t
tcagtagtgtagatcacgaccggtgctcgatttagtagcatactgttgggtttggggaacccaaaaaccacacccctccttgggagaatccctagatcacagctcctcaccatggactggacctggagcattccttttccgnggtggcagcagacaacgaggtcgacccactctcgtaggttcagtcgtggtacgctagttcgnggacgngtggaggtacgaagaacggcggtacgggctcgaggaggtacgtcctaccgagacgacgttcttacgtagttacttaccgttagacttaagttagtaggtactacggtaacggtcgggtacacggtaccggaccggtacccggtaggaaccggtacgggtacctaaggtagaggggtaggtacggttagggtaacgtgggaaactcgtaacggtaccttaattaaaaccgtaaataaaccgaacgtaaccaacgttaactacgtaacgacgtaaacggtaaacggttacggtaaccggaacgggaacgtacgtacccgtacctaaccgggaccgttaacaagtaccgactaaccgtacaccgacgtacgaccganaccgtacgaacggttagtacgaccgtagaacggcggtacacggagtacgtaggacaccggtcgaccggtacgttgttaacgttaggcgtaagtacgaagtacgtaggtaactaagttacgtagtacgacgtaggtacggtccggaacggtacg

SEQ ID NO: 67766 - DNA, 737 bp, Homo sapiens
  misc_feature: GYAE6OF01DGJIP.37.37.D04.1.454.CMB.1.raw
  modified_base (132)..(132): a, c, t, g, unknown or other
  misc_feature (132)..(132): n is a, c, g, or t
  modified_base (152)..(152): a, c, t, g, unknown or other
  misc_feature (152)..(152): n is a, c, g, or t
  modified_base (292)..(292): a, c, t, g, unknown or other
  misc_feature (292)..(292): n is a, c, g, or t
  modified_base (573)..(573): a, c, t, g, unknown or other
  misc_feature (573)..(573): n is a, c, g, or t
  modified_base (590)..(590): a, c, t, g, unknown or other
  misc_feature (590)..(590): n is a, c, g, or t
tcagtagtgtagatcacgaccggtgctcgatttagtagcatactgttgggttgggacccaaaaccacaccctccttgggagaatccctagatcacagctcctcaccatggactggacctgagcatcctttcnggtggcagcagcaacaggtncccactctcaggttcagctggtgcagtctggagctggaggtagaaagacgccgtaggggcctagaggtagaacggtcctcctaggcaaggtcttcgtggttacttacctttagactaattagagttatacgaagtggtanacgtaccgacggtacccctaggaaccgaaggtccgagtacggtaaggttgggagttaggggtactagggtactacgacggtacgtaccttaaacgaaacgttaaaataaccgtaacaaccgtaacgtttaacacggtactaaacgtaacggtaacgtttacccggagggtaccaaggtacggaccctaaccgttcgaaacccaagtacggaaacttaccgaacgttacccgaaccggtacgtaaccgacgtaaccgtaacccgtagtaaacgtcgggaacncggttagaccgggtacnccgtagacgtactcgaacgtaccgaacgttaccgggtcgttaacgtttgtaccggtagacggaacgttaagtacgtaaaggtaaacgtttagttaacgttacggtaaacggtacctaacggggtccgggaacccgttaaacccgggg

SEQ ID NO: 67767 - DNA, 326 bp, Homo sapiens
  misc_feature: GYAE6OF01D9U09.37.37.D04.1.454.CMB.1.raw
  modified_base (307)..(326): a, c, t, g, unknown or other
  misc_feature (307)..(326): n is a, c, g, or t
tcagtagtgtagatcacgaccggtgctcgatttagtagcatactgttgggtttgggtgcccaagctgctggagggcacggtcaccacgctgctggaggagtagagtcctgaggactgtaggacagcccagtccggttccttcccccgtggcctacccctcctaccaagacgccaccgtcgtcgggggacacgacggccgggcccgtggggcctcggtcccgttgggtacaaacggtaccttacctttaccacttcctaaccacgttacgtggacggccgggtcgtacggacgaacgggcgacatagnnnnnnnnnnnnnnnnnnnn

SEQ ID NO: 67768 - DNA, 246 bp, Homo sapiens
  misc_feature: GYAE6OF01CFM4P.37.37.D04.1.454.CMB.1.raw
  modified_base (168)..(168): a, c, t, g, unknown or other
  misc_feature (168)..(168): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (241)..(246): a, c, t, g, unknown or other
  misc_feature (241)..(246): n is a, c, g, or t
tcagtagtgtagatcacgaccggtgctcgatttagtagcatactgttgggtttgggtgcccaagctgctggagggcacggtcaccacgctgctgaggagtagagtcctgaggactgtaggacagcccatcggtctccccctggccaccctcctccaagagcacctcgnggggcacagcggcctgggctgcctgcaagctactccatctacactacngacgcggctggacgaagcgacangnnnnnn

SEQ ID NO: 67769 - DNA, 869 bp, Homo sapiens
  misc_feature: GYAE6OF01EQY8K.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtcgcccactctcaggttcagctggtgacagtctggagcgtggaggtagaaacggaaggccggtcggggccttcggaggttaggaacgggttcctcccgtggaccgtaagggtccttttacgttacgggttttaactttaaccccgttttaagaccttaaagtttagttcgggttaacttacgtaacggttcggggttacgacggaccgaaccgggtccccgtaaggtaaccggaacggtccaaggttcgggtagggttacgggacggttaggggaagtttacggaacgttaccgacgggtaccggttaaaccttttaaacggaaaaacttaaaaccgtaaacctaaaccctaagttaaacgttaacggaccgaaactaaccggtaaacggttaaaccggttacccggacgggggaaaccttaaggtaaccggtacccgtaaccccgtaccgtaaacccgaacgtaaccgtaacgtaaccgtaaccgtaacccgaaccgggaaccaccgaaaccgtaaccgtaccgttaaccgaacgtacgggacgtaacgtacggaacggacggtcgtacgacgtacgtacgaccggtaacgtacccggtaccgggttacgtttacgtttacgggtcgtacggtacggtaacgtacgtaagtaattaagtagtttaacggaacgttacggtagtaacgggtccgggtacggtaacccggg

SEQ ID NO: 67770 - DNA, 642 bp, Homo sapiens
  misc_feature: GYAE6OF01EO10X.37.37.D04.1.454.CMB.1.raw
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
  modified_base (430)..(430): a, c, t, g, unknown or other
  misc_feature (430)..(430): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaacggtctccgtgacaaggtccttcgttggtttacttacctttagactaattagtggtactacgaacgttgggtcgacgacgacggccccgtaggacaacggcctagtggaggtggagtgggatggatcgagcgtacttaanaaataataacaacacactatnacacgaagtaacgtcgaggacaggtactccaccgtagaccanacgtactacactaccgacgacgacacgaccgtactacagtcggacgcgaggacgacgccgtaggacgtacgtacgacggaaccgtaccggtacggttccgtttcggtttacgtggtacggacggtacggtaagtaacgaaagttaacgttaagttaacggtaacggttacgggaaccggttacgggtacccggggtacccggtaaaccgggg

SEQ ID NO: 67771 - DNA, 626 bp, Homo sapiens
  misc_feature: GYAE6OF01ARXD9.37.37.D04.1.454.CMB.1.raw
  modified_base (394)..(394): a, c, t, g, unknown or other
  misc_feature (394)..(394): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagcaattatggtatcaactgggtgcgacaggcccctggacaacggccatgagtggagtgggatggatcagcgacttaacaataataacacacaactatcgacacagtaagttcgagggcagacgtcaccctgaccanagatacactaccgaacgacgcgacacgtccctaacagtacggacgtacgtacgtaagggacgcccgttagaggtacgttcgtaaggaccgtaaccggtaaccgggtccccggttttagttttaccgtgggttacggaccggtaacggtaaggtaacgtaaagtaaagtttaagttaggttaaacggttagggtaaacgttacgggttcgggggtaacccgtaaaccgggggg

SEQ ID NO: 67772 - DNA, 704 bp, Homo sapiens
  misc_feature: GYAE6OF01BXOHT.37.37.D04.1.454.CMB.1.raw
  modified_base (231)..(231): a, c, t, g, unknown or other
  misc_feature (231)..(231): n is a, c, g, or t
  modified_base (345)..(345): a, c, t, g, unknown or other
  misc_feature (345)..(345): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccatctcaggttcagctggtgcagtctggagctgaggtgaagagccgtggggcctcagtgaaggtctcgngcaaggcttcgtggtatacctttagctaattatggtatcaacgtgggtcgcgacgacgggcccctggaacagggccagtgaggtggagtgggagttggatcgagcgtacttaanaagttaaacgtaaaccacaaacgtacttagagaccaacgtaaggtaacgttcccgaagggacaaggtacgtacccaacccgttacgaacccgaacgtaacgtaacgtaaccgtaaccgtaacccgaaccggaacgaaccgtaacccgaaccggttaaccctaacggtaacggttacggaaccgtacggtagggtaaccggtaacggcccgtaagggtaacgtacgtcggtaacgacggtacccggtacggttcgttacgttttagccggtaggaacgtaggtaactaacggtaagttaacgttaagttacggtaaacgttacgggaaaccgtggggtacccgggaaccgtaacccgggg

SEQ ID NO: 67773 - DNA, 704 bp, Homo sapiens
  misc_feature: GYAE6OF01DKE10.37.37.D04.1.454.CMB.1.raw
  modified_base (526)..(526): a, c, t, g, unknown or other
  misc_feature (526)..(526): n is a, c, g, or t
tcagtagtgtagatcacgaccggtgctcgatttagtagcatactgttgggtttgggacccaaaaaccacacccctccttgggagaatcccctagatcacagctcctcaccatggactggacctgagcatccttttcctggtggcagcagcaacaggtgcccactctcaggttcagctggtgcagtctggagctgaggtgaagaagccgtggggcctcgagtgaagtctcctgcaggtcttcgtggttataccttttagactaattagtggttactacgtaaacgttggggttgaccgaacgacggcccccgtagggaccaaagggcctaagtggaggtgggagtggggatggatcgagacgtacttaacgtaaataaactaacacaactactaatgaacacgaagaacgttccgagggcaaggtacgtaccaacccgtagaaccctaacacgaactaacaacgtacccaacgaacggaccaaccgacgtacccgtaacaggtaggacgtcgtacgggacgggaacnccggttaaggaaccggtagtaccggaacggtaaccgacccgggtaccggtccggttttacgtttacggtgggttaggtacgggtaaacggtaagttaaacgtaaaggttaaacgttaagttttagggtaacgttaaacgggtagttaaccggggtcggggtaacccggtaaaccgggg

SEQ ID NO: 67774 - DNA, 796 bp, Homo sapiens
  misc_feature: GYAE6OF01DVASC.37.37.D04.1.454.CMB.1.raw
  modified_base (515)..(515): a, c, t, g, unknown or other
  misc_feature (515)..(515): n is a, c, g, or t
tcagtagtgtagatcacgaccggtgctcgatttagtagcatactgttgggtttggggacccaaaaaccacacccctcttgggagaatcccctagatcacagctcctcaccatggactggacctggagcattccttttcctggtggcagcagcaacaggtcgcccactctcgaggttcagcgtggtgctagtcgtggagcgtgggaggtaggaaaggaacggtcccggtcgggggtccctacgtaaggtacggtaaacgggttcctccgttaggaccgaacgggtcgttttacgttggtttaacgtttaacccgttttaggactttaaaagtttaagttagggttaacttaccgtaaacggttggggttacggaccggaaccggtacccgggtacccgtaacgggaaccggaacggtacctaggtaagggtagggttagggaggttaggggaggtacggtagtacggtaacgacgttaacttaaacgaaataaactaaccgaactaactaacgtanacgacgaaagacgtaacgtacggagacgagtacctacaccgtacgaacaacgatactacgaccgtaccagacgacaacgactacgtagaggtacgagtaggaggagaccgtgtaggaatcgttacgaaccgaaccggtacgggttaccgttcggtttaaggtttacgacgggtaggtaacgtaaacgggtaagttaacggttaaagttacgttaagggttaaacgttaggttaaccggggaccgggtttacggggtaccgggtaacgggttaaccccgggg

SEQ ID NO: 67775 - DNA, 615 bp, Homo sapiens
  misc_feature: GYAE6OF01B7GKU.37.37.D04.1.454.CMB.1.raw
  modified_base (236)..(236): a, c, t, g, unknown or other
  misc_feature (236)..(236): n is a, c, g, or t
  modified_base (272)..(272): a, c, t, g, unknown or other
  misc_feature (272)..(272): n is a, c, g, or t
  modified_base (480)..(480): a, c, t, g, unknown or other
  misc_feature (480)..(480): n is a, c, g, or t
  modified_base (519)..(519): a, c, t, g, unknown or other
  misc_feature (519)..(519): n is a, c, g, or t
  modified_base (557)..(557): a, c, t, g, unknown or other
  misc_feature (557)..(557): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatcccttttcctggtggcagcagcaacgaggtcgcccactctcaggttcagcgtggtgcagtcgtggagctggaggtagaagacgccgtgggcctgagtgagtctcngacaggtcttcgtaggttactactttagactaattntaggtactacgaagttgggtcgacgacgaccggccccgtagggaaccgaacggcctagtaggaggttggaggtgggtaagtggatcacggtcgtaacttaacgaaaattaacaaccaaccaacgtatagtacacgaacgaaggtaaccgtcggacgggactaggtacctacccaccgtagaaccagaacgataccgactaccgaacgngaccacgtacgaccctagacgtacgacgcgaggacgacncgtagagtatcgacgacgaccgtcggtacttgttacgngtagaggagtagatagtacttacgtagtacgtcggacgtcggtacggacccggtacgg

SEQ ID NO: 67776 - DNA, 691 bp, Homo sapiens
  misc_feature: GYAE6OF01C23Q4.37.37.D04.1.454.CMB.1.raw
  modified_base (129)..(129): a, c, t, g, unknown or other
  misc_feature (129)..(129): n is a, c, g, or t
  modified_base (143)..(143): a, c, t, g, unknown or other
  misc_feature (143)..(143): n is a, c, g, or t
  modified_base (164)..(164): a, c, t, g, unknown or other
  misc_feature (164)..(164): n is a, c, g, or t
  modified_base (197)..(197): a, c, t, g, unknown or other
  misc_feature (197)..(197): n is a, c, g, or t
  modified_base (613)..(613): a, c, t, g, unknown or other
  misc_feature (613)..(613): n is a, c, g, or t
tcagtagtgtagatcacgaccggtgctcgatttagtagcatactgttgggtttggggaacccaaaaaccacacccctccttgggagaatcccctagatcacagctcctcaccatggactggacctgganctattccttttccnggtggcagcagcaacaggtcnccctactctcgaggttcagctggtgctagttcnggagcgtaggaggtaggaacgacgccggtcggggtcctagaggttacggaacggttcctaccgtagaccgtaggttccttttcgttacggtttaacttaaccgttttagaacttaaagtttagtacggtactaccggtaaggtgggtacgaccgacgaccgtcccgtaggaaccgaaggtccagtcggaaggttggaggttagggataggtactacgcgtacgtactaaacagtaaactacactacgtatatacgacaaacgtacggtacgtccgagggtaccagtacgtacccactacgaactacgaagtaactacgtactaccgacgtacgaccacgacgactacgacgtgacgtgaaggcgtacgtcgagacgtagttaccgacggacgtaccggtcgttacgttagttacgngtaaggcgtaacgtataacgtaagttaacgttgtaaacggttcgacggttacgtacggggtcgaaccgggtaacccgg

SEQ ID NO: 67777 - DNA, 600 bp, Homo sapiens
  misc_feature: GYAE6OF01B04EC.37.37.D04.1.454.CMB.1.raw
  modified_base (384)..(384): a, c, t, g, unknown or other
  misc_feature (384)..(384): n is a, c, g, or t
  modified_base (432)..(432): a, c, t, g, unknown or other
  misc_feature (432)..(432): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
  modified_base (492)..(492): a, c, t, g, unknown or other
  misc_feature (492)..(492): n is a, c, g, or t
  modified_base (535)..(535): a, c, t, g, unknown or other
  misc_feature (535)..(535): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaacgccgtggggcctcgagtggaaggtctctgcgaaggtcttacgtggttactaccgttagctaagttactaggtactcaacgtgggtgcgaacgtacggcccctgggaacaaggccagtggaggtggagtggggatagggatccgagccgtaatacgaaatacaactacacacgttancgacaacgaagtaacgtcgaaggcgtagtacgaccgaccctgaaccanacgtaactacactccgaacacgacaacgacnctacgagtggacgngtagagggcgcgtanaacggtcttagcgaacgacggtaccggttcgttagtttacggngtacgcggtaacggtagaactagtaattgtacggtaagtggtacgacggtcgggcccgtaacggg

SEQ ID NO: 67778 - DNA, 969 bp, Homo sapiens
  misc_feature: GYAE6OF01D2XGB.37.37.D04.1.454.CMB.1.raw
  modified_base (139)..(139): a, c, t, g, unknown or other
  misc_feature (139)..(139): n is a, c, g, or t
tcagtagtgtagatcacgaccggtgctcgatttagtagcatactgttgggtttgggacccaaaaaccacacccctccttgggagaatcccctagatcacagctcctcaccatggactggacctgagcattccttttccnggtggcagcagcaacgaggtcgccctactctcgtaggttcagctggtcgctagtcgtaggagtcgtaggaggtaggaaagtacggtccggtcggggtaccctaggtaaggtacgggtaaaccggtccgttaccgtaggtaccgtaacggttccgtttacgttacgggttttaaccttaaccgttttacgaacgttaacgttttaacgtacgggtttaactaaccggtaacggtcggggtacgtaccgggaaccggtaccggtaccccgtaacgggaaacggtaaccggtcctaaggtacggggtagggtacgggtaagggttagggacgttacgggaacttaccgaggtaaccgttaaaccgttaaaacgtaaaacgtttaaactaaacccgaaacgtaaccgttaacgtaacggtacccgtaacgtaacgtaaacggttaccggtacggggtaacggaccgtaaacggttaacccggacccttaaccccgggtaactaaacccggtaaaccgtaaacggtaaaccgtaacccgttaaccggtaaacccgaaaccgggaaacgtacccggtaaaaaccgtcccgtaaaccgttaccggtaaacgggtaccggtacggtaaccgggttacggaacgggtaccctaacggtaacggtacggttaaccgtacgggtaaccgacccggttaaccggttccggttaccggtttaacggttacggtacggtaagttacgggtaaacgtaacgttaacggttaaaggttaaacgttaggtttaacgtacggtaaccggttaaccggtcggggtacccggttaacgggtaacccgggg

SEQ ID NO: 67779 - DNA, 776 bp, Homo sapiens
  misc_feature: GYAE6OF01CPFQ0.37.37.D04.1.454.CMB.1.raw
tcagtagtgtagatcacgaccggtgctcgatttagtagcatactgttgggtttggggacccaaaaaaccacacccctccgttgggagaatcccctagatcacagctcctcaccagtggacgtggacctggacgcacttccttttccgtgggtcggcaggcgagacgaacgaggtcgaccccacttccgttacgtaggttcgagtcgttggtgctaggtcgtaggacgtcgttaggaggtagaaggtacgccggtcggggcctacgaggtaagtaacggttcctaccgtcgagtacggttcgttcgttcggttacttaccgtttagacttaagtttacgtaggttaactcgtaaccggttgggtaccgaccgaaccggtacccggtaccgtacggaaacgtacggccgtaggtagacggttacggaggtacgggtacggtaggtaccgtacggacgtaacgttactaaacgaaacttaacgaacgtaccaacgtactagtacgaacgtacgtaacgtacgtacggacggtacgcgtacgtaccgaccgtacgaacccagaacgtacctaacgtacgaccgaacgcgaacctacgacgtacctagagtacgtgaacgcggaacgcgtacgtacggtaagccgttagacggaccgtaccggttccgttaacgtttcggttacgaccggttaggacgtgttaacggaagtttaccggtaagttacggttacgtaaagggttccgaacgggttttacgggcccggtaacgggtaacccggg

SEQ ID NO: 67780 - DNA, 273 bp, Homo sapiens
  misc_feature: GYAE6OF01B6IR4.37.37.D04.1.454.CMB.1.raw
  modified_base (250)..(250): a, c, t, g, unknown or other
  misc_feature (250)..(250): n is a, c, g, or t
  modified_base (252)..(273): a, c, t, g, unknown or other
  misc_feature (252)..(273): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggccaccctcctaccaagagcacctcgtggggcacagcggccctgggctgcctggtcaaggctacttccatctacactactgagcgggctggacaaggcgacatagnannnnnnnnnnnnnnnnnnnnnn

SEQ ID NO: 67781 - DNA, 661 bp, Homo sapiens
  misc_feature: GYAE6OF01A2BYZ.37.37.D04.1.454.CMB.1.raw
  modified_base (324)..(324): a, c, t, g, unknown or other
  misc_feature (324)..(324): n is a, c, g, or t
  modified_base (446)..(446): a, c, t, g, unknown or other
  misc_feature (446)..(446): n is a, c, g, or t
  modified_base (593)..(593): a, c, t, g, unknown or other
  misc_feature (593)..(593): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgccccactctcaggttcagctggtgcagtctggagctggaggtgaaagaacgccgtcggggcctcgaggtgaaggtctccgtgcgaaggtcttcgtggttactacctttagctaattagtggtactcaacgtgggtcgcgacgcggcccctaggacaacggcagngaggtggagtgggatggactcgaacgcgtacttaacaagtaactaacacaactactagtcgacaacgaaggtacgtaccgaaggcgaagtaccgtaccgaacccgtacgaaccaacggtaanaacgtaacacctaccgaacgacgtaccaaccgtaccgtaacctaacgacgttgggaacctcggtaaggaaacgggtcttaccggtaggaacgtacgttacccgtaacggaaccgtacccggtaaccggttccgtttaggtttaccgngtacggacgtagtaacgtaacagtacgttagtacgtaagtcgtaagtccgggaggtaccgtaacccgg

SEQ ID NO: 67782 - DNA, 670 bp, Homo sapiens
  misc_feature: GYAE6OF01E09ZV.37.37.D04.1.454.CMB.1.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
  modified_base (376)..(376): a, c, t, g, unknown or other
  misc_feature (376)..(376): n is a, c, g, or t
tcagtagtgtagatcacgaccggtgctcgatttagtagcatactgttgggtttgggggacccaaaaaaccacacccctccttgggagaatcccctagatcacagctcctcaccatggactggacctgggagcattccttttcctggtggcagcagcaacaggtcgcccactctcaggttcagctgggtncagtctggagctgaggtgaagagccgtgggcctnagtgacggtctcctgcaggtcttcgtgttataccttanactaatatgtatcaacgtgggtgcgacgacggcccctggaacgacggcagtgaggtggagtgggatgggactcaggtccgtaattaacaaataaactaacgaacaacctacttanagacctaacgaaggtaaccgttcgaacggggacaaggtacgtcccaacccgtgaaccaacgactaactacactaccgacgtaacgccaacgacgtacctaactagtacgggactcgtacgggacggaacggtaccgcggtaagtcgtaacggtccgaaacgtccggtaccggggtttcccgtttagtttacccggtaggtccggttaacgagtaacgtaacggaaagtttaacgtttaggtacggtaacggttacgaaacgtttccggggtaacgggaaccggttaaacccggg

SEQ ID NO: 67783 - DNA, 789 bp, Homo sapiens
  misc_feature: GYAE6OF01BG9UU.37.37.D04.1.454.CMB.1.raw
  modified_base (85)..(85): a, c, t, g, unknown or other
  misc_feature (85)..(85): n is a, c, g, or t
tcagtagtgtagatcacgaccggtgctcgatttagtagcatactgttgggtttggggacccaaaaaccacacccctccttggganaatcccctagatcacagctcctcaccagtggactggacctggagcattccctttttccgtgggtggcagcagacaacgaggtcgcccactctcgaggttcagtcgtggtgcagtcgtggagtcgtggaggtagaaaggaacggtccggtgggccctagaggtacgaacggttcctccgtgaccgaacggttcttcgttaggtttacttacgtttagactaatttgtaggtactacgtaaggtgggtacgacgtacgaccggtcccgtaggaacgaacgcagtggtaggaggtaggtaggagtacggtacgtacgacgtaccgtaacgtaaacctaaagtaaacaactaaactaactaacgttagacgaccgaaacgtaagtaaccggttacgaacgggacgaacggtacgtacccgtaccctacgaacctaacgtaacgaacgttacctaaccgtaccccgaaacgtacgacctaaaccgacgttaacccgtaacgtaagggtaaccggtacgtaaggacggtaacgggacggccgtaagttacggtacccgttaacggaacccgtaacccggaccgggtttacggttacccggttttagtttaacggcgttaacgggtacgtaagtaccggtaagtaacgtaaagtttacgttaagtaacggttacgaacggtccggggtaaccggtaccgggtaaacccggg

SEQ ID NO: 67784 - DNA, 656 bp, Homo sapiens
  misc_feature: GYAE6OF01C6SQD.37.37.D04.1.454.CMB.1.raw
  modified_base (161)..(161): a, c, t, g, unknown or other
  misc_feature (161)..(161): n is a, c, g, or t
  modified_base (223)..(223): a, c, t, g, unknown or other
  misc_feature (223)..(223): n is a, c, g, or t
  modified_base (391)..(391): a, c, t, g, unknown or other
  misc_feature (391)..(391): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtcncccactctcaggttcagctggtagcagtctggagcgtggaggtagaagacgccgtgggcctnaggtgacgtcctcgtgacgaaggtcttcgttagttactacgtttagactaattgtagtatacgtaacgtgggtcacgacgaccggtcccctaggaccgtaaggacctagtggacggttggacgtaggggtatggacgtacgacggtctaccttaaagtaaacttaaanaacctacaacctaataacgtcgaacaacgtaacgtaacggtccgagggtacaaggtctaccgaccgtacgacaacgacaactaccactacgacgacacacgactcaacgngnggatacgcggagacgtacgaggtactacgtacggtacgaccgtacgtaccgggttctttagttccgtagtaccgaggtaaacgacgttaagtaagttacgttaacgtagtaacgtacgggacgttaacggggccggggtaaccgtacccgggg

SEQ ID NO: 67785 - DNA, 789 bp, Homo sapiens
  misc_feature: GYAE6OF01DAYL4.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgagggaagcgcccaccctctccgtgcgagggccagtcagtagtgttagcagactaacttcgcctaggtaccagacaagaaaccgtggaccaggtcctcccgaggcctcctcattcgtagtcgggtcactacgtcccgaacggaccgggtaccctaacggttcggtacctccccgtaacggccgtaaggtttcgaagggttcgggacgtagggttcggggttacgtacggggaacgtacggttaccgttaccgtaccgttaccttaccgaacccgtaacgtccgtaacggacccgtaccggttccccgttagggtaccccttagggttaccgtaaggttaaacgtttttgttttacggtaccgtttttaaacgtttttcgtttaccgttggtacgtacgtacgttaagtttaaacttaaccgttttacggtccggttacccctttaccggttagggtaccggttaccgggtacccggtaacgggaaaaccggggttacggaaacggggttaacggaaaaccttaccgggtaaaacggtaacggtttcggaaccggtaccgttaacccgaccgtaaccgtagtttcccgtttaaccgg

SEQ ID NO: 67786 - DNA, 813 bp, Homo sapiens
  misc_feature: GYAE6OF01B1XJF.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagacaacaggtgaccccacttctcaggttcagcttggtgctagtcgtggagctggaggtagaagaagccgtggggcctagaggtaggaaggtctccgtgacgaaggtcctttgtcggttaactaccgtttagactaattagtagttactacgaacggtgggtgaccgaccgaccggtaccccgtagggtaaccgaacggtccaagtggtaacggtgggtaggtagggtagtgggtaactacgacggtaccgtaacgttaaacaaagttaaacgaacctaaaccaacgttaacgtaacgttacggaccaaacggaagtaaccggttacggacggacaacggtacgtaccctacccgtacgaaccctaagtacgaactaccgtaccgacccggtaacgacctacgtaacccaccggtacctaagagggtcggaccggtagtaacgggacgacgtaccgaaggtcttaccgtaccgtaggaaaccccgtcggttaccgggttttccgtttaacggtttacggacgggtaccgggtaaaagggtaccggttaaagtaaaccggttaaaggttaaacggttttaagttaaacgggggtttaaccacgggggtttaaaacccggttaaccggggggtcccgggggtaaacccggttaaaacccccggggg

SEQ ID NO: 67787 - DNA, 700 bp, Homo sapiens
  misc_feature: GYAE6OF01C3FGG.37.37.D04.1.454.CMB.1.raw
  modified_base (127)..(127): a, c, t, g, unknown or other
  misc_feature (127)..(127): n is a, c, g, or t
  modified_base (159)..(159): a, c, t, g, unknown or other
  misc_feature (159)..(159): n is a, c, g, or t
tcagtagtgtagatcacgaccggtgctcgatttagtagcatactgttgggtttggggacccaaaaccacacccctccttgggagaatcccctagatcacagctcctcaccatggactggacctggancatcctttcctggtggcagcagcaacaggtcncccactctcgaggttcagctggtgcagtctggagctggacggtgaaagacggtccgtaggggcctcgaggtggaaggtcctcgtaggactagggtctttcgttaggttacttaccgtttagactaattagttgtatcgaagtgggtcgacgacgacggccccgtggaacgacggacctaggtaggtacggtagggagtaggggaattcgggaactacgacgtacggtaacctaagtaaactaaactaacaacgaaactactagtacgaacaacgtaagtaacgtcggaaggacgacgtaccgtacacgtacacaacgataacacgtacgaccaacgtacgacctaacgaccgtacctaaggacgtacggaacgtacggtacgggaagtcgtaccgtaagacgtacgtacgaacgacgtaccggtacggttacgtttagttacgtacgggtacgacggtaacggtaactaaggtaagtaactttagttaaaccggtaggttaacggtaacggtaccgggtacggggtaacgtaaccccgggg

SEQ ID NO: 67788 - DNA, 822 bp, Homo sapiens
  misc_feature: GYAE6OF01EE4WW.37.37.D04.1.454.CMB.1.raw
tcagtagtgtagatcacgaccggtgctcgatttagtagcatactgttgggtttgggacccaaaaaccacacccctccttgggagaatcccctagatcacagctcctcaccatggactggacctggagcattccttttcctggtggcagcagcaacaggtcgcccactctcaggttcagctggtgcagtctggagctggaggtagaagaagccgtgggcctcagtgaacgtctcgtgcgaaggtcttcgttaggttacttaccgttagactaatttgtcgttaataccgaacgttgggtgaccgacgtacggccccgtaggaaccgaacggcctaagtggtaaggtagggaggtgggagttaggactacgacgtacgtaaccttaaacgtaaaactttaaacaaaccaaccgaaactaaacgttagtacgaacgtaaccggaaaggttaaccgttaccgggaacggtacgtaacggtaccgttacccaaccccgttaccgaaccgaaccgtaaagtaacctaacgaacccgttaacccgaaaccggaaccgtaaccgaacccaacccggtccccgttaaagacggtacgggaaccgacggttaacggaaccgggtaccttaccgttaaggtaactacggttaccgaacgggtaacccgtaacccgggttcccggttaccggttttacgttaacgggtcggttcgggtaaggtaaccgtaagggttaacccgtaaaggtttaaacgttacgttttaaagggttaaccgttaccgggttaaccggtaaccgggggttccggggtaaccccggtaaaccccggggg

SEQ ID NO: 67789 - DNA, 759 bp, Homo sapiens
  misc_feature: GYAE6OF01EKR3Q.37.37.D04.1.454.CMB.1.raw
tcagtagtgtagatcacgaccggtgctcgatttagtagcatactgttgggtttgggacccaaaaccacacccctccttgggagaatcccctagatcacagctcctcaccatggactggacctggagcattcctttcctggtggcagcagcaacaggtcgcccactctcaggttcagctggtgcagtctggagctgaggtgaagacgccgtgggcctgagtgaacggttctccgtgacaaggtcttcgtaggttactacctttagactaattagtaggtatacgaacgtggggtacgacgacgtacggtcccctaggaaccgaacggcctagtacggtaggtaggtagtcgggtatacgggacttacgaacggtaccgttaacctttaaaacgaaaagttaaaccgttaaaccaaccgtaaacctaacgttagtacgaacctaaacgtaaaggtaaccggtttacccgaggggaccaacggtaaccgtacccgtaaccccgtacgaacccgaacgtaacgtaactaccgtaaccgtacccgaacgtacacgaaccgaccgtacctaacgaggttacggagtacggtaggaacgggacgtccgtaaggtacgtaaccgttacgtaacggaaccccggtacggtaacccgggttcgtttaacggttttacgtcggtacggacggtaaggtacgtaacgtaagttaaattacgtaacggttaagtacggtaacgttacgggtaccggggtaccgtaacccggg

SEQ ID NO: 67790 - DNA, 661 bp, Homo sapiens
  misc_feature: GYAE6OF01BT3ND.37.37.D04.1.454.CMB.1.raw
  modified_base (409)..(409): a, c, t, g, unknown or other
  misc_feature (409)..(409): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcagtgaaggtctcctgcaaggcttcgtggtttactactttagctaattatggtatcaacgtgggtgcgacgacggccctggacaaggccagtgagtggagtgggatggatcgagcgtacttaacaataataacacacactatcgacacgaagtaacgtccgagggcaaggacgtaccaccgtacgaccanaacgactaacacgtacccaacgacgaccaacgacgtacctaacgagtacggaacgtcgtacggaacggtacgccgtagggaaccgtacgttaccgtacggaaccgtaaccggtaccgggttaccggttttacggttttaccgtgggttacggacggtaacggtaacgttaacgtaaaggttaaacttaagtttaacgggtaaacgtacgggtaaccgtttaacgggtaccgggggacccgtaaacccggggg

SEQ ID NO: 67791 - DNA, 854 bp, Homo sapiens
  misc_feature: GYAE6OF01ET1NZ.37.37.D04.1.454.CMB.1.raw
  modified_base (141)..(141): a, c, t, g, unknown or other
  misc_feature (141)..(141): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttccnggtggcagcagcaacaggtcgccccactcctcgtaggttcagccgtggtgcagtcgtggagtcgtaggagggtagaaaggaacggccggtcgggggcccttagaggttacggtaagggttcctccgttacggacgtaacggtccttttacgtagggtttaaccttaccgtttaaggacttaagtttagtaggttactacgtaacggttgggttacgccgaaccgtaccgggtccccgtagggaaaccgtacgggacctaagtgggtacgggtaggtaaggggttacgggagttacgggtaacgtaccgggaacggtaccgttaacccgttaaactaaaagttaaaacctaaaccgaaaccgtaaccctaaatacggttacgaccaaacggttaaacggtaaccgtttcgggaaacggggtacgaaacggtaacctacccggtacccgtaacggtaaacccgagtaaccgtaacgtaaccctaaaccgtaacccgtaaaccgaacgtaaccgtaaccgacgttaacctaacgacggtacgtagtacggtacggacggtacgcgtaacgacgtagtaccgtacgaaccggttaccgtacgggttaccgtttaaggttcccggtagtacggtaaggtaacggaacgttaacgaagttaacgttaagttacgaacgttaggaccggttaaccggtcggggtaaccgtaaacccgggg

SEQ ID NO: 67792 - DNA, 790 bp, Homo sapiens
  misc_feature: GYAE6OF01B536O.37.37.D04.1.454.CMB.1.raw
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctccagataccatgganaaatgtgatgacgcagtctccagcccacctgtctgtgtcctacgaagggaancgcccacctctctgcgacggccagtcagtagtgtacgcacgactaacgttacgccgtacggtaccagacctaacggaaacccgtcggacccgacggcccttaccccgacggtccccttcctacgtaacgttcggttaacggttcgggtacctacctaccgtaccccggaaccggtaccgggacccttacggttacggtaccctaccccggacgtccggtaacggtttacgtacgggtcggtacggacggggtttcgggtaccggacggggtaactagggttaccgttaccttaccgttccgtaaccgtaccgtacgtaccggaccgtaaccgccggtacctcgtacccgtaagtttcgaaggttaacgtttactttacggtacttttaacggttttcgtttaccgtgttacgtacgtacgttaaacttttaacgttaaccgttccggttaccggttacccttcgggtaccggttaccggttacccggtaacgggtacccggtaaaggtaccgggtaaaggtaacgtaaaccgttaaccgtaaacgtcggtacggttacgcgttaccgacgtacgttcgttcggttacc

SEQ ID NO: 67793 - DNA, 809 bp, Homo sapiens
  misc_feature: GYAE6OF01ALLMB.37.37.D04.1.454.CMB.1.raw
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcgaggttcagcgtggtgcagtctggagctggaggtagaagaacggccgtggggcctcgaggtgaacggtctcgtgcgaacggtcttcgtaggtttacttaccgtttagactaatttagtggttaactcgtaacgttggggtcgacgacgacggtacccccgtagggaccgaacggccgtagtaggaggtaggaggtagggagtacgggtactacggaacggtcggtaaccttaacgtaaaacgttaaaactaaccaacctaaacctaacgttaacgtcgaaccgtaaaccgtaacgggtaaaccggttcccggaaacgggtccgtaaaggtacccgttacccgaacccgtaacggaaccctaacgtaacgaacctaaccgtaacctaaccccgaacggtaaccgaaccctaaaccgaccgtaacccgtaacgtaaacggttcgggaaccgtcggtaacgggaccgggtacgtaccgttagggaacgtaccgttacgtaccggaaccggtaacccgtaccgggttaccgttttacggttacggtcggtacggaacgtaaggttacggtaaacgtacgttaagttaggttacgttaacggtacggttaacgtaccggggttccgggaaccggtaaccccggg

SEQ ID NO: 67794 - DNA, 991 bp, Homo sapiens
  misc_feature: GYAE6OF01BPABL.37.37.D04.1.454.CMB.1.raw
tcagtagtgtagatcacgaccggtgctcgatttagtagcatactgttgggtttgggacccaaaaccacaccctccttgggagaatccctagatcacagctcctcaccagtggactggacctggacgcacgttccctttttccgtggtggctagcgagtacaacgtaggtcgcccctactctcaggttcagtccgttggtcgtcgagttcgtggtagtcgtagaggtaggaaacgacggtccgtcggggacctacgaggtacggtacggtcctaccgtgaccgtaacggttccgttacgttacggtttaaccttaaccgtttaggtaacttaacggtttacgtacggttaacgttaccggtaacgggttcgggtacggaccgtaccggtaccggtaccggtaccggaaccgacggtaccgtaggtacggtacgggttacggtaggttacgggtacgttcggtaaccggttaccgtacggttacccgttaaaccgttaaaaccgtaaacgtaaacctaaccgtaaccgtaaccgttaacgttaccgtaccgtaacggtaaacggttaaccggtaggttacccggtaacggtaccgtaaccggtaccgtacccgacccggtaaccgtaacccgtaacgtaaccgtaaccgttaccgtaaccgtacccggtaaccggtaaccgtaaccccgtaaccgtaacccggttaaccgttacgtaaccgggttacgggtaaccggttaccggtaaccgggtaccggttaacggtaccggtaacgtacggttaaccgttaccggttaaccgggtaccgttaacccgggtacggtttaaccgggttttacggttacccgggtacgggttaaccggttaaacgggtaaacggttacccgttaaaggttaaccgggtttaaacgtttacggggttaaacggtaaccgggttaacccgggtaaccgggtttaaccggggtaacccgggttaacccgggtaaccggg

SEQ ID NO: 67795 - DNA, 960 bp, Homo sapiens
  misc_feature: GYAE6OF01B8HZD.37.37.D04.1.454.CMB.1.raw
tcagtagtgtagatcacgaccggtgctcgatttagtagcatactgttgggtttggggacccaaaaaccacacccctccttgggagaactcccctagatcacagctcctcaccatggactggacctggagcattccttttcctggtggcagcagccaacgaggtcgccccactctacgaggttcagtcgtgggtcgcgtagtcgtgggacgtcgtagggtagggtaggaaacgggaaccggtcccgggttccggggggccccttacggtaacgggttacggggtaaaccgggtttccccgttcccgttagggaaccccgtaaacggggttccctttttaccggtttaacggggtttttaaacctttaaccccgtttttaaaggaccgttaaaagttttacggttacgggtttaacttaccggtaaaccgggttgggggttaccggaccggtacccggaaccggggtccccccggtaagggaaaccgaacgggtaccgtaggttagggacgggttgggaacggttaggggagttacggactcgaggtaccgttaaccttaaactaaaattaaacaaacctacgtaacgtaactagtacgacgtaaccgaaggtaccggtaccgaggtaccgacggtaccgtacccgaaccggtacgaaccgactaacggtaactaaccgaccgtacccgaacgactaccgaaccgaccgactacggagtcggacgcgtacgggacggtaccgtacgtacggaacgtccgtaacggtacgggtaacccgaaccgggttacccgggtttacggttttaacggttttacgggtccgggaacggttaaccgggtaacggtttaacgggaaaacgtttaagggttaaaacgttttcgggttaaacggttaaaggggttaccgttaaaccggggttacccggggttaaccgggggaacccgggtttaaaaccccgggg

SEQ ID NO: 67796 - DNA, 748 bp, Homo sapiens
  misc_feature: GYAE6OF01ENZO9.37.37.D04.1.454.CMB.1.raw
  modified_base (396)..(396): a, c, t, g, unknown or other
  misc_feature (396)..(396): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtcgtggagctgaggtgaagagccgtggggacctcgagtgaacggtctcctgcaaggtcttcgtggttattacttagactaattagtggtatacgaacgttgggtcgacgtacgacggtcccccgtaggaaccaacgggcctaagtacggtagggtacgggaagttgggggtaagtgggaacttacggacggtaccgttaaccgtttaaanaaaacgttaacgttaaaccaacgtaacctaacttacgtacgaacctaacgtaaagttaaccggtaccgaaggggactaagtaccggtcccaacccgttagaaccctaacggaacgtaactaaccgtaaccgttaacccgaacgggtaacaacggaaccctacgtaccctaaacgacgttaagggactcggtaacgggacggtacgtccgttaagggacttacgtaccgtacggaccgtaaccggtacggttcgttttaacgtttcgtacggtcggtacgtaaggtacgttacggtaaagtacttaagttacggtaagttacggtaacgtcgggtacggtccggtaaaccggg

SEQ ID NO: 67797 - DNA, 663 bp, Homo sapiens
  misc_feature: GYAE6OF01EOJ4N.37.37.D04.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtcgcccactctcaggttcagctggtgcagtctgganctgaggtgaagaagccgtgggcctnagtgagtctccngcaggtctcgtgttataccgttagctaattagtggtatacgaacgttgggtcgacgacgacggcccctaggaaccaacgggccagtggtaaggtggtaggtggggatgggactcgagtccgacttaacaaagtaaactaacaacaacgtactactacggacaagtaacgtaaaggttccgaagggactaaggtacgtaccctaaccgtacgaaccaacgtaagtactaacactacccgaacgtacaccacgaccgtacctaagagtacgggataccggtaggacggtacgtacgtacgaacgtacgttccgacgtaaccgacggttacccggttcggttttacgtttacggcggtacgacggtaaggttaacagtaacgtaagttagtaacgtaagttcggtaaacgttacggggtcggaccggtaaccggg

SEQ ID NO: 67798 - DNA, 658 bp, Homo sapiens
  misc_feature: GYAE6OF01AZ4JC.37.37.D04.1.454.CMB.1.raw
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtgggcctgagtgaaggtctccgtgcaaggtcttctggttatacctttagctaattatggtatcaacgtgggtgcgacgacggcccctaggacgaaggccagtgaggtggagtgggatggatcgagcgtactaanaataacaacacacactanacgacacgtagtaacgtacgagggcaaggtactaccacctagaaccagacgaactaccactaccgaacgacgaccaacgacgtacctaagacgtgggactacgtaggaagtacgtccgtaaggacgtaacgtaccgtacggaaccgtaaccggtacccgggtttacgttttaggtttacgacggttacgggtaaccgtaaggttaacgaacgttaaagttaaacttaaggtttaggtaaacggtacgggttaaacccgttacggggtaaccggggtaacccgtaaaacccggggg

SEQ ID NO: 67799 - DNA, 622 bp, Homo sapiens
  misc_feature: GYAE6OF01A5DDR.37.37.D04.1.454.CMB.1.raw
  modified_base (138)..(138): a, c, t, g, unknown or other
  misc_feature (138)..(138): n is a, c, g, or t
  modified_base (378)..(378): a, c, t, g, unknown or other
  misc_feature (378)..(378): n is a, c, g, or t
  modified_base (602)..(602): a, c, t, g, unknown or other
  misc_feature (602)..(602): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatcctttcnggtggcagcagcaacaggtcgaccactctcgaggttcagctggtagctagtctggacgtctggagtgaagacgtcgtgggcctgagtgaacgtctctgactaggtcttcgtaggttactaccgttagctaattagtggtatacgaacgttgggtacgacgtacgacggccccgtaggacgtacggctagtcggagtaggacgtggaatggactcgagtacacttaagaataactaccganaactattcgacgtaacacgtaacgtagttacccgaggatacgtacggtccacgtacgacctaagtacgaactacgtaacctcaaggaccgctaacgagtaccctaagacgaggtagccgttaggacgacgtccaggactcgttacgacgaacgccgtacggttcgtttagtacgagtcgacggagtacgtaagacgttagtacttaagtacgtaggtaacccgnggttaccgggcgtaacccgg

SEQ ID NO: 67800 - DNA, 700 bp, Homo sapiens
  misc_feature: GYAE6OF01DSQN6.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagttctccagcccaccttgtctgtcgtcgtaccgaggggaaaagtacgccaccctcctccgtgaccgacggggctacgtcaaggtagtaggttagcaagactaagttacgaccgtaggtaaccaggacaacggtaaaccgtcggacccaaggtccctacccgaggtccctaccgttactaacttccgttaagttcgggtctaaccacgtcccgtaaccggagggaccctaacgtacgtacctacccgaggccgtaacggtcacggtcgggacttaggggtccgggtacgacgggtaactaggaccgtttacaccgttctactaacgtacctgacgtacacgtcgtaggactaggtactaggtaagttcgtttacggatttaacgtttattccgagtactagtactaaagttaacgtaactttcgagtaccttacgttaacgggtacgaccggtacgtaaccgggagggtaaacaagggtactaaagtaacgtaaacgtaggtcgacgtacgttccgatacggtacttgttaccg

SEQ ID NO: 67801 - DNA, 853 bp, Homo sapiens
  misc_feature: GYAE6OF01AMDDR.37.37.D04.1.454.CMB.1.raw
  modified_base (198)..(198): a, c, t, g, unknown or other
  misc_feature (198)..(198): n is a, c, g, or t
  modified_base (754)..(754): a, c, t, g, unknown or other
  misc_feature (754)..(754): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttccgtggtggcagcagcaacaggtgcccactctcaggttcagctggtgcagtcgtggacgntgaggtgaagaacgccgtggggcctcagtggaacggtctactgacgaagggcttcgtggttacttaccgtttagactatttatggttataccgaacgtggggtcgaccggaccgtaccgggcccccgtagggaaacctaacgggcctaaggtgacggttacgggtaagttggggtaactgggtacgttacgacggtacgtaacttaaacgtaaaacgtaaacttaaccgaaaccaactaacgtaacgtacggaacctaaacgtaacggtaacggtttacccggaacgggggtaactaaccgggttacccgtaaccccgaaccccgttaaccgggaaccccgtaaccgtaaacgtaaacggttaaaccccacggttaacccccgaaacggaaccggaacccgaaaccgtaccgtaaaccccgtaaacggttacggaacgggttaacgtaccgggtttaagggaaaccggttacggttacccgaagggtaacggttaacgttaccggaaccggtaaccgtaaccgggtacccgggttcccgtttaaggttttaccggnggtacgggacgtaaacggtaataaacggtaacgttaaattaacggtttaaggtaacgtacgggttaacgacggggttccgggaccgggttaaacccggg

SEQ ID NO: 67802 - DNA, 811 bp, Homo sapiens
  misc_feature: GYAE6OF01ASXMD.37.37.D04.1.454.CMB.1.raw
  modified_base (68)..(68): a, c, t, g, unknown or other
  misc_feature (68)..(68): n is a, c, g, or t
  modified_base (130)..(130): a, c, t, g, unknown or other
  misc_feature (130)..(130): n is a, c, g, or t
  modified_base (145)..(145): a, c, t, g, unknown or other
  misc_feature (145)..(145): n is a, c, g, or t
  modified_base (169)..(169): a, c, t, g, unknown or other
  misc_feature (169)..(169): n is a, c, g, or t
tcagtagtgtagatcacgaccggtgctcgatttagtagcatactgttgggtttgggacccaaaaaccncacccctccttgggagaactcccctagatcacagcctcctcaccagtggactggacctgganctattccttttccgnggtggcagcagcgaacgaggtccncccactctacgtaggtttcagtcgtggtcgacctggttcgtgggacgtcgtagggaggtaggaaacgacggtcccggtcgggtaccctaggaggttacggacggttcctccgtagacgacggttcgttacgttacgtttaacgtaccgttatagtaacgttagtacgtactacgtacggttggcgacgacgtaccggtaccgtagaacgacgatacgtggtacggtaggaggtaggtacgtaggtaacctcggaaccgtaccgttaaacgttaaactaaaacgttaaccaaaacccggaacttaaaccgtacgtaaaggttaccgaaaacccgttacgggttaaaacggtaccggtaacccgggagggtaaccgtaacgtaaccccggtacctacccggtaaacggaaccaacggtaacgtaacgaccctacgtaacgacgaaccgtaccgaacccgtaactaccgaacgtacggaccggtacggagttaacggacggttacgtaccgaaggtactacgacgtaaccggaacgtacccggttacgtttcgtttaacggtaccgttgacggaacggttagaacgtattaagtacgttaagttagtaccggtagtacggtaccgggtaccgtacggtaaccggg

SEQ ID NO: 67803 - DNA, 823 bp, Homo sapiens
  misc_feature: GYAE6OF01B7HDO.37.37.D04.1.454.CMB.1.raw
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
tcagtagtgtagatcacgaccggtgctcgatttagtagcatactggttggggtttgggggaggaactgctcagttaggacccagacggaaccatggaacgcccagcgcagcttctcttccgtctgctactctggcctcccagataccactaggaagaaatgtgatcgacgcagtcctccacgcctacctgtctgtcgtcgtacggaagggaanacgcctacctctccgngcgacgggcctagtacgagtagtcgttacggctagaccgtaacgttacggaccgttaccggaacctacggacgaacggtaaaccgtcggacccgaacggtcccgtaccggacggtcctccgtactactttccgtagttcggttacaccgttccgacggaccggtccgtacgtccggtacctacccggtaccccgtacgtacgggttaccgtagggttcgggttcgggtcgggttaccggtacggggaacttaaccggttcctttaccgacctttaccgaccgtaacgtctaccggaacgaaccgttacgggaaccgttaacggggaacccggtaaccggtaaacttccgttcgggtaacgtacggtttaacgttttacggttttacctttcggaccgttagaacggtttcgtaagggtttaccgcggttaaccgccggttaaccccttcccggaacccgggttttaccgacggggttcccgaaaacgggtaccgggttaacggaaaggttaaaccgaacgttaaaccgtaaccggttgggttaccggcggtaacaccgtacggttacctaggtttacgttccttacgttacccg

SEQ ID NO: 67804 - DNA, 721 bp, Homo sapiens
  misc_feature: GYAE6OF01BYAMT.37.37.D04.1.454.CMB.1.raw
  modified_base (183)..(183): a, c, t, g, unknown or other
  misc_feature (183)..(183): n is a, c, g, or t
  modified_base (293)..(293): a, c, t, g, unknown or other
  misc_feature (293)..(293): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttctggtggcagcagcaacgaggtgcccactctcaggttcagctggtncagtctggagctggaggtgaagaacgccgtggggcctacagtgaacggtctcctgacaaggtcttctggttaatacctttagacctattagtggttatctaacgtgggtncgacgacggcccctaggaacaggccatggaggtcggaggtcgggaagttggacttcgaggtccgtacgttaaacaaacttaacgtaaaccacgtaactaactagtacgaccaaacgtaacggtaacgttacccggaagggtacccaaggtaaccgttacccgaaccgtacgaacccggaataacggtaactacgaaccttacccgaacgtacgaccaaccgtacgtaccctacgaaggtcggtacgtcggagggtacgacgtacgtaggaactcgttaccgaggtacccgtaccggtaggttcccgtttaacgggtttctcgggttaacggcgtaaacgggttacctaaggaaccgttaaggtttaacgttacgggttaaccggtagtaaccggttacggggtaaccgggtcccggtaaaccccgggg

SEQ ID NO: 67805 - DNA, 697 bp, Homo sapiens
  misc_feature: GYAE6OF01E4O0T.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttccgtggtggcagcagcaacaggtcgcccactctcaggttcagtctggtgcagtctgggagcgtggaggtagaaagaaggcccggtggggcctacgaggtggaaggttcctccgtggaccgaaggtctttcgttaggtttacttaccttttagactaattagtaggttaactcgtaacgtgggtgaccgacgccgggtccccgtaggaacctaacgggtccagtacggtaggtaggagtaggggagtaggtactcgacgcgtacttaaacaaataacgtaacaacactactagtacgacctaacgaagtaacgtccgaaggacaggactccctaaccgtacgaaccacaagtacctaacaccgtaccgaacgacgacgaaccgacgtacaacgtagtacggacgtacgtagggaacgtcgtacgagtaacgtctaccgtacggacggtaaccgttaccgggttcgttttagttacggtgtacggaacggtagtaatacggtaattaagtttacgtaaggtacggttacgacggttacgggccgggtaccggtaacccggg

SEQ ID NO: 67806 - DNA, 712 bp, Homo sapiens
  misc_feature: GYAE6OF01ELNL7.37.37.D04.1.454.CMB.1.raw
  modified_base (206)..(206): a, c, t, g, unknown or other
  misc_feature (206)..(206): n is a, c, g, or t
  modified_base (333)..(333): a, c, t, g, unknown or other
  misc_feature (333)..(333): n is a, c, g, or t
  modified_base (503)..(503): a, c, t, g, unknown or other
  misc_feature (503)..(503): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagcccacccttgtctgtgtctccgaggggaaanacgccaccctctcctgcgagggccagtcagagttgttagcagctaacttacgccttacggtaccagacgaacgaaaccgtggaccaggcctacccgaggtccttaccctcatccgtagttcgggtcncactcccgaccggtacgggcctacgtcggtacctccccgaggacccgtacggttcgaggttcggacgtaggttcgggtacgtacgggactaggtacgttccacttccgtaaccaccgtataccgagtacccgacgtcccgtgacccgtagtacgttaagtaaacggtttntttttcggactttaggttttttaacttccggttatacgtaacgtacgttaagtttaactttagtttacccgttcgtacccgtttcccgtagggttacggttacccggttacgggaccggaaaccggggtaacgtaagggtaacgtaaacgaaaccggtaaaggtaccgttagggaccgtacgtccggacttaccctacgttcgttaccg

SEQ ID NO: 67807 - DNA, 736 bp, Homo sapiens
  misc_feature: GYAE6OF01DMC6P.37.37.D04.1.454.CMB.1.raw
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
  modified_base (606)..(606): a, c, t, g, unknown or other
  misc_feature (606)..(606): n is a, c, g, or t
tcagtagtgtagatcacgaccggtgctcgatttagtagcatactgttgggtttggggaacccaaaaaccacacccctccttgggagaatcccctagatcacagctcctcaccatggactggacctggagcattcctttttcctggtggcagcagcaacgaggtcgaccccactctcgaggttcagcgtggtcgctagtctggagtcgtaggaggtagaaagacgtccggtcggggtacctgaggtggaacggttcctcctcggacgaacggtcctttcggttacggtttaacttaccgtttagacttaaatttagtacggtaactacggaacggttggggccgtacgtacggaccggtaccccgtgggaacctaacgggcctaaggttcgggagttagggaggttaggggacgttggtactaccggagtaccgtactttaaacaaagtttaacaaacnccaanaacgtttancgtaaccacgttaaaggtaccgtacgacggggactaggtaccttaccgaccgtacgaacctacgaactaccgtaacaaccgtcccgaaggctaacacgatccctaagacgtagaccgagtacggagggttaccncgtaagactacgtgtaacgaccggtaccggtacggttcgtttacgttagtacggaggtacgtaagtaacgtagttaagtaagtttacgaagttacggttacgtacgggtacggtccgggtcggtaacccg

SEQ ID NO: 67808 - DNA, 922 bp, Homo sapiens
  misc_feature: GYAE6OF01BK5CD.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaacgccgtggggcctcagtgaaggtcctccgtgacgaaggtcttcgttaggtttacttaccgttttaggacctaaatttacgttggttaactacgtaaccggttgggggtacgaccggtaaccgaccgggtacccccgttagggaaccgtaacgggaccctaaggttacgggtaagggttagggtaagggttagggggtaagttcggggtaacttaccggaacggtaccggttaacttttaaaaccggtaaaaacttaaaaccgtaaacctaaccctaaacgtaaccgttaacgtaccggtaacccgaaaaccggttaaacggttaaaccggtttaccccggggaaacgggggtacctaaacgggtaaccggttaccccgtaaccccggttaacgggaacccctaaacggtaaaccgtaaaccgttaacccgtaacccggttaacccccgaaaaccgggtacccgaaaccgtaaaccccggaacccggtaacccttaacggtaaggttaaccggggaacgtaccgggttaacggggaaccgggtacggtaacccgtaagggtaacgttacggttaccgttaaccgggaaaccggttaccggtaccgggtttaccgtttaggtttacgtcggtaggaacggtaagtaacggtactaaggttaacgttagttaacggttaggtacggttaccgtacgggtacgggaccgtaacccgggg

SEQ ID NO: 67809 - DNA, 717 bp, Homo sapiens
  misc_feature: GYAE6OF01DNN6D.37.37.D04.1.454.CMB.1.raw
tcagtagtgtagatcacgaccggtgctcgatttagtagcatactgttgggtttggggacccaaaaaaccacaccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcgaaggtcttcgtggttaacttacctttagactaaattagtaggtactacgaacgtgggtagtccgaacgacggccccgtagggaacaacggcctagtaggtacggtggaggtagggagtaggactcgacggactacttaaacaaattaaaactaacaacctaataacgtaatacgactaaacgtaagtaaacgttccgaagggtcaacggtacgtacccaacccgtacgaacccaacgaacgtaacgtactaactaccccgaacgaacgaccaaccgaacgtaccctaacgaggttacggacggacgtagggaacggacggtaaccgtaggtaacgtaacgttacggacggtaaccgaacccggttacggtaccggttttagttttaccggaggttacggacggtaaggtaacgtaagtaaagttaaagttaagttaacgtaacgttacggtacgttacgggtcgggccggtaaacccgggg

SEQ ID NO: 67810 - DNA, 680 bp, Homo sapiens
  misc_feature: GYAE6OF01A67WM.37.37.D04.1.454.CMB.1.raw
  modified_base (284)..(284): a, c, t, g, unknown or other
  misc_feature (284)..(284): n is a, c, g, or t
  modified_base (435)..(435): a, c, t, g, unknown or other
  misc_feature (435)..(435): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcgaggttcagctggtgcagtatggagctggaggtgaagaagccgtgggcctgagtgaaggtctcctgcaaggcttctggttataccgtttagctaattagtggtatcaagtgggtncgacaggccctggacaggccagtggagtggagtgggatggactcgagcgtacttaacaaataaacgtaacaacacgtaactaatcgactaacgaaggtaaacgttccgaaggggactaaacggtacgtactaaccccgtagaacccgtaanaacgtaactaacgtactaccgaacgaacgtacacgacgactagagtcggagtcgtaggaacggacgtaccgttacggaagtacgtaccgtacgaaccgggtaaccgtacccgggtaccgtttaccggttttaagccgggttaaggtacccggtaacggtaaacgtaaacggtacgtttaaaagttaacgtttaacgtaaagtacccggttaagttacccgggtacggggtacccggtaaacgggg

SEQ ID NO: 67811 - DNA, 689 bp, Homo sapiens
  misc_feature: GYAE6OF01E26XN.37.37.D04.1.454.CMB.1.raw
  modified_base (289)..(289): a, c, t, g, unknown or other
  misc_feature (289)..(289): n is a, c, g, or t
  modified_base (641)..(641): a, c, t, g, unknown or other
  misc_feature (641)..(641): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctcgagtgaaggtctccgtgacaaggtcttctgttacttacctttagctaattagtggtatacgaagtggggtnacgacgacggcccgtaggaaccgaaggccaagtcgaggtcggaagtggggactggtactacgacgacggtacttaacaaaagttaaacctaaacgaacaacctaactacgtcgacaacgaaggtaacgttaccgaagggacacggtactaccgtaaccctacgaaccacgtaacgaacgtaacctaaccgacccgtaacgaccgaacgtaaccgaccgtaacctaacggtacgtacggacgtcgtaaggaggacgtaccgtaaggacgtactacggttaccgaaccgtacgtaccgggttcgtttacgttacgtaggacgtacggtaacgtagtaacgtaacgttagttaanaaacggttacgagggtaacgttacgggcgggtaacccggtaaaccggg

SEQ ID NO: 67812 - DNA, 648 bp, Homo sapiens
  misc_feature: GYAE6OF01BIE7N.37.37.D04.1.454.CMB.1.raw
  modified_base (161)..(161): a, c, t, g, unknown or other
  misc_feature (161)..(161): n is a, c, g, or t
  modified_base (281)..(281): a, c, t, g, unknown or other
  misc_feature (281)..(281): n is a, c, g, or t
  modified_base (337)..(337): a, c, t, g, unknown or other
  misc_feature (337)..(337): n is a, c, g, or t
tcagtagtgtagatcacgaccggtgctcgatttagtagcatactgttgggtttggggacccaaaaaccacacccctccttgggagaatcccctagatcaccagctcctcaccatggactggacctggagcatccttttcctggtggcagcagcaacaggtncccactctcaggttcagctggtgcagtctggagcgtgaggtgaacgagcctggggcctcgagtgaaggtctcctgcaaggctctggttatacttagctaattatggtatcaacgtgggtncgtacgacggccctaggactaggcctagtgacggtggactggggattgggactcgngtaccgtacttaacgaaataactaaacacgaacactagacgtacaacgtaaggtaaccgtacccgaaggggtcaagtacgtacccaccgtaggaccaagaagaactacacgtccaacgtcgacacacgtccctacagtacggagcgtaggacgacgtccgtagacgtatccgtaggacgaccggtaacggttccggttacgttttacgtgggttaccggacgtacggaaggttaacgaacggttaaatttaggttaaccggtaaagttacgggtaaaccttacggggtaccggggccccggtaaacccggg

SEQ ID NO: 67813 - DNA, 833 bp, Homo sapiens
  misc_feature: GYAE6OF01B1CSQ.37.37.D04.1.454.CMB.1.raw
  modified_base (137)..(137): a, c, t, g, unknown or other
  misc_feature (137)..(137): n is a, c, g, or t
  modified_base (158)..(158): a, c, t, g, unknown or other
  misc_feature (158)..(158): n is a, c, g, or t
  modified_base (187)..(187): a, c, t, g, unknown or other
  misc_feature (187)..(187): n is a, c, g, or t
  modified_base (648)..(648): a, c, t, g, unknown or other
  misc_feature (648)..(648): n is a, c, g, or t
  modified_base (702)..(702): a, c, t, g, unknown or other
  misc_feature (702)..(702): n is a, c, g, or t
  modified_base (733)..(733): a, c, t, g, unknown or other
  misc_feature (733)..(733): n is a, c, g, or t
tcagtagtgtagatcacgaccggtgctcgatttagtagcatactgttgggtttggggacccaaaaaccacacccctcttgggagaatcccctagatcacagctcctcaccatggactggacctgagcatccttttcncggtgcagcagacacaggtcncccactctacgaggttcagtctaggtcgntacgtcgtggacgtcgtagggagtagaaggaacgccggtcggggacctacgaggtacggtaacgtcgtcgtacgacgaacggttctttcgacggtttaactacgtttacgatttaagttcgtacgttaacgacgtaaccgggttgggtccggaccgaccggtaccccggtacccccggtagggaaccgtaacgggtccgtaaaggttacggggtaagggtaccggggtaaggggtacggggtaacgtcggggtaacctacggtaacgtaccggttttaaactaaaacggaaaaactttaacgaaaccctaactaaccgtaagtttacgacccgtaactaaaggaaccggttaaccggtaccgtacgggaacccgtagtaaccccgttacaaccccgttagaaccccgagttaacgaaccttaccgaaactcccgaacggacacgacctaacgactaacggngtacgggatacgaggacgtcgaccgtaagtacgacgtacgaccggtaacccggngtaacccggttttggttaacgtttcccgggnggttaaccggacggtaagtacgtaacgttaggtaacttaggttaaacggaccgttagggaacccgggtttaacgggaacccgggggttccgtaaacccgg

SEQ ID NO: 67814 - DNA, 787 bp, Homo sapiens
  misc_feature: GYAE6OF01DJI6Q.37.37.D04.1.454.CMB.1.raw
  modified_base (616)..(616): a, c, t, g, unknown or other
  misc_feature (616)..(616): n is a, c, g, or t
  modified_base (724)..(724): a, c, t, g, unknown or other
  misc_feature (724)..(724): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtcgcccactctcaggttcagctggtgcagtctggagctggaggtagaagaacggccggtcgggggacctacgaggtaggtaaacgggttcctccgttaggaccgtaaacgggtcctttcgtttagggtttaacttaaccgttttacgactaaatttagtaggttactacgtaacggtggggtacgaccggaacgaccgggtaccccgtaggaaccgaacgggccctaagtagggagggtacgggtaaggttaggggacgtacgggtacttacgacggtaccgtactaaaacgtaaacgtaaactaaccaaccgtaactaactaacgtcggaactaaacgtaacggtaaacggttccggacgggactaacggtaaccgtacccaacccgttacggaaaccaacaacggtaactaactacgtacgaaccgaacgtacccaacgtacgacctaacgaaggngggtacacggtaaggacgggaacacccgtaggactaacgttcgaaccggacgtaccgaccgggtttccgttaagtttcgaggtaccagggtaacgaagttaaggtaanaaagttttagaacggttaaggtaaccgtacggttaacgggcccggggtacgtaaacccggggg

SEQ ID NO: 67815 - DNA, 705 bp, Homo sapiens
  misc_feature: GYAE6OF01AFZWM.37.37.D04.1.454.CMB.1.raw
  modified_base (126)..(126): a, c, t, g, unknown or other
  misc_feature (126)..(126): n is a, c, g, or t
  modified_base (151)..(151): a, c, t, g, unknown or other
  misc_feature (151)..(151): n is a, c, g, or t
  modified_base (352)..(352): a, c, t, g, unknown or other
  misc_feature (352)..(352): n is a, c, g, or t
  modified_base (579)..(579): a, c, t, g, unknown or other
  misc_feature (579)..(579): n is a, c, g, or t
  modified_base (639)..(639): a, c, t, g, unknown or other
  misc_feature (639)..(639): n is a, c, g, or t
tcagtagtgtagatcacgaccggtgctcgatttagtagcatactgttgggtttggggacccaaaaaccacacccctccttgggagaatccctagatcacagctcctcaccatgactggacctggancattccttttcctggtggcagcagnaacgaggtcgccactctcaggttcagcgtggtgctagtcgtggagtcgtggaggtacgagaacgcgtcggggcctcgaaggtggtaaccggtctccgtgaccgaaggtctttcgtggttaacttacttagactaatttagtggttacaccgtaacggtggtacgtacgacgcggaccccgtagacgtacggcaggtgacgnggtaacggtgggtctagggactcggtacgtacgtaccttaaagtaaacgtaactaaccgaaactactaccggttaataccgacgtaaaccgtaacggtacggttaacgggcgtaacgtaacggttaccgaccctaacccgtagaaccgtaacacgtaacacgtaccgtacgaaacgtacgaaccgtacaccgtaactacggtagacggtacgacgttaggaccgacncgtagagtccgtacgacggtacgtaccgtcggttaacgtcgttacggtacgtcggtaacnggtttaacgacgttaacgtacttaaggttacgtacgtaggtacccgtcggacggtccgtaaccggg

SEQ ID NO: 67816 - DNA, 914 bp, Homo sapiens
  misc_feature: GYAE6OF01AYWS0.37.37.D04.1.454.CMB.1.raw
tcagtagtgtagatcacgaccggtgctcgatttagtagcatactgttgggtttggggacccaaaaccacacccctccttgggagaatcccctagatcacagctcctcaccatggactggacctggagcatccttttccgtggtggcagcagcaacgaggtcgccccactctacgaggttcagtcgtgggtagcaagttcgtgggagtcgtggagggtagaaaggaacgtccggtggggtccctagagggttaggtaacgggttccttcccgtggaccgtaagggttcctttcggttagggtttaacttaccgtttagtacttaatttaggttggttaacttacgtaacggttggggtcggacgtaaccggaccgggtacccccgttagggaaccgtaacggacccgtaggttacgggaaggttggggaaggttacggggagtagggtactacggtacggtaccgtaacttaaacgaaactaaactaaccgaaccaacctacgtaacgtacgaccgtaacggaacggtttaacggtcccgtaagggaaccgtaacggtaccgtacccgacccgtaaccggaccctaacgaagtaactacccgaacgtacccgaacgacgtaccgactaccgtaaccgtacgaacggtacggacgtacggtagggtaaccgggtacgtaccgggtagtacggttaaccgtcggttaaacccgggaccggttaacccggggtaaccccgggtttacggtttttaccgtttaccgggttcgggttaaccggacgggtaaagttaacccggttaaacgggttaaagtaaacgggtttttaggtttaaccggttaaacgggttacccgggtaaaaccgggttaaccggggggttccccggggaaaacccggggttaaaccccccgggggg

SEQ ID NO: 67817 - DNA, 850 bp, Homo sapiens
  misc_feature: GYAE6OF01CLPCR.37.37.D04.1.454.CMB.1.raw
  modified_base (158)..(158): a, c, t, g, unknown or other
  misc_feature (158)..(158): n is a, c, g, or t
  modified_base (165)..(165): a, c, t, g, unknown or other
  misc_feature (165)..(165): n is a, c, g, or t
  modified_base (187)..(187): a, c, t, g, unknown or other
  misc_feature (187)..(187): n is a, c, g, or t
  modified_base (194)..(194): a, c, t, g, unknown or other
  misc_feature (194)..(194): n is a, c, g, or t
  modified_base (216)..(216): a, c, t, g, unknown or other
  misc_feature (216)..(216): n is a, c, g, or t
  modified_base (420)..(420): a, c, t, g, unknown or other
  misc_feature (420)..(420): n is a, c, g, or t
tcagtagtgtagatcacgaccggtgctcgatttagtagcatactgttgggtttgggacccaaaaaccacacccctcttgggagaatcccctagatcacagctcctcaccatggactggacctggagcatcctttcctggtggcagcagcaacaggtcncccatcncgaggttcagctgtagctagtntggacgngtggaggtagaagaacgtccgnggggccttacagttacggaaggtcctaccgtgacgaagggtctttacgtaggttaacttacgtttagataagttttagtaggttataccgtaaaggtcgggttagaccgtaccgtacggcccccgtaggaaccgaaacggtccaagttaggacgttagggaagtttggggaagttggaacgttaccgaggtacgtactttaaanaaacgttaagtaaaccaacaacgtaaactacgtacggaaccaaagtacggtaaacgttacccggaagggcttaaacggacgttaaccgaaccccgttaccggaacccgtaacgaacgttaaaccgtaactaaaccgttaccccaaacggtaacggaaccaaaccgtaaccgtaaccgttaacccggtaaacggttaggaccggtaacgtaagggtaaaccggggtaacgtacccgtaacgggttagaaaccccgtagttaccgaacccggttaacggacccgggtttacccgtttaaggttttaaccggtagaccggggtacgtaaaaggtaccgttaaaggaccgttaaatttaaaccggtttaaaggtaaacggttttaaaccgaccgggttaaacgggtgggggtaaccccgttaaaccccgggggg

SEQ ID NO: 67818 - DNA, 270 bp, Homo sapiens
  misc_feature: GYAE6OF01ATY4Q.37.37.D04.1.454.CMB.1.raw
  modified_base (231)..(231): a, c, t, g, unknown or other
  misc_feature (231)..(231): n is a, c, g, or t
  modified_base (252)..(270): a, c, t, g, unknown or other
  misc_feature (252)..(270): n is a, c, g, or t
tcagtagtgtagatcacgaccggtgctcgatttagtagcatactgttgggtttgggtgcccaagctgctggagggcacggtcaccacgctgctgaggagtagagtcctgaggactgtaggacagcccatcggtcttcccctggccaccctcctccaagagccacctcgtggggcacgagcggccctgggctgccgtggtcaaggactacttccatctacactactgacggnggctggacgacggcacatagnnnnnnnnnnnnnnnnnnn

SEQ ID NO: 67819 - DNA, 651 bp, Homo sapiens
  misc_feature: GYAE6OF01BU8KD.37.37.D04.1.454.CMB.1.raw
  modified_base (511)..(511): a, c, t, g, unknown or other
  misc_feature (511)..(511): n is a, c, g, or t
  modified_base (525)..(525): a, c, t, g, unknown or other
  misc_feature (525)..(525): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagacgccgtgggcctcgagtgaagtctcctgcgagtcttctggttactactttagctaattagtggtaactacgtaacgtgggtcgcgtacgacggccccgtaggaaccgaacggccagtagaggtggagtagggagtaggtactacgaacgtcgtacttaaacaaattaaacaaaccaactaactactagtacgaacaacgaaggtaacgttccggacggacgaagtaccgtacccacccgtacaacccaacgtacaacgtaccacgtacccgaacgtacacaccgaccgtacctacgagtcggacncggtacgagggacnccgtaagacgtatcgtaacggacgtacgacgggttcctttagtttccgtggtccgaggtacgtaagtactagtaaattgttaagtaaggtacggttaaccgtcgggtcgggtaaccggtacccggg

SEQ ID NO: 67820 - DNA, 801 bp, Homo sapiens
  misc_feature: GYAE6OF01A8I3Z.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtcgcccactctcaggttcagctggtgcagtcgtggagcgtggaggtcgaaagacgccgtcggggcctcgaggtgtaacggtctccgtgaccgaggtccttcgtaggttattaccgttagactaagtttacgtaggtacttacgaacggttgggggtcaccggtaccgaacggccccgttacgggaaccgtaaacgggcccgtaagttacgggaggttacgggtacggttaggggaagtacgggtaacgtacggtaacggtaccggttaacttaaacgttaaaccgttaaaacaaacgtaaccgaaccgttaacgtaattccggaaccgaacggtaaacggttaaccggttaccggaaagggtacccgtaaaggtacccgtaacccgtaaccccggttaaccgaacccgtaactaacggaacttaacccgaacttaacccccgaacgacggtaacctaacgaacccgtacctaaacgtacgacgggtaagtccgtaagggaacgttaccggacgtaacgacggtacgttcgaaccggaacgaccggttaccggtacggtttcgttacggtcggtacgacggtacgtagtaaacgtagtagttagtagtacgttcggaagtcgggtacgggcgtaaaccccggg

SEQ ID NO: 67821 - DNA, 733 bp, Homo sapiens
  misc_feature: GYAE6OF01D2LHI.37.37.D04.1.454.CMB.1.raw
  modified_base (163)..(163): a, c, t, g, unknown or other
  misc_feature (163)..(163): n is a, c, g, or t
  modified_base (329)..(329): a, c, t, g, unknown or other
  misc_feature (329)..(329): n is a, c, g, or t
  modified_base (422)..(422): a, c, t, g, unknown or other
  misc_feature (422)..(422): n is a, c, g, or t
  modified_base (478)..(478): a, c, t, g, unknown or other
  misc_feature (478)..(478): n is a, c, g, or t
  modified_base (641)..(641): a, c, t, g, unknown or other
  misc_feature (641)..(641): n is a, c, g, or t
tcagtagtgtagatcacgaccggtgctcgatttagtagcatactgttgggtttgggacccaaaaaccacacccctccttgggagaatcccctagatcacagctcctcaccatggactggacctggacgcattccttttcctggtggcagcagacaacagggtnccctatctcgaggttcagctggtgcagtctggagctgaggtagaaagaacgccgtaggggccctagagtaggaacggttctccgtaggaccgtaaggtcctttacgttaggtttaacttaacctttagacttaaagtttagtaggttactacgtaacgtgggtacncgaacgacggtaccccgtaggaaccgtaaggccaagttggaacggtggagtagggagtcggatacgacggtacgtacttaaacgaaacttaanaaccgaacaacgtacttaacgacgtacaaacgtaacggtaacgtacgacggggtanaaggttaacgaccaacccgtagaactaacgaacgtaactataaccgttacgaacgaacgacgaaccgacgtaccgtaacgacgttaggaacgtcggtaagacggacgaccgtagtaagtacgtagtacggaccgaacggtaccggttacttacggttttaacngggttacgtaccggaagtaacggtaacgtaacgtaaacgttagttaacgttaacgtacggtagttaaccggtaggggacccgtaaacccggg

SEQ ID NO: 67822 - DNA, 359 bp, Homo sapiens
  misc_feature: GYAE6OF01D7EMN.37.37.D04.1.454.CMB.1.raw
  modified_base (302)..(302): a, c, t, g, unknown or other
  misc_feature (302)..(302): n is a, c, g, or t
  modified_base (339)..(359): a, c, t, g, unknown or other
  misc_feature (339)..(359): n is a, c, g, or t
tcagtagtgtagatcacgaccggtgctcgatttagtagcatactgttgggtttgggacagagttcactctcaccatcagcagcctgcagtctgaagtattctgctagttttatttctgtcagctaagttaattaactttacgtcggtccctccgttacggtcggtaccggtttccgggaccgaaagggtaacccgaaagggttaggaaaattaccgaaaaacgtaacgttggtgggcctcgaccacctattccgtgttcctctactccttcccgacactctagaacttcctaacacttacgnggacggccggtacgtggacgtaacggcgtactagagnnnnnnnnnnnnnnnnnnnnn

SEQ ID NO: 67823 - DNA, 786 bp, Homo sapiens
  misc_feature: GYAE6OF01BRALG.37.37.D04.1.454.CMB.1.raw
  modified_base (102)..(102): a, c, t, g, unknown or other
  misc_feature (102)..(102): n is a, c, g, or t
tcagtagtgtagatcacgaccggtgctcgatttagtagcatactgttgggtttggggacccaaaaaccacacccctccttgggagaactcccctagatcacngctcctcaccatggactggacctggagcattccctttttccgtggtggcagcagcaacgaggtcgccccactcgtcaggttcagtcgtggtgcgagtcgtgggagtcgtggaggtaggaaggaacggcccggtcgggggtcccttacgaaggttacggtaaacggttcccttccgacgccggtaacggttcctttttccgttaggttttaactttacccgttttaggaacttaaagttttagtagggttaactaccggtaaggttgggtaccgaccgtacggaccggtcccccggtaggaacgaacggccagtggacggttagggaggttagggacgtggtaacgtcgaacgtccgtaacctttaaacaaattaaaacaaaccaacaaccgtaatttagacgacaacgtaaggtaacgtacgagggacgacgacgtccctaaccgacgaacgtaacaacgtacaactaccgaacccgaactacgaaccaccgtacgacttaaacgacggtacgacgcggaggtaacccgagccgtagacgtactacggtaccgaccgtacggtacccggtacggttttagttcggtacgagtacggtaagttaccgaagttaacgaaagtttaattacgggttaagtacccggttaaccgggttaaacggccggggtaaacgggttaaccccgg

SEQ ID NO: 67824 - DNA, 708 bp, Homo sapiens
  misc_feature: GYAE6OF01D7ULF.37.37.D04.1.454.CMB.1.raw
  modified_base (140)..(140): a, c, t, g, unknown or other
  misc_feature (140)..(140): n is a, c, g, or t
  modified_base (157)..(157): a, c, t, g, unknown or other
  misc_feature (157)..(157): n is a, c, g, or t
  modified_base (266)..(266): a, c, t, g, unknown or other
  misc_feature (266)..(266): n is a, c, g, or t
  modified_base (389)..(389): a, c, t, g, unknown or other
  misc_feature (389)..(389): n is a, c, g, or t
  modified_base (477)..(477): a, c, t, g, unknown or other
  misc_feature (477)..(477): n is a, c, g, or t
  modified_base (680)..(680): a, c, t, g, unknown or other
  misc_feature (680)..(680): n is a, c, g, or t
tcagtagtgtagatcacgaccggtgctcgatttagtagcatactgttgggtttggggacccaaaaccacacccctccttgggagaatcccctagatcacagctcctcacatggactggacctggagctattcccttttcnggtcggcagcagccaanaggtcacccactctacgacggttcagtcttggtcgactagttcgtggactcgtaggacggtgaaaagccgtccgtgggcctgagtagaccgtcctacgtgactacggtnttcgttagttactactactacgtatttgacgttactaccgaggttacggtacgctaaccggccggtcctaggacgacgtcaggttcgaggtggtaaggtggatcggactagcgtactctaaanacgtaacaccgatacgatcagactaacgacgtacgtcgagtacaggtccttaccacgtacgacctagaacgtactaccgactaaccgntaaccgctaaccgtaccgtaacccggtatagggggttccaacgtttcggaacggggagtcccgtaacggttacgaacgttccgtaccggaaccggtcccgaacggtttcgggttaaccggtttcgttacggttacgcgggttaaaccggaagttaccggtataaaacggttcttaaacttagggtaaacgcgggtttaacccnggggttaccccgggtacccgtaaccggg

SEQ ID NO: 67825 - DNA, 930 bp, Homo sapiens
  misc_feature: GYAE6OF01BYDS5.37.37.D04.1.454.CMB.1.raw
tcagtagtgtagatcacgaccggtgctcgatttagtagcatactgttgggtttgggacccaaaaaccacacccctccttgggagaatcccctagatcacagctcctcaccatggactggacctggagcatccttttccgtggtggcagcagcaacgaggtcgcccactctcgaggttcagcgtggtgcgtagtcgtaggacgtcgtaggaggtaggaaacggaacggtccggtcggggtcctacggaaggttacggtaaacgggttccttaccgttcggaccgtaaacggttccgttttccgttagggttttaacttaaccgttttaaggaccttaaagttttaacgttaggttaacgttaccgtaaaccggtggggttacggtacggaaccgaccggtccccgtagggtaaccgaacggaccgtaggttacgggaggtagggtaggtacgggtagttaggtactacgacggtaccgtaaccgttaaactaaacttaaaaccgtaaaccaaccgaaacctaacgttacgacgtaccaaacgtaacggtaaacggttaccggaaacgggtaccgaacggtaaccggtaccctaaccccggtacgtaaacccgaagtaaaccgtaactaacccgtaaaccgttaaccccggaaacgggaactaccaaacccgtacgtacccgtaaccgtaaggtaccggaacgtcggtaaaggccggaacgtcgtaaccggagttaccggttacggaacggtaacccgtaccgggttaaccggggtttcccgttttaaagggttttccgaggttaacgggacgggtaaagtaacccgggttaagtaaaggtttaaaccgtttacggttaaaggttaaaccgggtaacgggttacccggttaacgggggttaacccggggaaccccggtttaaacccgggggg

SEQ ID NO: 67826 - DNA, 873 bp, Homo sapiens
  misc_feature: GYAE6OF01CUFWG.37.37.D04.1.454.CMB.1.raw
  modified_base (523)..(523): a, c, t, g, unknown or other
  misc_feature (523)..(523): n is a, c, g, or t
tcagtagtgtagatcacgaccggtgctcgatttagtagcatactgttgggtttggggaggaactgctcagttagacccagacggaaccatggaagccccagcgcagcttctcttcctctgctactctggcctcccaagactaacccatggaagaaaagttagtagaactggaaccgctagttcctacccgaagcccctaacccgttgtccgtaggttcgtaccgtaccgggaaaggggaaaacgccgtaccccctaaccccgttcctaccttaggaccgtaacgggggcctaaacggtacctaaagggtacgttagttaacgaccgaacgtaacgtaaaccgttttaccggaccgtttaacggtaacccgaacggtaaccgaaaacgtaaaaaccccggttcgggaacccgtacgggtaccctaacccggaggtaccctacctacgtactaccgtatcggtacaccgactacccgaacgtacggccctacgtacgtactacccgacgtcggtaacgttacggngtacggcgtacggtggggtaccgtaggtacgtaacgtgtttaaccaccttacgttaacccgacgacgttaacaacggtccgacgtacctacggtaacgtacgttgttaaacgtatttaaacggttttccgaagttttaacgtttttcttacgtacgtactacggtaacgttaaataaccgtttaacgttaccgtccgttaaccttaccgttaacgggtaccggttaacgggtacccggtaccggaaaagggtccggaaaacggttaaacggaaattaacccggtaaaacgaacgggttacggtaaacggttccaacccgttacccgtaaacctgtttcccgtttaaccgg

SEQ ID NO: 67827 - DNA, 265 bp, Homo sapiens
  misc_feature: GYAE6OF01EL59O.37.37.D04.1.454.CMB.1.raw
  modified_base (246)..(246): a, c, t, g, unknown or other
  misc_feature (246)..(246): n is a, c, g, or t
  modified_base (252)..(265): a, c, t, g, unknown or other
  misc_feature (252)..(265): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtccttccccctggccacccctcctccaagagcctacctcgtgggggcacacgccggccctgggctcgcctggtacagactacttcatctacactactgagcggctggcaggcncatagnnnnnnnnnnnnnn

SEQ ID NO: 67828 - DNA, 738 bp, Homo sapiens
  misc_feature: GYAE6OF01AIFI3.37.37.D04.1.454.CMB.1.raw
tcagtagtgtagatcacgaccggtgctcgatttagtagcatactgttgggtttgggggacccgaaaaaccacacccctccttgggagaatcccctagatcacagcctcctcaccatggactggacctggagcatccttttcctggtggcagcagcaacaggtgcccactctcaggttcagctggtgcagtctggagctgacggtgaagaagccgtggggcctcgagtgaggtctctgcaaggcttctggtttactacctttagacaattatggtatcaacgtgggtgcgacgacggccccgtaggaaccacggacctagtgagtcggagtgggtagtggacgtgacgccgattaccgaaataactaacgacactactatcgacaacgagtacgttacgacggcaggactccacctagaaccatagactacactacccgaagtacgacctaacggacctcccttaaacgacgtacgggaccgtacgtagggaaacggacccgtaccgttagggaacgtacgtaccgtaccgggtaacccggtaaccggtaaccccgggttcgggttttaaccgttttaacgggtgggtttaacccgggaacgggttaaaccgggttaaacggttaaaaccggtaaagggtttaaactttaagggttttaacgggttaaacggttcgggtaaaacccccggttaccggggtttacccggggggaaacccggtttaaaaccccccgggggg

SEQ ID NO: 67829 - DNA, 1057 bp, Homo sapiens
  misc_feature: GYAE6OF01AQYHT.37.37.D04.1.454.CMB.1.raw
  modified_base (127)..(127): a, c, t, g, unknown or other
  misc_feature (127)..(127): n is a, c, g, or t
tcagtagtgtagatcacgaccggtgctcgatttagtagcatactgttgggtttggggacccaaaaaccacacccctccttgggagaatcccctagatcacagctcctcaccatggactggacctggngcattcctttcctgggtggccagcagcaacgtaggtcgccccactcctcgtacgggttcaggtctgggtgctagtcgtgggagtcgtcggtaaggtacggaaaggtaacggtcccggtgggggtaccctggtaaccggttaggaaccggggtttcccttcccggtacggtaccggtaaacgggttccgttttacggttacgggttttaaacctttaccccgtttttaggaaccgttaaaagttttaacggttgggttaaccctttaccggtaaaacgggtttcgggggttacgacccgggtaaacccggtaccggggtcccccccgtttaaggggaaacccggtaacgggaccccctaagggtttaggacgggtttagggagggttaccgggggttagttacgggaacttaccgggacgtacccgggttaaccttaaacggtaaaactttaaacaaaccccggtaaactaacccggtaaaccttacgaaccggaaccgtttaaaaccgaacgggtttaaccgggtttaacccgggaacgggtaccgttaaacgggtacccgttaccccaacccccgggttacgtaacccgaaccgtaaagtaacccgtaaccgttacccgaaccccgaacggaaccggtaccctaaaccgggacccgttaaccccggtaaacgtaccggggttaaccggaacgggtaccggtacggtaaccggggtaccggttaccggtaacgggttaaccggtaacggttttaacccgggacccgggttacccggttaaccccgggttacccggggtttacccggtttagggttttaccgtccgggttaaccgagggtaccggttaacggttaacgtacgtaaagtttacgtaacgggttaacggtacgggtaacggtcggggtacccgggtaccgggtaaacccgggg

SEQ ID NO: 67830 - DNA, 666 bp, Homo sapiens
  misc_feature: GYAE6OF01EIWZ5.37.37.D04.1.454.CMB.1.raw
  modified_base (301)..(301): a, c, t, g, unknown or other
  misc_feature (301)..(301): n is a, c, g, or t
  modified_base (416)..(416): a, c, t, g, unknown or other
  misc_feature (416)..(416): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtctggagctggaggtgaagaacgccgtggggcctcgaggtagaaggtctcctgacgaaggtcttcgtggtttataccgtttagactaattagtggttactacgaacgttgggtncgacacggccctaggacaaggccagtgaggtggagtgggatggatcgagtcgtacttaaacaataaacaacaacaacgtactagtcgacaacgtaacggtaacgtcgaacggganaacggtacgtacccaccgtacgaaacccaagtaacgtaactacgtaacgtaccaacgacgacaacgaccgtacctaactaggtacggacgtcgtaaggacggtacgtctacgtacgtagttaccgacggaaccgtaccggtaccggtttacgttacgttttacggtggtacggtacgtaaggtaacgtactaaagttaaagtcgttaagtaacgacggtaaccgtacggttaccggggcgtaacccgggg

SEQ ID NO: 67831 - DNA, 754 bp, Homo sapiens
  misc_feature: GYAE6OF01DI6FG.37.37.D04.1.454.CMB.1.raw
  modified_base (156)..(156): a, c, t, g, unknown or other
  misc_feature (156)..(156): n is a, c, g, or t
  modified_base (164)..(164): a, c, t, g, unknown or other
  misc_feature (164)..(164): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (328)..(328): a, c, t, g, unknown or other
  misc_feature (328)..(328): n is a, c, g, or t
  modified_base (453)..(453): a, c, t, g, unknown or other
  misc_feature (453)..(453): n is a, c, g, or t
tcagtagtgtagatcacgaccggtgctcgatttagtagcatactgttgggtttgggggaggaactgctcagttaggacccagacggaaccatggaacgccccagcgcagtcttctcttcctcctgctactctcggctccagactaccactaggaanaaatagtnatgacgcacgtctccacgcccacctgtctgtcgtctacggaagggaaacncgtcccacctccnctgccgacggccagnaagtagtgtagcagactaacttccggctacggtaccaagacgtaacgaaaccgtcggacctaggccctcccgaacgtcttaccctnacgttcgtacggtggtaccactaccgtcccgaccgacggtacctaaggtcgtacctaccgaggaccgttacgtaggtacgggtaccgagggttccgggtaagcgggaacaaggtcctttaaaccnccgtacctaacaacgtacgtacgaaccgacggtcgccgtaggtacgttaagtacggttaaagtcgttttacgttacgtttaaacgtttgttttaccggttattacgtacgtaacgttaagttaaacgttaacgtttaacgttccggtaccgttacccgttacggggttaacgggtacggttaaacccggtaaccgggaacgttaaaaccgggtaacggtaaacggttaaaaacggttaacgaaacccgggttaaactcggtcgggtacgtaaccaaacgttaccgtaactcgtttcgtaac

SEQ ID NO: 67832 - DNA, 857 bp, Homo sapiens
  misc_feature: GYAE6OF01BDU59.37.37.D04.1.454.CMB.1.raw
  modified_base (141)..(141): a, c, t, g, unknown or other
  misc_feature (141)..(141): n is a, c, g, or t
tcagtagtgtagatcacgaccggtgctcgatttagtagcatactgttgggtttggggacccaaaaaccacacccctccttgggagaactcccctagatcacagctcctcaccatggactggacctggagcatccttttccnggtggcagcagcaacaggtgcccactctcacggtttcagtcctggtgctagttcgtggagtcgtggagggtagaacgaacgtccggtcggggtcctcgaggttacggtaacgggtctccgtggaccgtaagggtcttttaccgtgggtttaacttaaccgtttagcttaaagttagtaggttactaccgaacgttggggtacgtcgaaccgaccgggtcccgtaggaacgacggtcaaggtggacgtggtacggtggagtggactcgaacggtcgttaaccttaaacaagttaaaccaacacgtaaactattacggactacgaaacgtaacgttaaccggtccgggagggtaaacaggttaaccgtaccctaccgttaacccggaactaaccggtaactaactaaccgtaaccgttacccgaacggacgaaccttaacccgacccttaccctaagggtacccgtagggtccgtacgtaacgggacggaacgtccggtacgtaacggtacttaaccggtggaaccccggttaggttacccggggtttacgttttaccgggttttacggtaacgggtccggtaaaacggggggtcctttaaaggggtaaacgttaaacgggttaacgtttttaaccggttaaacggtttaaccgggtacgggttaacccggggttaaaccccggggtaccggggttaaccccggggtaaacccggggg

SEQ ID NO: 67833 - DNA, 880 bp, Homo sapiens
  misc_feature: GYAE6OF01DPTCI.37.37.D04.1.454.CMB.1.raw
  modified_base (541)..(541): a, c, t, g, unknown or other
  misc_feature (541)..(541): n is a, c, g, or t
tcagtagtgtagatcacgaccggtgctcgatttagtagcatactggttgggttggggaacccaaaaaccacacccctccgttgggagaatcccctagatcacagcctcctcaccatggactcggacctggagctacttccttttccgtgggtggcagcagaccaagaggtcacccatcgtacgtaggttcaggtcgtggtgactgtcgtaggagcgtagggacggtagaaggtacggccgtcggggtacctgtaaggtaggtaacggtccttcgagacgtacggtctttcgtaggttaacttacgttagaacttaagttagtaggtaactaccgtaaggttgggtaccgacgtaccggtaccggtcccgtaaggaaccgtaacggccgtttagacgggtaggtcgggtaaggtggggtaacgttaggacgtttaccgagggtacccgttaaattaaaccgaaaactaaaccgtacgtaaactaccgtaaatcgtacgtaacgaacgtacggttaacggaccggtaacggctacgttaaccnccgttaccacgtaccgaacgtaagtcctaacgtaccaccgaacgacgactaacgaaccggtacaaggcgttagaacggttcgtaacgggacgggtaccgtaccggtaagtaccggtacggtacccgttaaacggggacccgttaacccgggttccgggttttaacgttttaccggttaaccggggttacgttaccggggaaaccgggttaacggttaaccggggttaaaacttaagggttaaaaccggttttaaacgggttaacctaacgggggtttaacccggtttaaaggaccccgggggtttaaacggggtaacccccggtttaaaacccgggggg

SEQ ID NO: 67834 - DNA, 867 bp, Homo sapiens
  misc_feature: GYAE6OF01BMTZE.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcacgcaacaggtcgcccactctcaggttcagctggtgcagtctaggagcgtagaggtggaaggaacgtccggtgggggccctcgacgtaggaacggtcttacccgtgacgaacggtctttcgttacggtttactaccgtttacgataacgttagtcggtactactaacgtggggtacgcgaaccgaccggtaccccgtagggaacccgaacggaccgtaacggtggtaggtaggtaggtacggggtagtacgggacgttacgaacggtcgtaacctttaaacaaaattaaaacgtaaccaaaccgtaacgtaacttaacgaacgtaccaacgtaacggtaacgttacccggaagggtaccgaaacggtaccgttacccgaacccgttacgaacccgtaacgaaccggtacttaacccgaacctaaccccggaacgaacggaccaacccgtacggtaaccccgtaaacgtacggtacgggaccgtaaggttcgggaacgtcgggtaaccgtaagggtacgtaaaccgttcggtaaaccggaccggaacccgggttacccggtttaacccggttttacggttttaccgtaccgggtaacggtaccgggtaaacgggtaacggttaaaccggtaaaggtaaacgttttaagttaaccgggttaaacttaccggggtaacccgttacgggggtaaacccggggtaacggtaaacccccggggg

SEQ ID NO: 67835 - DNA, 736 bp, Homo sapiens
  misc_feature: GYAE6OF01BD5NZ.37.37.D04.1.454.CMB.1.raw
  modified_base (139)..(139): a, c, t, g, unknown or other
  misc_feature (139)..(139): n is a, c, g, or t
  modified_base (240)..(240): a, c, t, g, unknown or other
  misc_feature (240)..(240): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcnggtggcagcagcaacagtgcccactctcaggttcagctggtgcagtctggatgtgaggtagaacggaagccgtggggccctagaggtggaaggtcctccgngaccgaaggtcttacgttaggtttaacttaccgttagacaagtttagtaggttactacaacggtggtcgacgaccgacggtccccgtaggaacacgggaccagtaggagttgggaagtgggtagtagctacgagtcgtactaaacaaagttaacaacacaacgtaactatacgactaacgaaggtaacttaccggaacgaccgtaagaacgccctaacgtaacgacctaacgaagtaactaaccgtacgaccctaacggacgtaaccaacgaacgtacgttaacgaagtagggaacgtctaacggggaacgtacgtaccggtaggtaacgtaccgtcggtaaccgaaccggaaccgggtaccggttaccggttttaacgtttaacggtacggtactaacggggtaaactaagggaaccgttaaaagaaagtttaacgttaacgttaaaccggtacggttaacggaaacggttaccgggggcccggttaaaaccggg

SEQ ID NO: 67836 - DNA, 896 bp, Homo sapiens
  misc_feature: GYAE6OF01DD2IE.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttccgtggtggcagcagcaacgaggtcgcccactctcaggttcagtctggtgcagtcgtggagcgtggaggtgaaaggacgccggtcggggcctacgaggtacggtaacggttccgtccgtaggaccgtaacgggtcctttttcggtaggtttacctttaccgttttagtaactaagtttacgtaggttaacttaccgtaacggttggggtacgccggtaccgaccgggtccccgtaggaaccgacggacctagtggaacggtaggaggtacgggtagttacggactcgaacgcggtaaccttaaacgtaataaactaacgaacctacgtaacgttatacggtaacgaaacgtaacggtaaacggtttaccggacgggtaccgtaaggtaccgttaaccccgacccgtaacgggaacccaacggtaacgaaccttaaccgtacgtaccccgaacggaacgaacccgtaaccgtaacccggttaccgtaacggtaacgttacggggaacttaccgggaggtaacgggaccggttacgaacggtaccggtacgttaaccggtacggaaccccggtaaccgggttacccgggttaccgtttttaacgggtttacggtaccgggtacgggttaaaccgggtacggttaaacccggtaaaggtttaaccggttaaaggttttacgtttaaacgggtaacggtttaaaccgggtaaccgggttacccgggggttaaccgggtaccccgggggttaaaaccccgggg

SEQ ID NO: 67837 - DNA, 348 bp, Homo sapiens
  misc_feature: GYAE6OF01EACQE.37.37.D04.1.454.CMB.1.raw
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (271)..(348): a, c, t, g, unknown or other
  misc_feature (271)..(348): n is a, c, g, or t
tcagtagtgtagatcacgaccggtgctcgatttagtagcatactgttgggtttggggtgcccaagctgctggagggcacggtcaccacgctgctggagggagtagagtcctgaggactgtaggacagcccatcggtcttccccctggccaccctccctaccaaagacgccacctcgtggggggcacgacggccggcccgtgggctggcctggtacaacgtactactaccatcacacgatgagcggctggaccgaaggccgacatagncnannnnnnnnnnnnnnnnnnnnnnnnnnnnnnnnnnnnnnnnnnnnnnnnnnnnnnnnnnnnnnnnnnnnnnnnnnnnnn

SEQ ID NO: 67838 - DNA, 907 bp, Homo sapiens
  misc_feature: GYAE6OF01CGGJE.37.37.D04.1.454.CMB.1.raw
tcagtagtgtagatcacgaccggtgctcgatttagtagcatactgttgggtttggggaccaaaaaccacaccctccttggagaatcccctagatcacagctcctcaccatggactgggacctggagctatccttttcctggtcggcacgcagcaacaggtcgaccctacgtcctccgagggttcaacgtaccgttagggtcgaccgaggttccgttagggacgtacttgggaagggttaagaacggtaaacggcccggttacgggggtcccttacggtaaggttacggtaaacgggttccaccgttacgaacgtaacgggtcctttacgttaggttaacttaaccgtttacgacttaacgtttagtaggttaacgtactaaacggtcgggtacgtaaccggtaccgtaaccggtccccggttaagggaaccaaacgggtccgtaacggttaggtaacggtagggtaacgtagggtaacggtgggtaactacgtaacggtacgtaaccttaaacaaagttaaaacctaaccgtaacgtaaccgtaacgtacgtaacggaacctaaacgggtaacggtaaaccgttacggggaacgggaccgtaacggttacgtacccgtaaaccgttacgaaacccgtaagtaacgtaaccgtactaaacgtacccggaacggtaaacctagaaccgtaaccggtaacctaaccgggtaacgtacggggtaaccgttacggacggttaaacgggacctaaccgggtttaagacccggtaagtacccggtaacgtaaccgtacgggtacccgttacggttttaacgttaccgtaggtacggaacggtaataacggtacaaacgttaagttaggttaacgtaacggtacggtacgttaacgggagggtcccgtaaacggg

SEQ ID NO: 67839 - DNA, 689 bp, Homo sapiens
  misc_feature: GYAE6OF01ANRTM.37.37.D04.1.454.CMB.1.raw
  modified_base (638)..(638): a, c, t, g, unknown or other
  misc_feature (638)..(638): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcttgtggcagcagcaacaggtgcccactctcaggttcagctggtgcagtctggagctgaggtgaagaagccgtgggcctcagtgaaggtctcctgcaaggtcttcgtggttactaccgtttagactaattaagtggttatcaacgtgggtgcgacgtacggccccgtggacgaacggcctagtgagtggagtgggagtgggactacgacgtacggtaccttaaacgaaactaaacgtaaaccaacaacctaaccgttaagtacgaacgtaacaaggtaaccgttacccggaaggggtacctaacggacgtacccgaaccccgtagaaccaacgaacgtaacgtaactaacccgtaccgaaaccgacgtaaccgaccgtaacccgtacccgtaacctaacggtagggacctacggtaggaacgggtacggcccgtagacggtaactcgtaaggaccgacggtaccggttcgttacgtttcgtagtggtacgaggtacgtanacgttaattagttagtaagtgtaaccggcggtaccgggcggtaaacccggg

SEQ ID NO: 67840 - DNA, 761 bp, Homo sapiens
  misc_feature: GYAE6OF01DLTW9.37.37.D04.1.454.CMB.1.raw
  modified_base (85)..(85): a, c, t, g, unknown or other
  misc_feature (85)..(85): n is a, c, g, or t
  modified_base (128)..(128): a, c, t, g, unknown or other
  misc_feature (128)..(128): n is a, c, g, or t
  modified_base (501)..(501): a, c, t, g, unknown or other
  misc_feature (501)..(501): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
  modified_base (586)..(586): a, c, t, g, unknown or other
  misc_feature (586)..(586): n is a, c, g, or t
  modified_base (674)..(674): a, c, t, g, unknown or other
  misc_feature (674)..(674): n is a, c, g, or t
tcagtagtgtagatcacgaccggtgctcgatttagtagcatactgttgggtttggggacccaaaaaccacacccctccttggganaatcccctagatcacagctcctcaccatggactggacctggancattccttttcctgggtggcagcagcaaccagtcgcccctactctcgtacggttcagtcgttgggtacgctaggtcgtgggagcgtggagggtaggaacggaacggtccgtcgggggcctacgaggtacggtaacgggttctaccgtggtaccgtaacggttccgtttcgttttaggtttaaccttaaccgtttaaggacttaaagtttagtacgggtttaactacggtaacggtgggtacgaccggaaccgtccggtaccccgtaggaacggaaccggtacgtaagtcgggtagggtaggaacgggttgggaacttcgggactacgacgtacgttaaccttaaacaattaaaccaaccgtacactacgttancgactaacgtaagacggtacgagggacagacctacgaaccgnaccctanacgactacacaccgcgaacacacgcctaaccaacgngtagtacggacgtacgggacggcgtaccgagaccgtaacttcgggacggtaccgtaccggtcgggttacgtttaccggtttgacgggnggtaacgtaacgaaggttaagttaagttaaagttaggtaacgttacggacgtagggtacggggtcccgggaacccggttaaaccggg

SEQ ID NO: 67841 - DNA, 260 bp, Homo sapiens
  misc_feature: GYAE6OF01BV3ZV.37.37.D04.1.454.CMB.1.raw
  modified_base (249)..(260): a, c, t, g, unknown or other
  misc_feature (249)..(260): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctcgtggggcacagcggccctgggctgcctggtcaaggactacttccatctacactactgagcgggctggacaaggcgcagtagnnnnnnnnnnnn

SEQ ID NO: 67842 - DNA, 722 bp, Homo sapiens
  misc_feature: GYAE6OF01EQ2V5.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgctagtctccagccaccctgtctgtgtctccgaggggaagcgcccaccctctcctgcgacgggccagtcagtagtgttacgcagctaacgttcgccgtacggtaccagtccaacgaaaccgtcggaccacggtccctaccccgacggtcctcccgttactacttaccgttacgttcgggtcgtaccgtaccgtacccgaaccggaccggggtaccctaacggttcgggtaaccctccccgaacggtcccgttaagggttccgacggggttcggtacgtaggggttcggggtacgtacggggtaactaacggttacgttccgaacttccgaacctaccgtacttacgacgtaccgacgtccgtcggacgtacgtacgtaggtaacgtttgtttcgtactttaaggttttccttagtcgttactagtactaagttacttacgttccgtcgtaccttcgtacggtacgtaccggttcggaaccggtacggtaaccgtagggtaacgaacgtaacgaaacggttacggtcggtacgtacgtacacgacttacgtcgttaccg

SEQ ID NO: 67843 - DNA, 893 bp, Homo sapiens
  misc_feature: GYAE6OF01AEU03.37.37.D04.1.454.CMB.1.raw
  modified_base (231)..(231): a, c, t, g, unknown or other
  misc_feature (231)..(231): n is a, c, g, or t
tcagtagtgtagatcacgaccggtgctcgatttagtagcatactgttgggtttggggacccaaaaccacacccctccttgggagaatcccctagatcacagctcctcaccatcggactggacctggacgctattcccttttccgtggtaggcagccagcaacgaggtcaccctactcctcgaggttccagtcgtggtacgcgtagtcgtaggacgtcctggaacgggttanaaacgggtacgtccgtacggggtcctagtaggtagacggttcctcgacgacgaagtccgttattagttaacgttcttaagctaagttagacggtactacaggttcgggtacacgacgtccggaccctaggaacgttaaccggacctagggtagtacgggaggttacggtaggggtacgtacgggttacgaccgtagggacctttacgtaaaacgttaaaataacccgttaaccaaacggttacccgttaaacgttacgaacggtaaccctaaaacgggtaaccgttaacgtccggggtaaaccgtacgttaacggtacccgttaccggaacccctaacgtacccgtaacggttaccacgttaacccgtacgtaaccctaaacggtaaccgactaaacccgggtactaaaccccgtaaggtaccggtacgtacggtaaaggtacccgggaagttaccggtaccgttaacgggtacctaccgggttaaccgacggtacccggacggttaacccggttcccggttttaaagtaccggttacggaacccggttacgggttaaacccgtaggaaacccggtttaagaacgttttaacgtaaccggtttaacgggtaccggttaacccgttacggggggtaacccggtacccgggttaaaccccgggg

SEQ ID NO: 67844 - DNA, 869 bp, Homo sapiens
  misc_feature: GYAE6OF01A42DV.37.37.D04.1.454.CMB.1.raw
  modified_base (495)..(495): a, c, t, g, unknown or other
  misc_feature (495)..(495): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacgaggtcgccccacttctcagggttcaggcgttgggtgccgtaggtcgtgggagtctagggaggtaggaaacggaacggtcccggtacgggggccctacgtaaggtacggtaacgggttcctccgtgacgaacggtcctttcggttacggtttacttaccgttttagcttaaagtttacgtaggttaatacgtaacggttggggtcgaccgacggaccggtccccgtaggaaccgaacggtaccgaaggttggaagggtagggtaggttacggggaagtcgggtacttacggacgtacgtaaccttaaaacgtaaacttaaaaccaaccaacaaccttaanaggttaccaacgtaaacggtaaacggttaaccggttacccggaacggggacgtaacggtacccgtacccaacccgtaaccgacctaaacggaactaacgtaaccccgtactaaccccggaacggaaccaccttaacccgaaccgtaccgtaaccgaaggtccgggaactacgggtacggtaacgggcgtaacggtacgaacgttcgtacccggaacggtacccggtaacccgggttccggttacgggtttgtttaccgtgggtaacgacggttaacggtaacggttaaggttaaacggtaactttaagggtacgtttaaacgggtaccgtacccgggtggggttaaacccccgggggccgttaaaacccggggg

SEQ ID NO: 67845 - DNA, 763 bp, Homo sapiens
  misc_feature: GYAE6OF01CFWJ4.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagctattccttttcgtggtggcagcagcaacgaggtcgcccactctcgaggttcagcgtggtgcagtctaggagcgtggaggtaggaaagaacggtccggtcggggtcctcgaggtacggtaaggtcctccgtagacgtaacggtctttacgtaggttacttacgtttaagacttaagttagtagttacgtactaaggtcgggtacgccgacgtaccggcccctaggaacgacggctaagtggacgtggagtcgggatggactcgagaccgtataataaataacgtaaccacgaactacgtatacggaactaacgtaacgggtaacgtccggaaaggtccgaaaggtacccgtaacccgtaaccgtaaccggaaaccctaaggtacttaaccgttaaccccgaaacgtacccggaacggaacgtaccgtaaacgtaccgttaaccgtaaagtacgggtacggacgttacgggaggtaaccggacgttaccgagtaccggtaacgttcgaccggtaaccgtaccggaccgttttcggttaacgtttcgcggtaacgacggtaccgtaaggtaactaagttaacggttaagtaaggtcgtaacggttaccgaccggggttaccggacggtaaccccggg

SEQ ID NO: 67846 - DNA, 649 bp, Homo sapiens
  misc_feature: GYAE6OF01EP35I.37.37.D04.1.454.CMB.1.raw
  modified_base (194)..(194): a, c, t, g, unknown or other
  misc_feature (194)..(194): n is a, c, g, or t
  modified_base (241)..(241): a, c, t, g, unknown or other
  misc_feature (241)..(241): n is a, c, g, or t
  modified_base (494)..(494): a, c, t, g, unknown or other
  misc_feature (494)..(494): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtctgganctgaggtgaagaagccgtgggcctgagtgaggtctctgcaaggcttntgttatacttagctattatggtatacaacgtgggtgacgacgacggccccgtggaacacggcctagtggaggtggagtgggaatggatcgagtcgtacgttaacaaataactaaacactaacgtaactacgtacgacaacgtaacgtaacggttcccggaaggggtaccaaggtacgtaccccgaccgttacgaacccgaactaacgaacttaaccaacgtacccaacggacgacaaccaacgtacccgtaanacgtacgggatccggtaggaggacgtcgaagagactacgagtaaccgacgtaccggtccgttagtttacgtcggtgtaccggtaagtaacgtagtaaacgtagttaaattacgggttaaacgaggtacgtacgggtcgggacccggtaaaccggg

SEQ ID NO: 67847 - DNA, 799 bp, Homo sapiens
  misc_feature: GYAE6OF01APJCF.37.37.D04.1.454.CMB.1.raw
  modified_base (610)..(610): a, c, t, g, unknown or other
  misc_feature (610)..(610): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaaacaggtcgcccactctctaggttcagctggtgcagtcgtgagtctggaggtagaagagccgtggggcctagagtacgtaggtctcgtgacgaggtcttgttaggttactacctttagactaattgtggtatcgagtcggtcgggtagcgtaccgaccggtccccgtaggaaccgtaacgggcctaagtggaaggttcgggtaacgtgggggtaattcggtaacgtcgacgggtacgttaaacccttaacaaaaagtttaaaaccgaaaaccacgtaaactaacgttacgtacgaacccgtaaacgtaacgggtttaaaccgttaccgggaggttaaccgaacggttaaacccgtaaccccgtaaccccgtaaccggaacccgtaaaccgtaacgttaacgtaaaccctacgaaacccggtaacgaccgtaacacccgtaaacgtcctaaaccggnggttacgggacacggttaaccgggacggtacgacgggttacggtaacgtcgtaacggtaccgaaccggtacccggttcggtttacccgttttgggttaaccgttgggtaacgccgggttaaagttacgaaactaggttaacgttaacgtacgtaacggttcgggtaaccgaaggggtcccggtaaccgg

SEQ ID NO: 67848 - DNA, 684 bp, Homo sapiens
  misc_feature: GYAE6OF01BEFU0.37.37.D04.1.454.CMB.1.raw
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagtagtgtagatcacgaccggtgctcgatttagtagcatactgttgggtttgggtgcccaagctgctggagggcgcggtcaccacgctgctgaggagtagagtcctgaggactgtaggacagcccatccggtccttcccccgtggccacccctcctaccaaagacgcctaccgtcggtgggggaccacgacggccgggccccgttggggccttcggcccgttagggtaaccgaaaacgggtaaccctttaacctttaccctaattacccttaaccgtaaccgttaaccgtacgggaacgggtccggggtaccgttacgggacgaaacggggtaccgtacctaagtaggncgatcgngattagcagcctanacgctnagcgtagcgtagtcncgngtacgtcgacgtagactacgagacgacgacgcgacncgtacgtntacgactacacgtacgtacgtacacgtacgacgtagcgtagtacgtacgacgtagtacgtacgtacgtacgtacgtacgtacgtacgtacgtcgtacgtacgtacgtacgtacgacgaacgtacgtacgtacgtacgtacgtacgtacgttagacgtacgtacgacgtacgtacgtacgtactacgtacgtacgtagtacgtacgacgtacgtaacgtaccgtacgtacgtacgtcgtcgtacg

SEQ ID NO: 67849 - DNA, 676 bp, Homo sapiens
  misc_feature: GYAE6OF01BBEDO.37.37.D04.1.454.CMB.1.raw
  modified_base (371)..(371): a, c, t, g, unknown or other
  misc_feature (371)..(371): n is a, c, g, or t
  modified_base (641)..(641): a, c, t, g, unknown or other
  misc_feature (641)..(641): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattcccttttccgtgggtggaacgcagacaaacgaggttcgcccacttctcgtaggttcagccgttagggtgacgtagtcgtggagcttggaggtagaacgacgccggtgggcctcgagtgacggttctccgtgacgtaggtcttacgttagttacttaccgtttgacttaagttgtagtatacgtacggtggtcgaccgacgtccggccgtagacgacgaccagtcggaggtgtagtaggntaggctacgacgtctacgttaacaaacttaacaaaccactaaccgtatacgacggactaacgacggtacgtacggacggtactacggtacaccctaccgtacgaaccgtagactactaccacgtaccgacggacctaacgacgtacccgtctaacggtaccgggtacgacgtcgagggtaacgccgtacgtagtacaggtccgacgtaccgtacggttaccgttgtttactaggtcgagggataggtacaagtacgttaattgttaacgngtaccggtagtaccgggccgaacggtacgtcccgg

SEQ ID NO: 67850 - DNA, 908 bp, Homo sapiens
  misc_feature: GYAE6OF01ATUTY.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagtaagccgtggggcctcagtgaaggtctcctgcaggcttctggttactaccgtttagctaatttacgtggttaacttccgaaacgttggggttacgaccggaccgtaacgggtccccccgttagggaaccaacggggtacccctaaggttacggtaaggttacgggaacgttcgggggtaattacggggaacttaccgaacgggtccggtaaccgtttaaccgaaaatttaaacggttaaaccaaccgtaaacctaaaccgttaagttaccggaacctaaacccggtaaagggttaaaccgggttttacccggaagggggtaccgtaacggggtacgttaccccgtaaccccgttacgggaaccccctaacgaacggttaacttaacccgtaacgttaccccggaacgggtaaccgaccgtaaacccgtaaccgggtaaccccgttaacggaacggtttacgggaaccgggttacccgttaacgggaaccggggttaaccgggtaccccgttaacggggtaacggtaccgtttaaccgggtaaaccggtaaccggtaaccccgggtacccggggtttaccggtttaacggtttttaccgtacgggttacggtacgggtaccggtaagttaacccggaaagttaaccgttaagttacggtaacgtacggtaaacccgtcggtacggggtacccgtaaacccggggg

SEQ ID NO: 67851 - DNA, 896 bp, Homo sapiens
  misc_feature: GYAE6OF01EHH64.37.37.D04.1.454.CMB.1.raw
tcagtagtgtagatcacgaccggtgctcgatttagtagcatactgttgggtttggggacccaaaaaaccacacccctccttgggagaatcccctagatcacagctcctcaccatggactggacctggagcattccttttcctggtggcagcagcaacgaggtcgcccactcgtcgtaggttcaggtcgtggtgctagttcgtggagcgtaggaggtagaaaggacggtccggtacggggcctacgtaggtacggtaacggttcctaccgtacggacgtaacggttctttacgttacggtttaactttaaccgtttagacgttaaagtttaggtacggttaacttaccggtaacggttgggtacgaccggtaaccggaccgggtaccccgtagggaaaccgtaacgggtacctaagggtacggtaaggggttacgggtaaggttaggggtactacgggtacgtacgtacggtaccgttaaacttaaaacgtaaaattaaaccgtaaacccgaaacgaaccttaaacgtagtaccgaaccgtaacgtaaacggttaccggtaacggacggggtaacctaaggtacccctacccggtaacccgtacgaaacctaacgtaacgtaaaccttaaccgaactacccggaacgtaaccgaaccgaaccgtacctaaccggtacgtaaggtacggtacggtacggtaagggaccggtacgacggtaacggtacgtacgtaccggtaaccggtacgggtaacccggtacggtttaccggttacgttaccgggtagttaccggaaaggtaacggttaaccgtaagtaaaccgttaagttaaggttaacggtaacgggtaaccgttaaccgggtaagggtaccccggggtacggttaaaccccgggg

SEQ ID NO: 67852 - DNA, 835 bp, Homo sapiens
  misc_feature: GYAE6OF01ACC3Y.37.37.D04.1.454.CMB.1.raw
  modified_base (141)..(141): a, c, t, g, unknown or other
  misc_feature (141)..(141): n is a, c, g, or t
  modified_base (610)..(610): a, c, t, g, unknown or other
  misc_feature (610)..(610): n is a, c, g, or t
tcagtagtgtagatcacgaccggtgctcgatttagtagcatactgttgggtttggggacccaaaaaccacaccctccttgggagaatcccctagatcacagctcctcaccatggactggacctggagcacttccttttccnggtgcagcagcaacaggtcgacccactctacgaggttcagtcgtggtcgcagttcgtaggagtcgtagggaaggtagaacggaacggtcggtcgggacctgaggtaggtaacggtctaccgtgacgtacggtctttacggttacggttaactttaccgttagtactaaagtttcgtagttaactacgtaacggtgggtaccaccggaaccgaccgggtccccgtaagggaacctacggacgtaggtaggtacgggtaggtaggttaagggacgtaggtacgtaccgaccgtaacgttaaccttaaaacaaaagtaacctaaccaaacgttaactacgtataccggaaacgtacggtaaacggtccggttaacgacgggactaaggtacccctaccgacccgtaacaaccgagaacgtaacctacgtaacccgtaacgacggaacctaacaaccggtaccaacggtacgnggtaacggtacgacgggaacggtaccggtacccgtagtacgggtaactaccgtaccgggtacgtaaccccggttaacggtccggttttaccggttaagttcgggtacggtaaccggtagttaaccgggtaaagttaaccgttaaagtttaaccgtttaaagttaccgggttaacgtaccggggtaagtcccccggggttaaaggggaaacccgttaccccggggg

SEQ ID NO: 67853 - DNA, 972 bp, Homo sapiens
  misc_feature: GYAE6OF01BLRZ3.37.37.D04.1.454.CMB.1.raw
  modified_base (142)..(142): a, c, t, g, unknown or other
  misc_feature (142)..(142): n is a, c, g, or t
tcagtagtgtagatcacgaccggtgctcgatttagtagcatactgttgggtttggggacccaaaaaaccacacccctccttgggagaatcccctagatcacagctccctcaccatggactggacctggagcatccttttccnggtggcagcagcaacaggtgcccactctcgaggttcagcgtggtgcagtcgtgggagctggacggtagaaacggaacgccgtggggccctcgaaggttggaacggttccttaccccgtggtaccgtaaacggtccgtttacgttacgggtttaacctttaaccccgtttaggaaccttaaaagttttaacgtacggttaacttacgaaacggttcggggttcggaccggtaacgtaaccgggtacccccgtagggtaaaccggaacggaccgtacgtaggtaggtacggaaggttacgggaagtgggtaacttacggaacgtacggtaaccttaaacgaaacttaaaacgtaaaccaacaacctaacgtaagtaccgaaccgtaacggtaaacggtaaccggttaaccgggaacgggtactaacggtaccgtaaccccggtaccccgtaaccggaaccccgtaacgtaaaccgtaacgtaaccccgtaaccgttaaccccggaaaccgtaaccgtaaccgaacccgtaaccgttacccgtaaacccgtacgtaacggggcgtaacggacggtaaccggggaagttcccgggtaagtacggtaaaccggttcgtaaccgggtaacccgttaacccggggttaaccgggttacccggttttaccggtttaaacggttacgggtaaccggtaaccgggtaaacgggtaaggtttaaaacccggtaaaggtttaaacggttaaacgtttaaccgggtttaaacggttaacccgggttaaaggggttaccgggggttaacccgggggttaacccggggttaaaacccccgggggg

SEQ ID NO: 67854 - DNA, 829 bp, Homo sapiens
  misc_feature: GYAE6OF01EWFY0.37.37.D04.1.454.CMB.1.raw
  modified_base (419)..(419): a, c, t, g, unknown or other
  misc_feature (419)..(419): n is a, c, g, or t
tcagtagtgtagatcacgaccggtgctcgatttagtagcatactgttgggtttggggacccaaaaaccacacccctccttggggagaatcccctagatcacagctcctcaccatggactggacctggagcattcctttttccgtgggtggcagccagcgaacgaggtcgccccacttctcgaggtttcgagtcgttgggtgcgtagtcgtgggagcgtggaggtaggaaaggaacggccggtcggggcctcgaggtaggtaacggtcctccgtggacgtaacggttctttcgttggtttaacttaccgtttagacttaaagtttagtgtaatccgtaacggtggtcgacgtaacgaccgggtcccctaggaaccgaaggtcctaggtaggtacgggtaggaggtcgggtagtacgggtntacggaggttaccgtacttaaacaaaagttaaactaaccgaaccctaagtaactgtacggaactaacggtaagtaaccgtacggacggagtaacggatacccgaccgtaacgacgtaacgacgtaataccaccgtaacccgaaagaccgaccaaaccgtaccgtaccgtaaagacggttaggaccgtacggtaagggaccgggacgaccgttaggaaccggtcgtaaccgtacgggaacccgtaccggttacgggggtttaccgtttacgtttaccggggttacggtacggtaaacgggttcggtaaacgttaacggaaaggtttaaacgttaagggtttaaacgtaaaccggggtttcgggttaaccggttaacccgggggtccggggtaaaccgggtaaaccccgggg

SEQ ID NO: 67855 - DNA, 717 bp, Homo sapiens
  misc_feature: GYAE6OF01AVEUA.37.37.D04.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (342)..(342): a, c, t, g, unknown or other
  misc_feature (342)..(342): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagactaccacgtggagaaatgtgatgacgcagtcctcgagccacctgtctgtgtcncgagggaancgccctaccgtctcngcgacggccagtcaggagttgtacgcacgtactaacgtacgccgtaggtaacccacgtacgaacgtaaccgtcggccgaccgtaccgtcccgacggtcctccgtacagttccttagtcggtccncgtacctacccgaccggaccggtaccacgttacggtaccctccgacggtaccgtcggttacgacggtacggcggtacgggttagggtccggttacggggaactacggtaccgttaccgtaactcccgtacccacgtacgtcggtacgtaccggtctccgtacgtacggtacgttacgttacgtaaggtttacgtttcgttaacggttttagttttcttacgtcgtacgtacgtacttaagttaacttacgttaccgtccgtaccttacggtacggttacgtaccgggtccgaaccgggtaacggtacggtaacgggtactacgaacggtaacgtcgtacggttaccgcgttaacgccttactacttccgggttac

SEQ ID NO: 67856 - DNA, 757 bp, Homo sapiens
  misc_feature: GYAE6OF01B9KVU.37.37.D04.1.454.CMB.1.raw
  modified_base (208)..(208): a, c, t, g, unknown or other
  misc_feature (208)..(208): n is a, c, g, or t
  modified_base (557)..(557): a, c, t, g, unknown or other
  misc_feature (557)..(557): n is a, c, g, or t
  modified_base (690)..(690): a, c, t, g, unknown or other
  misc_feature (690)..(690): n is a, c, g, or t
tcagtagtgtagatcacgaccggtgctcgatttagtagcatactgttgggtttggggaacccaaaaaccacacccctccgttgggagaatcccctagatcacagctcctcaccatggactggacctgggacgcacttccttttccgtgggtggcagcagcaacgaggtcgcctactccgtcgtaggttcagtcgtggtgcacgttcgnggacgtcgtaggaggtaggaaacggtaacggccggttcggggacctcgtaaggtacgtaacggtccttacgtcgacgtaacggtcgtttacgttaggttttacttaaccgttagtaacgttaaggtttagtacggttaacgttaaccgtaagggttcggggacggtaccggtaacccggaccggaccccggtaaggaaccgtacggtaccgaggttaccgggtaggtacggagtagggtaggtaggtaacgtacgggtacgtaccgttaacgttaaaaccaaacgtaaaacgtaaaccaacgtaacgtaacgtacgacgtaacgacgtaaacgtacggtacggaacggngtaaacggaccttaaccgaccgtacaaccgaagtacgataaccgtacacgacacgaacacgacctaactagagagcgacgtagacgacgtacgagtactacgacgacgtaacggtcgacgttcgttagttacncggtacgagtaacgagtaacgtaggtacttaagtacgtacgacgtacgacggtcgggacgtaaccgg

SEQ ID NO: 67857 - DNA, 845 bp, Homo sapiens
  misc_feature: GYAE6OF01B5HJO.37.37.D04.1.454.CMB.1.raw
  modified_base (151)..(151): a, c, t, g, unknown or other
  misc_feature (151)..(151): n is a, c, g, or t
  modified_base (161)..(161): a, c, t, g, unknown or other
  misc_feature (161)..(161): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcancaacaggtcncccatctcgaggttcagcgtggtgcctagtcgtggacgcgtaggaggtagaaggacgccggtggggcccttgaaggttggaacggttctccgtgacgtaacggtctttcggttaggttacttaccgttttagacttaatttagtaggttactccgaacggttggggtcgaccggaccgtaaccgggtcccctagggaacgaacggcctagtggacggtaggaggtagggtagtggactcgaagtccgtacttaaacaaagttaaactaacaccactaagtacgtacgactaacgtaaggtaccgtaccggagggtaccaggtaacccgtacctacccggtacgaaccgtacgaagtaacctaaccgtaacctacccggaacggaaccgtaccgaaccgaaccgtaccgtaaaggtaccggtacgggtacggtaccgtaaggggaaccggtacgggttacccgaagggtaaacgtacccgttaccggggtaacggaaccccgggttaacccggggttacccggtttaccgggttttacgggttttaacggcccgggttaacggtaccgggtaaaagggttaacgtaaaccggttaaggtttaaaccgtttaacggttaacggtaagggttaccggttaacccgggttaccggggttacccggggaaacccgggttaaccccgggg

SEQ ID NO: 67858 - DNA, 246 bp, Homo sapiens
  misc_feature: GYAE6OF02IPYZ3.37.37.D04.1.454.CMB.1.raw
  modified_base (244)..(246): a, c, t, g, unknown or other
  misc_feature (244)..(246): n is a, c, g, or t
tcagtagtgtagatcacgaccggtgctcgatttagtagcatactgttgggttgggtgcccaagctgctggagggcacggtcaccacgctgctgagggagtagagtcctgaggactgtaggacagcccatcggtcttcccctggcaccctcctccaagagcacctctggggcacagcggccctgggctgcctggtcaaggactacttccatctacactactgagcgggctggcaaggcgcatagnnn

SEQ ID NO: 67859 - DNA, 272 bp, Homo sapiens
  misc_feature: GYAE6OF02INEFA.37.37.D04.1.454.CMB.1.raw
  modified_base (249)..(272): a, c, t, g, unknown or other
  misc_feature (249)..(272): n is a, c, g, or t
tcagtagtgtagatcacgaccggtgctcgatttagtagcatactgttgggtttgggtgccaagctgctggagggcacggtcaccacgctgctgagggagtagagtcctgaggactggtaggacagcccatcggtcttccccctggcaccctcctccaaggagcacctctgggggcacagcggccctgggctgcctggtccaaggactacttccatctacactactgagcgggctggcaaggcgcatagnnnnnnnnnnnnnnnnnnnnnnnn

SEQ ID NO: 67860 - DNA, 265 bp, Homo sapiens
  misc_feature: GYAE6OF02INESZ.37.37.D04.1.454.CMB.1.raw
  modified_base (211)..(211): a, c, t, g, unknown or other
  misc_feature (211)..(211): n is a, c, g, or t
  modified_base (245)..(265): a, c, t, g, unknown or other
  misc_feature (245)..(265): n is a, c, g, or t
tcagtagtgtagatcacgaccggtgctcgatttagtagcatactgttgggttgggtgcccgaagctgctggagggcacggtcaccacgcgtgcgtgagggacgtagagtcctgagactgtaggcagccatcgtcttcccctggcacccgtctccaagagcactcgtgggcacagcggccctgggctgcctggtcaaggctactccatctanactactgagcgggctggcaaggcgtctatgccannnnnnnnnnnnnnnnnnnnn

SEQ ID NO: 67861 - DNA, 163 bp, Homo sapiens
  misc_feature: GYAE6OF02HEO0R.37.37.D04.1.454.CMB.1.raw
  modified_base (131)..(163): a, c, t, g, unknown or other
  misc_feature (131)..(163): n is a, c, g, or t
tcagtagtgtagatcacgaccggtgctcgatttagtagcatactgttagggttgggcacagcggccctgggctgcctggtcaaggactacttccatctacactactgagcgggctggcaaggcgcataggnnnnnnnnnnnnnnnnnnnnnnnnnnnnnnnnn

SEQ ID NO: 67862 - DNA, 248 bp, Homo sapiens; identical to SEQ ID NO: 67467
  misc_feature: GYAE6OF02H6JCJ.37.37.D04.1.454.CMB.1.raw
  modified_base (247)..(248): a, c, t, g, unknown or other
  misc_feature (247)..(248): n is a, c, g, or t

SEQ ID NO: 67863 - DNA, 259 bp, Homo sapiens
  misc_feature: GYAE6OF02GWFLZ.37.37.D04.1.454.CMB.1.raw
  modified_base (258)..(259): a, c, t, g, unknown or other
  misc_feature (258)..(259): n is a, c, g, or t
tcagtagtgtagatcacgaccggtgctcgatttagtagcatactgtgggtttgggacagagttcactctcaccatcagcagcctgcagtctgaagattttgcagtttatttctgtcagcagtataattactggcctcctacgtggacgttcggccaagggaccaaggtggaaatcaaacgaactgtggctgcaccatctgtcttcatcttcccgccatctgaatctacactactgagcgggctggcaaggcgcatagnn

SEQ ID NO: 67864 - DNA, 248 bp, Homo sapiens
  misc_feature: GYAE6OF02GU99Y.37.37.D04.1.454.CMB.1.raw
  modified_base (246)..(248): a, c, t, g, unknown or other
  misc_feature (246)..(248): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctggggcacagcggccctgggctgcctggtcaaggactacttccatctacactactgagcgggctggcaaggcgcatagnnn

SEQ ID NO: 67865 - DNA, 248 bp, Homo sapiens
  misc_feature: GYAE6OF02GJY2R.37.37.D04.1.454.CMB.1.raw
  modified_base (246)..(248): a, c, t, g, unknown or other
  misc_feature (246)..(248): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttcccctggcaccctcctccaagagcacctctgggggcacagcggccctgggctgcctggtcaaggactacttccatctacactactgagcgggctggcaaggcgcatagnnn

SEQ ID NO: 67866 - DNA, 288 bp, Homo sapiens
  misc_feature: GYAE6OF02F2UJI.37.37.D04.1.454.CMB.1.raw
  modified_base (255)..(257): a, c, t, g, unknown or other
  misc_feature (255)..(257): n is a, c, g, or t
  modified_base (259)..(288): a, c, t, g, unknown or other
  misc_feature (259)..(288): n is a, c, g, or t
tcagtagtgtagatcacgaccggtgctcgatttagtagcatactggttgggtttgggtgcccaagctgctggagggcacggtcaccacgctgctcgagggagtagagtccctggaggactgtaggacagcccatccggtcttccccctggcaccctcctccaagagccacctctgggggccacagcggccctgggcctgcctggtcaaggctacttccgatctacactactgagcgggctggcaaggcgcatagnnntnnnnnnnnnnnnnnnnnnnnnnnnnnnnnn

SEQ ID NO: 67867 - DNA, 266 bp, Homo sapiens
  misc_feature: GYAE6OF02IJNJS.37.37.D04.1.454.CMB.1.raw
  modified_base (250)..(266): a, c, t, g, unknown or other
  misc_feature (250)..(266): n is a, c, g, or t
tcagtagtgtagatcacgaccggtgctcgatttagtagcatactgttgggtttgggtgcccaagctgctggagggcacggtcaccacgctgctgagggagtagagtcctgaggacctgtaggacagcccatcggtcttccccctggccaccctcctccaacgagcacctctgggggcacagcggccctgggctgcctggtcaaggactacttccatctacactactgagcgggctggcaaggcgcatagnnnnnnnnnnnnnnnnn

SEQ ID NO: 67868 - DNA, 254 bp, Homo sapiens
  misc_feature: GYAE6OF02GMJBZ.37.37.D04.1.454.CMB.1.raw
  modified_base (247)..(254): a, c, t, g, unknown or other
  misc_feature (247)..(254): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnn

SEQ ID NO: 67869 - DNA, 244 bp, Homo sapiens
  misc_feature: GYAE6OF02JLW6L.37.37.D04.1.454.CMB.1.raw
  modified_base (241)..(244): a, c, t, g, unknown or other
  misc_feature (241)..(244): n is a, c, g, or t
tcagtagtgtagatcacgaccggtgctcgatttagtagcatactgttggtttggtgccaagctgctggagggcacggtcaccacgctgctgagggagtagagtcctgaggactgtaggacagcccatcggtcttcccctggcaccctcctccaagagcacctctggggcacagcggcctgggctgcctggtcaaggactacttccatctacactactgagcgggctggcaaggcgcatagnnnn

SEQ ID NO: 67870 - DNA, 511 bp, Homo sapiens
  misc_feature: GYAE6OF02F2JQV.37.37.D04.1.454.CMB.1.raw
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
tcagtagtgtagatcacgaccggtgctcgatttagtagcatactgttgggtttggggaggaactgctcagttaggtacccgacgacggaaccgaatggaaggaccccacgcgcagcttctcttcctcctgctactctggctcccacgataccactggagaaataagtgatgacgcagtctccagccaccctgtctgtgtctccaggggaaagagccaccctctcctgcagggccagtcagagtgttagcagcaacttagcctggtaccagcagaaacctggccaggctccccaggctcctcatctatggtgcatcccaccagggccactggtatccccagccaggttcagtggcagtgggtctgggacagngttcactctcaccntcagcagcctgcagtctgaagattttgctagttttattctgtcagcagtataattactggcccttctacgtggtacgttcgccagggacaggtggaatcgaaacgaagtgtggctgcaccatctcg

SEQ ID NO: 67871 - DNA, 257 bp, Homo sapiens
  misc_feature: GYAE6OF02ISSVX.37.37.D04.1.454.CMB.1.raw
  modified_base (251)..(257): a, c, t, g, unknown or other
  misc_feature (251)..(257): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgccgtggtacaaggactacttccatctacactactgaggcggctggacgaaggcgcatagnnnnnnn

SEQ ID NO: 67872 - DNA, 247 bp, Homo sapiens; identical to SEQ ID NO: 67450
  misc_feature: GYAE6OF02FSVIT.37.37.D04.1.454.CMB.1.raw
  modified_base (247)..(247): a, c, t, g, unknown or other
  misc_feature (247)..(247): n is a, c, g, or t

SEQ ID NO: 67873 - DNA, 344 bp, Homo sapiens
  misc_feature: GYAE6OF02H0AE3.37.37.D04.1.454.CMB.1.raw
  modified_base (293)..(344): a, c, t, g, unknown or other
  misc_feature (293)..(344): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctctccacaagcacctcctggggtcgggacaagcggcccgtcgggtcggtcgccgtcggttcgaacggaacgtacctttaccctactacttacctaactaaccttgtaggacgggccggtggcgaacggacggcgactaagtgnnnnnnnnnnnnnnnnnnnnnnnnnnnnnnnnnnnnnnnnnnnnnnnnnnnn

SEQ ID NO: 67874 - DNA, 246 bp, Homo sapiens
  misc_feature: GYAE6OF02FV9V4.37.37.D04.1.454.CMB.1.raw
  modified_base (246)..(246): a, c, t, g, unknown or other
  misc_feature (246)..(246): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttcccctggcaccctcctccaagagcacctctgggggcacagcggccctgggctgcctggtcaaggactacttccatctacactactgagcgggctggcaaggcgcatagn

SEQ ID NO: 67875 - DNA, 248 bp, Homo sapiens; identical to SEQ ID NO: 67467
  misc_feature: GYAE6OF02H0JUH.37.37.D04.1.454.CMB.1.raw
  modified_base (247)..(248): a, c, t, g, unknown or other
  misc_feature (247)..(248): n is a, c, g, or t

SEQ ID NO: 67876 - DNA, 133 bp, Homo sapiens
  misc_feature: GYAE6OF02F46VL.37.37.D04.1.454.CMB.1.raw
  modified_base (130)..(133): a, c, t, g, unknown or other
  misc_feature (130)..(133): n is a, c, g, or t
tcagtagtgtagatcacgaccggtgctcgatttagtagcatactgttgggtttgggcacagcggccctgggctgcctggtcaaggactacttccatctacactactgagcgggctggcaaggcgcatagnnnn

SEQ ID NO: 67877 - DNA, 250 bp, Homo sapiens; identical to SEQ ID NO: 67462
  misc_feature: GYAE6OF02HRA0A.37.37.D04.1.454.CMB.1.raw
  modified_base (247)..(250): a, c, t, g, unknown or other
  misc_feature (247)..(250): n is a, c, g, or t

SEQ ID NO: 67878 - DNA, 250 bp, Homo sapiens
  misc_feature: GYAE6OF02I8OIW.37.37.D04.1.454.CMB.1.raw
  modified_base (246)..(250): a, c, t, g, unknown or other
  misc_feature (246)..(250): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttcccctggcaccctcctccaagagcacctctgggggcacagcggccctgggctgcctggtcaaggactacttccatctacactactgagcgggctggcaaggcgcatagnnnnn

SEQ ID NO: 67879 - DNA, 249 bp, Homo sapiens; identical to SEQ ID NO: 67463
  misc_feature: GYAE6OF02HUFOX.37.37.D04.1.454.CMB.1.raw
  modified_base (247)..(249): a, c, t, g, unknown or other
  misc_feature (247)..(249): n is a, c, g, or t

SEQ ID NO: 67880 - DNA, 247 bp, Homo sapiens; identical to SEQ ID NO: 67450
  misc_feature: GYAE6OF02JDU35.37.37.D04.1.454.CMB.1.raw
  modified_base (247)..(247): a, c, t, g, unknown or other
  misc_feature (247)..(247): n is a, c, g, or t

SEQ ID NO: 67881 - DNA, 261 bp, Homo sapiens
  misc_feature: GYAE6OF02G4G7P.37.37.D04.1.454.CMB.1.raw
  modified_base (259)..(261): a, c, t, g, unknown or other
  misc_feature (259)..(261): n is a, c, g, or t
tcagtagtgtagatcacgaccggtgctcgatttagtagcatactgttgggtttgggacagagttcactctcaccatcagcagcctgcagtctgaagattctgcagtttatttctgtcagcagtataattactggcctcctacgtggacgttcggccaagggaccaaggtggaaatcaaacgaactgtggctgcaccatctgtcttcatcttcccgccatctgaatctacactactgagcgggctggcaaggcgcatagnnn

SEQ ID NO: 67882 - DNA, 248 bp, Homo sapiens; identical to SEQ ID NO: 67467
  misc_feature: GYAE6OF02FL9GB.37.37.D04.1.454.CMB.1.raw
  modified_base (247)..(248): a, c, t, g, unknown or other
  misc_feature (247)..(248): n is a, c, g, or t

SEQ ID NO: 67883 - DNA, 502 bp, Homo sapiens
  misc_feature: GYAE6OF02GK5XM.37.37.D04.1.454.CMB.1.raw
  modified_base (204)..(204): a, c, t, g, unknown or other
  misc_feature (204)..(204): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtatttgctagtttattctgtcagcagtatattactgcctctacgtgacgttcgaccagggaccaaggtggaaatcgaaacgtacgtgtaggctagacactagtctacg

SEQ ID NO: 67884 - DNA, 269 bp, Homo sapiens
  misc_feature: GYAE6OF02JH3BW.37.37.D04.1.454.CMB.1.raw
  modified_base (249)..(269): a, c, t, g, unknown or other
  misc_feature (249)..(269): n is a, c, g, or t
tcagtagtgtagatcacgaccggtgctcgatttagtagcatactgttgggtttagggtgcccaagctgctggagggcacggtcaccacgctcgctgagggagtagagtcctgaggactgtaggacagcccatcggtcttccccctggcaccctcctccaagagcacctctggggcacagcggccctgggctggcctggtcaaggactacttccatctacactactgagcgggctggcaaggcgcatagnnnnnnnnnnnnnnnnnnnnn

SEQ ID NO: 67885 - DNA, 249 bp, Homo sapiens; identical to SEQ ID NO: 67463
  misc_feature: GYAE6OF02I7HBA.37.37.D04.1.454.CMB.1.raw
  modified_base (247)..(249): a, c, t, g, unknown or other
  misc_feature (247)..(249): n is a, c, g, or t

SEQ ID NO: 67886 - DNA, 253 bp, Homo sapiens
  misc_feature: GYAE6OF02INM1S.37.37.D04.1.454.CMB.1.raw
  modified_base (247)..(253): a, c, t, g, unknown or other
  misc_feature (247)..(253): n is a, c, g, or t
tcagtagtgtagatcacgaccggtgctcgatttagtagcatactgttgggtttgggtgcccaagctgctggagggcacggtaaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnn

SEQ ID NO: 67887 - DNA, 248 bp, Homo sapiens; identical to SEQ ID NO: 67467
  misc_feature: GYAE6OF02GH0S3.37.37.D04.1.454.CMB.1.raw
  modified_base (247)..(248): a, c, t, g, unknown or other
  misc_feature (247)..(248): n is a, c, g, or t

SEQ ID NO: 67888 - DNA, 259 bp, Homo sapiens
  misc_feature: GYAE6OF02HEO93.37.37.D04.1.454.CMB.1.raw
  modified_base (259)..(259): a, c, t, g, unknown or other
  misc_feature (259)..(259): n is a, c, g, or t
tcagtagtgtagatcacgaccggtgctcgatttagtagcatactgttgggtttgggacagagttcactctcaccatcagcagcctgcagtctgaagattctgcagtttatttctgtcagcagtataattactggcctcctacgtggacgttcggccaagggaccaaggtggaaatcaaacgaactgtggctgcaccatctgtcttcatcttcccgccatctgaatctacactactgagcgggctggcaaggcgcatagn

SEQ ID NO: 67889 - DNA, 248 bp, Homo sapiens; identical to SEQ ID NO: 67467
  misc_feature: GYAE6OF02JENGQ.37.37.D04.1.454.CMB.1.raw
  modified_base (247)..(248): a, c, t, g, unknown or other
  misc_feature (247)..(248): n is a, c, g, or t

SEQ ID NO: 67890 - DNA, 500 bp, Homo sapiens
  misc_feature: GYAE6OF02FXMUU.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggattggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgaccacagatacatccacgagccacagcctacatggagctgaggagcctgagatctgacgacacggccgttgtttactgtgcgagagtacagaatattgtaatggactacgtgggaccacggg

SEQ ID NO: 67891 - DNA, 255 bp, Homo sapiens
  misc_feature: GYAE6OF02HXPG0.37.37.D04.1.454.CMB.1.raw
  modified_base (247)..(255): a, c, t, g, unknown or other
  misc_feature (247)..(255): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnnn

SEQ ID NO: 67892 - DNA, 505 bp, Homo sapiens
  misc_feature: GYAE6OF02HU4LQ.37.37.D04.1.454.CMB.1.raw
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
  modified_base (454)..(454): a, c, t, g, unknown or other
  misc_feature (454)..(454): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgaccacagatacatccacgagcacagcctacatgganctgaggagcctagagatcngacgacacggccgtgtttacngtgcgagagtacagaattattgtaactggtactacgtggggcctaacgggg

SEQ ID NO: 67893 - DNA, 130 bp, Homo sapiens; identical to SEQ ID NO: 67457
  misc_feature: GYAE6OF02IELGJ.37.37.D04.1.454.CMB.1.raw
  modified_base (130)..(130): a, c, t, g, unknown or other
  misc_feature (130)..(130): n is a, c, g, or t

SEQ ID NO: 67894 - DNA, 246 bp, Homo sapiens
  misc_feature: GYAE6OF02ID6DK.37.37.D04.1.454.CMB.1.raw
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatag

SEQ ID NO: 67895 - DNA, 598 bp, Homo sapiens
  misc_feature: GYAE6OF02IG0LP.37.37.D04.1.454.CMB.1.raw
tcagtagtgtagatcacgaccggtgctcgatttagtagcatactgttgggtttggggacccaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctctgcaaggcttctggttatacctttagcaattatggtatcaactgggtgcgacaggcccctggactaaggccatgagtggatgggatggatcagcgcttacaagtaataacacacactatgacacagaagttcaggcagacgtcacctgacacagatacatccacgagacacagcctaacacgttaggacgtcgtagacggtacgaccgtagacgacttccgtagaccgtaaccgtacggtcccgttagttttaaccgcggttacggtaccggtaacggtacggttaacctaacgggtaaacgttagtttacggtaaacgttcgggtaacccgtttaacggttacgggggtaacccgttaaaccgggggg

SEQ ID NO: 67896 - DNA, 732 bp, Homo sapiens
  misc_feature: GYAE6OF02H1Z8L.37.37.D04.1.454.CMB.1.raw
  modified_base (203)..(203): a, c, t, g, unknown or other
  misc_feature (203)..(203): n is a, c, g, or t
tcagtagtgtagatcacgaccggtgctcgatttagtagcatactgttgggtttgggggaggaactgctcagttaggacccagacggaacatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcaagaaacctggccaggctcccaggctcctcactctatggtgctatccaccgagggccagtcggtactcccagcctaggttcaggtcggctaggtcgggtcgtaggggaaccaggtacgtttccaaccgttctaccgaaccctagtacgaacggccgtaacgtccccgttaggaccgtaacgtaccgttaggtaaacgttagttttttcggacgttttaacggttttttaacttttccgtttacggttacctaacggttaccgttaaaggtttaaactttaaaacgttttaccgttaccgggttaccccgtttacccgttaacgggttacgggtaacccgggtttaccgggtaaccccggtaaacggggtaacccgtaaacggggtaacgggtaaacgttaaccggaaaaccggtaaccgttcgggttacgggtaccgtacggtacccgtaaccgttaccgttccgttacg

SEQ ID NO: 67897 - DNA, 248 bp, Homo sapiens; identical to SEQ ID NO: 67467
  misc_feature: GYAE6OF02FUMS7.37.37.D04.1.454.CMB.1.raw
  modified_base (247)..(248): a, c, t, g, unknown or other
  misc_feature (247)..(248): n is a, c, g, or t

SEQ ID NO: 67898 - DNA, 498 bp, Homo sapiens
  misc_feature: GYAE6OF02F1C1I.37.37.D04.1.454.CMB.1.raw
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgaccacagatacatccacgagcacagcctacatgganctgaggngcctgagatctgacgacacggccgtgtttactgtgcgagagtacagaatattgtaatggactacgtgggccaacggg

SEQ ID NO: 67899 - DNA, 248 bp, Homo sapiens
  misc_feature: GYAE6OF02HGDM9.37.37.D04.1.454.CMB.1.raw
  modified_base (247)..(248): a, c, t, g, unknown or other
  misc_feature (247)..(248): n is a, c, g, or t
tcagtagtgtagatcacgaccggtgctcgatttagtagcatactgttgggtttgggtgcccaagctgctggagggcacggtcaccactctgctgagggagtagagtcctgaggactgtaggacagcccatcggtcttccccctggcaccctcctccaagagcacctctgggggcacagcggccctgggctgcctggtcaaggaccacttccatctacactactgagcgggctggcaaggcgcatagnn

SEQ ID NO: 67900 - DNA, 555 bp, Homo sapiens
  misc_feature: GYAE6OF02IVN85.37.37.D04.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatcatggtncatccacagggccactggtactccagccaggttcagtggcagtgggtctggggacngagttcactctcaaccntcagcagcctgcgagtctgaagtattttggctagttttattcgtgttcagtctaaggtaacttaaatttcgtacggtccttccttacggtggacgtttacggacccaagggaccgtaagggtggaaaacttcgaaaaccggaacgttggtacggtcgtacgacgtaaccctagttcctacgg

SEQ ID NO: 67901 - DNA, 261 bp, Homo sapiens
  misc_feature: GYAE6OF02FIL1I.37.37.D04.1.454.CMB.1.raw
  modified_base (249)..(261): a, c, t, g, unknown or other
  misc_feature (249)..(261): n is a, c, g, or t
tcagtagtgtagatcacgaccggtgctcgatttagtagcatactgttgggtttgggtgcccaagctgctggagggcacggtcaccacgctgcctgagggagtagagtccgtgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnnnnnnn

SEQ ID NO: 67902 - DNA, 249 bp, Homo sapiens; identical to SEQ ID NO: 67463
  misc_feature: GYAE6OF02H11C0.37.37.D04.1.454.CMB.1.raw
  modified_base (247)..(249): a, c, t, g, unknown or other
  misc_feature (247)..(249): n is a, c, g, or t

SEQ ID NO: 67903 - DNA, 497 bp, Homo sapiens
  misc_feature: GYAE6OF02F8ARQ.37.37.D04.1.454.CMB.1.raw
  modified_base (453)..(453): a, c, t, g, unknown or other
  misc_feature (453)..(453): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgaccacagatacatccacgagcacagcctacatggagctgaggagcctagagatctgacgacacggcgtgtttacngtgcgagatacagaatattgaatggactacgtgggcctaacggg

SEQ ID NO: 67904 - DNA, 508 bp, Homo sapiens
  misc_feature: GYAE6OF02JEHGL.37.37.D04.1.454.CMB.1.raw
  modified_base (455)..(455): a, c, t, g, unknown or other
  misc_feature (455)..(455): n is a, c, g, or t
tcagtagtgtagatcacgaccggtgctcgatttagtagcatactgttgggtttggggacccaaaaaccacacccctccttgggagaatccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgaccacagatacatccacgagcacagcctaacatggagctaggaggagcctgagatctgacgcacggccgttgtttacngtgcgagagtacgagaattagttagtaagtggactacgtcggggctaacgggg

SEQ ID NO: 67905 - DNA, 722 bp, Homo sapiens
  misc_feature: GYAE6OF02J3ATK.37.37.D04.1.454.CMB.1.raw
tcagtagtgtagatcacgaccggtgctcgatttagtagcatactgttgggtttggggacccaaaaccacacccctccttgggagaatcccctagatcacagctcctcaccatggactggacctggagcatcctttcctggtggcagcagcaacaggtgcccactctcaggttcagctggtgcagtctggagctgaggtgaagagcctgggcctacgagtgaaggtctcctgcaggtcttcgtggttactacctttagctaattgtggtactcgaacggtgggtacgccgacgacggcccctaggactaacgggcctagtggaggtggagtgggatggactcgagaccgtacttaaacaaactaacaaacctacaactactagtcggaacctaacgacggtaacgtaccgaggtacacgtacgtacccaccgtacgaaccacgacgtaactacactacccgaacgtacgacctaacgaccgtacgtaacgaggttacggaccgtacggtacggacggtaccgtaccggtacggaacgtaaccgttaccggtaaccggtacccgggtaacgttacccgggtttacgtttacggttaccggtaggtaccggtaaccggtaacggtaacgtaaacggttaaccgttaaggtttacggttaaacggtaccggttaccggggtaacccttttaaccgggggaccgggttaacccgggttaaccccggg

SEQ ID NO: 67906 - DNA, 250 bp, Homo sapiens; identical to SEQ ID NO: 67462
  misc_feature: GYAE6OF02FUUUF.37.37.D04.1.454.CMB.1.raw
  modified_base (247)..(250): a, c, t, g, unknown or other
  misc_feature (247)..(250): n is a, c, g, or t

SEQ ID NO: 67907 - DNA, 256 bp, Homo sapiens
  misc_feature: GYAE6OF02JDYLB.37.37.D04.1.454.CMB.1.raw
  modified_base (247)..(256): a, c, t, g, unknown or other
  misc_feature (247)..(256): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnnnn

SEQ ID NO: 67908 - DNA, 520 bp, Homo sapiens
  misc_feature: GYAE6OF02FHWZ8.37.37.D04.1.454.CMB.1.raw
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
  modified_base (459)..(459): a, c, t, g, unknown or other
  misc_feature (459)..(459): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgaccanagatacatccacgagcacagcctacatgganctaggaggagcctagagatctagacgacacggtccgttgtttacngtgacgaaggataacgagtaattagttagtaagtggtactacggtcggggacctaacgggg

SEQ ID NO: 67909 - DNA, 587 bp, Homo sapiens
  misc_feature: GYAE6OF02JMYYZ.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagcaattatggtatcaacgtgggtgcgacacggcccctggacaaggccagtgagtggagtgggatggatcgagcgacttaacaataactaacacacactatgacaacagaacgtccaagggcagacgtcacctacgaccaacagactacactaccgacgacgacaacgacgacctaacagtacggacgacgtaggaacggacgccgtaggacgtatcgtaacgaccgaccgaacggtccgttagtttaccgtggtcggaccgtaaggtaacgtaacgaagtaacttagtttagtaagtacggtacgtacggttacggggaccgtaaccggg

SEQ ID NO: 67910 - DNA, 262 bp, Homo sapiens
  misc_feature: GYAE6OF02GY2L1.37.37.D04.1.454.CMB.1.raw
  modified_base (247)..(262): a, c, t, g, unknown or other
  misc_feature (247)..(262): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnnnnnnnnnn

SEQ ID NO: 67911 - DNA, 568 bp, Homo sapiens
  misc_feature: GYAE6OF02GPD1O.37.37.D04.1.454.CMB.1.raw
  modified_base (379)..(379): a, c, t, g, unknown or other
  misc_feature (379)..(379): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtactcccagccaggttcaggtggcaggtgggactgggacaggtagttcagtcctaaccntcagcagcctgcagtctagaagtattttggtagttttatttcttgtcagtctagttattagttccgtggtcccgtcgggtaccgttccgggcccgtagggtaacccgtaagggtacggaacgtacgtaaacggaacgttacggtacggacgttacggcctaccgtattcctacgttcttctacttcccg

SEQ ID NO: 67912 - DNA, 260 bp, Homo sapiens
  misc_feature: GYAE6OF02JAANH.37.37.D04.1.454.CMB.1.raw
  modified_base (256)..(260): a, c, t, g, unknown or other
  misc_feature (256)..(260): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggccaccctcctccaaagagccacctcgtggggcacagccggcccgtgggctgccgtggtcaaggactacttccatctacactactgagcgggctggacgaaggcgacatagnnnnn

SEQ ID NO: 67913 - DNA, 536 bp, Homo sapiens
  misc_feature: GYAE6OF02IVIVH.37.37.D04.1.454.CMB.1.raw
  modified_base (387)..(387): a, c, t, g, unknown or other
  misc_feature (387)..(387): n is a, c, g, or t
  modified_base (472)..(472): a, c, t, g, unknown or other
  misc_feature (472)..(472): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacgtgggtgcgacaggcccctggacaaggccatgagtggatgggatggatcgagcgcttacaataataacacacactatgacacagaagtccagggcagacgtcaccctgaccanagatacatccacgagcacagcctaacagtggagctaggaggacgccgtagagtatcgtagacgacgacggtccgttagttttacngtgcggtagacgtaacgaagtaattagttaggtaatcggtaactacggtggggacctaacgggg

SEQ ID NO: 67914 - DNA, 625 bp, Homo sapiens
  misc_feature: GYAE6OF02H3NF8.37.37.D04.1.454.CMB.1.raw
  modified_base (279)..(279): a, c, t, g, unknown or other
  misc_feature (279)..(279): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtncgacaggcccctggacaaggccatgagtggatgggatggatcagcgcttacaataataacacacactatgacacagaacgttccagggcagagtccaccctgaccacagactacataccagacgacacacgcctaacagtagggacgcgtaggacggacgccttaggacgtacgtccgtaggaaccgaaccggtaccgggtaccgtttacgtttttaaccgtgggttacggtaccggtaacgggtaacggttaaccgtaaggtaaactttaaggttttaacggttaaacggttaccggggtaaccgtttaaccgggttaccggggggtacccgtaaacccgggggg

SEQ ID NO: 67915 - DNA, 250 bp, Homo sapiens; identical to SEQ ID NO: 67462
  misc_feature: GYAE6OF02FGSAQ.37.37.D04.1.454.CMB.1.raw
  modified_base (247)..(250): a, c, t, g, unknown or other
  misc_feature (247)..(250): n is a, c, g, or t

SEQ ID NO: 67916 - DNA, 248 bp, Homo sapiens
  misc_feature: GYAE6OF02JCAKI.37.37.D04.1.454.CMB.1.raw
  modified_base (246)..(248): a, c, t, g, unknown or other
  misc_feature (246)..(248): n is a, c, g, or t
tcagtagtgtagatcacgaccggtgctcgatttagtagcatactgttgggtttgggtgaccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactatgagcgggctggcaaggcgcatagnnn

SEQ ID NO: 67917 - DNA, 535 bp, Homo sapiens
  misc_feature: GYAE6OF02GSEA4.37.37.D04.1.454.CMB.1.raw
  modified_base (398)..(398): a, c, t, g, unknown or other
  misc_feature (398)..(398): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtactcccagccaggttcagtggcagtgggtctgggacagagttcactctcaccatcagcagcctgcagtctagaagtntttgctagtttatttctgtcagctagtataattactcggtccttaccgtacgtcggtaccgttcgggaccgaacgggacctaagggtacggtaaactacgaaacgtaacgtgtacggactcgaccaccgtatctacg

SEQ ID NO: 67918 - DNA, 248 bp, Homo sapiens; identical to SEQ ID NO: 67467
  misc_feature: GYAE6OF02GD5BP.37.37.D04.1.454.CMB.1.raw
  modified_base (247)..(248): a, c, t, g, unknown or other
  misc_feature (247)..(248): n is a, c, g, or t

SEQ ID NO: 67919 - DNA, 249 bp, Homo sapiens; identical to SEQ ID NO: 67463
  misc_feature: GYAE6OF02IDWS2.37.37.D04.1.454.CMB.1.raw
  modified_base (247)..(249): a, c, t, g, unknown or other
  misc_feature (247)..(249): n is a, c, g, or t

SEQ ID NO: 67920 - DNA, 508 bp, Homo sapiens
  misc_feature: GYAE6OF02ICE33.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctggggacagagttcactctcaccatcagcagcctgcagtctagaagtattttgctagtttattctgtcagcagtatattactgtcctcctacgtggtacgttcggcaagggacctaaggtggaaatcgaaacgtacgtagtcggactgcacactctcg

SEQ ID NO: 67921 - DNA, 590 bp, Homo sapiens
  misc_feature: GYAE6OF02IZ80T.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggagtgggatggatcgagcgcttaacaataataacacacactatgacacagaacgttccgagggcaggacgtaccaccctagaacccacaagactaacactaccaacgacgaccacacgacctacagtacggacgcgtaggacgggacgccgtaggaacgtatcgtacggaaccgaaccgaccgggtccgtttagttttaccgtggtcgacggaaggtagtaacgaagttaattagttagttaagtacgggtaacgttacggtacggggtaccgtaaccgggg

SEQ ID NO: 67922 - DNA, 249 bp, Homo sapiens; identical to SEQ ID NO: 67463
  misc_feature: GYAE6OF02HJI90.37.37.D04.1.454.CMB.1.raw
  modified_base (247)..(249): a, c, t, g, unknown or other
  misc_feature (247)..(249): n is a, c, g, or t

SEQ ID NO: 67923 - DNA, 540 bp, Homo sapiens
  misc_feature: GYAE6OF02IGCEL.37.37.D04.1.454.CMB.1.raw
  modified_base (364)..(364): a, c, t, g, unknown or other
  misc_feature (364)..(364): n is a, c, g, or t
  modified_base (404)..(404): a, c, t, g, unknown or other
  misc_feature (404)..(404): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgatactctggctcccagataccactggagaaatagtgatgacgcagtctccagccaccctgtctgtgtctccgaggggaaagagccaccctctcctgcagggccagtcagagtgttagcagcaacttagcctggtaccagcagaacctggccaggctcccaggctcctcatctagtggtcgcatccaccgagggcccactggtactcccagccaggttcaggtggcaggtgggtctgggacngtagttcactctcacatcagcagcctgcagtctgaacgtntttgcttagttttattctgtcagtctagttaatattacgtggtcctcttacggtgtacgttcggaccgagggtaccaagggtgtaaactaccgaaaacgtacgtaggtacggactacggaccaccgtattcgtacg

SEQ ID NO: 67924 - DNA, 246 bp, Homo sapiens; identical to SEQ ID NO: 67894
  misc_feature: GYAE6OF02FFDIW.37.37.D04.1.454.CMB.1.raw

SEQ ID NO: 67925 - DNA, 544 bp, Homo sapiens
  misc_feature: GYAE6OF02G72BA.37.37.D04.1.454.CMB.1.raw
  modified_base (358)..(358): a, c, t, g, unknown or other
  misc_feature (358)..(358): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
  modified_base (480)..(480): a, c, t, g, unknown or other
  misc_feature (480)..(480): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaacgtgggtgcgacacggcccctggacaaggccatgagtggatgggatggatcgagcgcttaacaataataacacacactatgacaanagaagttccgagggcaaggatccaccctgaccanagatacatccacgancacagacctacagtggacnctggacggagccgtagagtatcgtagaccgacgacggtccgttagttttaccgnggtcgcggaagagtaacagtaacgttagttagtaagtggtacgtacggtcgggacgtaaccggg

SEQ ID NO: 67926 - DNA, 522 bp, Homo sapiens
  misc_feature: GYAE6OF02IHHO1.37.37.D04.1.454.CMB.1.raw
  modified_base (279)..(279): a, c, t, g, unknown or other
  misc_feature (279)..(279): n is a, c, g, or t
  modified_base (336)..(336): a, c, t, g, unknown or other
  misc_feature (336)..(336): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (477)..(477): a, c, t, g, unknown or other
  misc_feature (477)..(477): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtncgacaggcccctggacaaggccatgagtggatgggatggatcagcgcttacaataanaacacacactatgcacagaagttccagggcagagtcaccctgaccanagatacatccagancacagcctacatggagctaggaggacgccgtagagatcgtagaccgacacggccgttagtttacgtgtgcgtagacgtanaagtaatagttagaagttcggaactacgtcggggacctaacgggg

SEQ ID NO: 67927 - DNA, 625 bp, Homo sapiens
  misc_feature: GYAE6OF02HJRWS.37.37.D04.1.454.CMB.1.raw
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
  modified_base (429)..(429): a, c, t, g, unknown or other
  misc_feature (429)..(429): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctccagataccactggagaaatagtgatgacgcagtctccagcccaccctgtctgtgtctccgaaggggaaagacgccaccctctcctgcagggccagtcagagtgtagcagcaacttagcctggtaccagcaagaacctggccaggcctccaggcctcctnatctagtggtgccatcccaccgagggcccagtggtacctccgagccgtaggttcaggtcggctaggtgggtcgngggactagtacgttcacgtctaccacctatacgacgcacgcctagctagtctaggaagttntttgactttagttttactttcgtagttcagtacttaagttaacttaatttaccgtcggtaccttacccgttacggttacggtaccggtttccgggaaccggtaacggggtaccgtaaaggggtaacggtaaacttaaccggaaaaccggtacgttagggtacggtcctacggaaccctaaccgtacgttcgttacg

SEQ ID NO: 67928 - DNA, 249 bp, Homo sapiens; identical to SEQ ID NO: 67463
  misc_feature: GYAE6OF02HN7DP.37.37.D04.1.454.CMB.1.raw
  modified_base (247)..(249): a, c, t, g, unknown or other
  misc_feature (247)..(249): n is a, c, g, or t

SEQ ID NO: 67929 - DNA, 544 bp, Homo sapiens
  misc_feature: GYAE6OF02H59P3.37.37.D04.1.454.CMB.1.raw
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (421)..(421): a, c, t, g, unknown or other
  misc_feature (421)..(421): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatggagtggatgggatggatcgagcgacttaanaataataacacacaactangacacagaagttccaggcagactcaccctgaccacagactacatccacgagcacacgcctacatgganctaggaggagccgtagagtatcgtggaacgacgacggtaccgttgttttactgtggacgaggtacgtacgaagtaagtagtttagaacgtagggtaacctacggtcggggaccgtaaccgggg

SEQ ID NO: 67930 - DNA, 253 bp, Homo sapiens
  misc_feature: GYAE6OF02ITMP7.37.37.D04.1.454.CMB.1.raw
  modified_base (226)..(226): a, c, t, g, unknown or other
  misc_feature (226)..(226): n is a, c, g, or t
  modified_base (247)..(253): a, c, t, g, unknown or other
  misc_feature (247)..(253): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgancgggctggcaaggcgcatagnnnnnnn

SEQ ID NO: 67931 - DNA, 248 bp, Homo sapiens; identical to SEQ ID NO: 67467
  misc_feature: GYAE6OF02GATIJ.37.37.D04.1.454.CMB.1.raw
  modified_base (247)..(248): a, c, t, g, unknown or other
  misc_feature (247)..(248): n is a, c, g, or t

SEQ ID NO: 67932 - DNA, 251 bp, Homo sapiens; identical to SEQ ID NO: 67542
  misc_feature: GYAE6OF02HPWTF.37.37.D04.1.454.CMB.1.raw
  modified_base (247)..(251): a, c, t, g, unknown or other
  misc_feature (247)..(251): n is a, c, g, or t

SEQ ID NO: 67933 - DNA, 571 bp, Homo sapiens
  misc_feature: GYAE6OF02HTA1C.37.37.D04.1.454.CMB.1.raw
  modified_base (330)..(330): a, c, t, g, unknown or other
  misc_feature (330)..(330): n is a, c, g, or t
  modified_base (428)..(428): a, c, t, g, unknown or other
  misc_feature (428)..(428): n is a, c, g, or t
  modified_base (471)..(471): a, c, t, g, unknown or other
  misc_feature (471)..(471): n is a, c, g, or t
tcagtagtgtagatcacgaccggtgctcgatttagtagcatactgttgggtttggggacccgaaaaaccaacaacccctccttcgggagaatcccctagatcacagctcctcaccatggactggacctggagcatccttttcctggtggcagcagcaacaggtgcccactcctcaggttcagctggtgcagtctggagctgaggtgaagaagccgtggggcctcgagtgaaggtctcctgcaaggcttctggttataccttttagctaattatggtatcaacgtgggtgcgacaggcccctggacaaggccatgagtgatgggatggatnagcgacttacaataataacacacaactatcgacaacagaaagttccaagggccaaggacgtcaacccgtagaccacgagacgtaacactaccaaacgngacctaacgaacgccttaacgacgtaggactacgtagaggacnccgtagacgagttcagtacgaccgacgtccgttagtttcgacgttgcgaagaggtacagttaatagttacgaagtggtaactcggtagggaccaacgggg

SEQ ID NO: 67934 - DNA, 608 bp, Homo sapiens
  misc_feature: GYAE6OF02GAJ82.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttgcctggtaccagcagaaacctggccaggctcccaggcctcctcatctagtggtgcatccacgagggccacgtggtactcccagccaggttcaggtgcagtgggtctgggacaggacgttcacgtctcaccatcagcacgccgtgcagtctagaatattttggacttagttttatttcgtgttctagtctaaggttaacttaagttaaccgttcggtacccttaccgttaacggttcggttaaccggttccgggacccggtaacggggtacccgtaaaggggttaacgggaaaacttaccggaaaaccggtacgttacggtacggtaccgtacggacccgtaaccgtacgttctttaccgg

SEQ ID NO: 67935 - DNA, 518 bp, Homo sapiens
  misc_feature: GYAE6OF02IRKRL.37.37.D04.1.454.CMB.1.raw
  modified_base (465)..(465): a, c, t, g, unknown or other
  misc_feature (465)..(465): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttaacaataataacacacactatgacacagaagttcaggcagacgtcaccctgaccacagatacatccagagcaacagcctacatggagctaggagggagccgtagagatcgtagacgacgacggtccgttagtttacngtgcgaagtagtacaagtatattagtaatggaactacggtcgggactaacggg

SEQ ID NO: 67936 - DNA, 598 bp, Homo sapiens
  misc_feature: GYAE6OF02IEDTT.37.37.D04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (296)..(296): a, c, t, g, unknown or other
  misc_feature (296)..(296): n is a, c, g, or t
  modified_base (355)..(355): a, c, t, g, unknown or other
  misc_feature (355)..(355): n is a, c, g, or t
  modified_base (400)..(400): a, c, t, g, unknown or other
  misc_feature (400)..(400): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctcaggggaaangccaccctntcctgcagggccagtcagagtgtagcagcaacttgcctggtaccagcagaacctggccaggctcccaggctcctcatctatggtncatccacacgggccacgtggtactcccagccaggttcagtggcaggtcggtctgggacngtagttcactctcacctatcagcacgcctgctagtctagtaagtntttgacttagtttatttcgtgttacacgtacgtaggttaacttaacgtttaccgttcggtacccttccgttaccgggttacggtaccggttttaccgggacccgtaacggggtaaccggtaacgggtaacgggtaaaccttaacggaaaccggtaagttacgggtacggacctggtaccctaccgtattcccgttacg

SEQ ID NO: 67937 - DNA, 250 bp, Homo sapiens; identical to SEQ ID NO: 67462
  misc_feature: GYAE6OF02I2CPQ.37.37.D04.1.454.CMB.1.raw
  modified_base (247)..(250): a, c, t, g, unknown or other
  misc_feature (247)..(250): n is a, c, g, or t

SEQ ID NO: 67938 - DNA, 588 bp, Homo sapiens
  misc_feature: GYAE6OF02FMV7V.37.37.D04.1.454.CMB.1.raw
  modified_base (298)..(298): a, c, t, g, unknown or other
  misc_feature (298)..(298): n is a, c, g, or t
tcagtagtgtagatcacgaccggtgctcgattagtagcatactgttgggtttggggacccaaaacccacacccctccttgggagaatcccctagatcacagctcctcaccatggactggacctggagcatcctttcctggtgcagcagcaacagtgcccactctcaggttcagctggtgcagtctggagctgaggtgagagcctgggcctcagtgaggtctcctgcaggcttctggtttactaccttagcaatatggtatcactgggtgcgacacggccccctggaccaacggccatnagtgatggatggatcagcgacttacaataactaacacacactatgcaacaagaacgttccgaggggcaaggacgtccacccctgaacccacacgactaaccactacccacgacgccaccacgtcctacacgtcggacgcgtaggacggacgcccgttagaacgtactacgtaggaacccgtacacccgggtcctttacggttttaccgtgacgtcggaagtacgtaacctaagtaacgttagttacggtaacgtcggtaccgtaccggttcggggaccccgtaaccgggg

SEQ ID NO: 67939 - DNA, 503 bp, Homo sapiens
  misc_feature: GYAE6OF02HB248.37.37.D04.1.454.CMB.1.raw
  modified_base (203)..(203): a, c, t, g, unknown or other
  misc_feature (203)..(203): n is a, c, g, or t
  modified_base (398)..(398): a, c, t, g, unknown or other
  misc_feature (398)..(398): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccactggtactcccagccaggttcagtggcaggtgggtctgggacagagttcactctcaccatcagcagcctgcagtctgaagtntttgctagtttatttctgtcagctagtataattactggtccttcctacgtcggacgttcggccgagggaccaggtgaatcgaacgactgtggctgcactatctcg

SEQ ID NO: 67940 - DNA, 718 bp, Homo sapiens
  misc_feature: GYAE6OF02FRC9A.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtcgcccactctcaggttcagctggtgcagtcgtggagctggaggtagaagaacgccgtggggcctcgaggtaggaacggtcctccgtgacgaaggtctttcgtggtttaacttacctttagactaatttagtaggtatacgtaacggtggggtcgaccggacgaccgggtcccccgtagggaacaacgggcctagtggaggtggagtgggatggactcgacggaccgtacttaaacaaataaactaaacaccaactaactagtacgacaacgtaaggtaaccgttaccggaaggacaacggtaccgtacccaacccgtacgaaccaacgaacgtaactaacctacgtacccgaacggaacgacccaacgtaccgtaaccctaagacggtacggacgtacggtaggaacggtaccgtcggtaagacgtactaccggacggaaccgtaccggtaccggtttcgttttacgttacgtggtacgaacggtaaggtaacgtaagtaagttaagttagttacggtacggtacggtaccgtacgggtaccggaccggtaacccggg

SEQ ID NO: 67941 - DNA, 550 bp, Homo sapiens
  misc_feature: GYAE6OF02IADJJ.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcactctatggtgcatcccaccgagggccacgtggtactcccagccaggttcagtggcaggtgggtctgggacaggagttcactctcacctatcagcagcctgcagtctagaagtatttgcttagtttatttctgtcagtctagtattaattacgtggtcccttccgtacggtcggtacgtttcggaccgtaagggacccgtaagggtacggtaaactacgaaacgtaacgtaggtaggcgtacgaccacctactcgttcg

SEQ ID NO: 67942 - DNA, 554 bp, Homo sapiens
  misc_feature: GYAE6OF02G14MH.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttcagggcagagtcaccctgaccacagatacatccacgacgcaacacgacctaacataggagcgtaggaggacgccgtagagatctagaccgaacgacggtaccgttagttttacgtgttacggacggaaggtagtaacgaaggtaagttagttaggttaacgtggtaacgttacggtcggggaccgtaaccggggg

SEQ ID NO: 67943 - DNA, 846 bp, Homo sapiens
  misc_feature: GYAE6OF02I569G.37.37.D04.1.454.CMB.1.raw
tcagtagtgtagatcacgaccggtgctcgatttagtagcatactgttgggtttggggacccaaaaccacacccctccttgggagaatcccctagatcacagctcctcaccatggactggacctgggacactactttcccttttcgtgggtcggacacgacgacgaaccaaacggtagggtcccgacccctaccttcctacggttacggttacgacgtcggttgggtcgacgtacgttcggtaggacgtcgtagggtagggtaaggaaaggaccgtccggggtccgggtcctagtaggtaaggtacggttccttcgacgaacggaacggttcttcggttaggttaacctttaaccgttagaacttaaagtttaggtaggttactaaccgtaagggttgggtacgaccgacggacccggtcccggtaggaaacgaacgcctaggtaggtaggtagtaggtggtagtaggatacggacgacgttacctaaataaattaaacaaccgacaactaactagcaaccaagaaggtaccgtacggagacagtaccgtacctaccgacaacgaagtagaactacgccgtaccgaacgacgaccaacgaccgtaccttaacgtaggtacggactacgtaaggaccgggaccgtccgaaggtaacgtacttaccgggaccggaaaccgttaacccgggtaccgggtttaccgtttttaacggtttacgtcgggaaggaaccggttaacggtaacgttaaacggaaacgtttaaacgttttacggtttaacgggttaacggacccgggttaaacccggttacggggttacccggggaaaccccgggttaaacccgggg

SEQ ID NO: 67944 - DNA, 249 bp, Homo sapiens; identical to SEQ ID NO: 67463
  misc_feature: GYAE6OF02GKU59.37.37.D04.1.454.CMB.1.raw
  modified_base (247)..(249): a, c, t, g, unknown or other
  misc_feature (247)..(249): n is a, c, g, or t

SEQ ID NO: 67945 - DNA, 586 bp, Homo sapiens
  misc_feature: GYAE6OF02GH3AF.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctgggcaaggccagtgagtggatgggatggatcgagcgcttacaataataacacacactatgcacagaagtccgagggcagagtcacctgaccacagatacactacccagacgcaacgacgacctaacatgggacgctggaacggagcctaggaacgtagttcgtaggaaccgaccgtaccgggtaccgtttagttttaccgtggtacggacggtaaggtaagtaaccgtaagtaactttagttacggttaagttacgggtaacgttaccggttacgggggacccgtaacccggggg

SEQ ID NO: 67946 - DNA, 275 bp, Homo sapiens
  misc_feature: GYAE6OF02HI3DB.37.37.D04.1.454.CMB.1.raw
  modified_base (250)..(275): a, c, t, g, unknown or other
  misc_feature (250)..(275): n is a, c, g, or t
tcagtagtgtagatcacgaccggtgctcgatttagtagcatactgttgggtttgggtgcccaagctgctggagggcacggtcaccacgctcgctgagggagtagagtcctgaggactgtaggacagcccatcggtcttccccctggcaccctcctccaagagcacctctgggggcacagcggccctgggcctgcctggtcaaggactacgttccatctacactactgagcgggctggcaaggcgcatagnnnnnnnnnnnnnnnnnnnnnnnnnn

SEQ ID NO: 67947 - DNA, 606 bp, Homo sapiens
  misc_feature: GYAE6OF02JX4PT.37.37.D04.1.454.CMB.1.raw
  modified_base (402)..(402): a, c, t, g, unknown or other
  misc_feature (402)..(402): n is a, c, g, or t
  modified_base (518)..(518): a, c, t, g, unknown or other
  misc_feature (518)..(518): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtctggagctgaggtgaagagccgtggggcctcagtgaaggtctcctgcaaggcttcgtggttatacctttagctaattatggtatcaacgtgggtgcgacacggcccctggaacgaggccagtgagtggagtgggatggatcgagcgacttaacgaaataataacaacacactatcgactaagagtaacgttccgagggacaggactccaccgtnaccacagactacactaccgagacgcaacacgacctagacgtaggacgagtacggacggacgccgtagagtactacgtacgaaccgaccgacgggtacccgtttagttttaacccgngggttacgaccggtaggtaaccgtaacgtaacgtaaagtttacgttagttaacgtggtaacctacgggtacgggaccggtaacccggg

SEQ ID NO: 67948 - DNA, 248 bp, Homo sapiens
  misc_feature: GYAE6OF02G4J16.37.37.D04.1.454.CMB.1.raw
  modified_base (246)..(248): a, c, t, g, unknown or other
  misc_feature (246)..(248): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcggctggcaaggcgcatagnnn

SEQ ID NO: 67949 - DNA, 252 bp, Homo sapiens
  misc_feature: GYAE6OF02GN6B4.37.37.D04.1.454.CMB.1.raw
  modified_base (247)..(252): a, c, t, g, unknown or other
  misc_feature (247)..(252): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnn

SEQ ID NO: 67950 - DNA, 506 bp, Homo sapiens
  misc_feature: GYAE6OF02IBBZD.37.37.D04.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
tcagtagtgtagatcacgaccggtgctcgatttagtagcatactgttgggtttgggggagaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctnatctatggtncatccacagggccatggtactcccagccaggttcagtggcaggtgggtctgggacngattcactcncaccatcagcagcctgcagtctagaagtatttgctagtttattctgtcagtcagttatattacgtggccttctacgtggacgttcggcaagggaccaagggtgaaatacgaaacgtaactgtggactgaccactatctcg

SEQ ID NO: 67951 - DNA, 556 bp, Homo sapiens
  misc_feature: GYAE6OF02GK8N8.37.37.D04.1.454.CMB.1.raw
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
tcagtagtgtagatcacgaccggtgctcgatttagtagcatactgttgggtttgggggacccaaaaaccacaccctccttgggagaatcccctagatcacagctcctcaccatggactggacctggagcatccttttcctggtggcagcagcaacaggtgcccactctcaggttcagctggtgcagtctggagctgaggtgaagaagcctgggcctcagtgaaggtctcctgcaaggcttctggttatacctttagctaattatggtatcaactggtgcgacaggcccctggaacaaggccatgagtggatgggatggatcgagcgcgttacaataataacacacactatgcacagaagttccaggcagactccaacctgaccacagactacatccaacgagcaacgacgacctaanattggagctagaggancctgagatcgtagaacgaaccacggtccgtttagttttaccgtgttaggaccggaaggtaagttaccaaggtaattaagttagttaaacgtgggtaacctacggttacggggacctaacgggg

SEQ ID NO: 67952 - DNA, 525 bp, Homo sapiens
  misc_feature: GYAE6OF02GL1L3.37.37.D04.1.454.CMB.1.raw
  modified_base (399)..(399): a, c, t, g, unknown or other
  misc_feature (399)..(399): n is a, c, g, or t
  modified_base (467)..(467): a, c, t, g, unknown or other
  misc_feature (467)..(467): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcgagcgcttacaataataacacacactatgacacagaagttccagggcagagtcacctgaccacagatacatccacgancaacagcctaacatcggagctgaggacgcctagagatcgtagaccgacgaccggtccgttgttttacngtgacggtagagtacagtaattagttagtaagtggactacggtacggggcctaacggg

SEQ ID NO: 67953 - DNA, 256 bp, Homo sapiens; identical to SEQ ID NO: 67907
  misc_feature: GYAE6OF02H324G.37.37.D04.1.454.CMB.1.raw
  modified_base (247)..(256): a, c, t, g, unknown or other
  misc_feature (247)..(256): n is a, c, g, or t

SEQ ID NO: 67954 - DNA, 550 bp, Homo sapiens
  misc_feature: GYAE6OF02HUO3Y.37.37.D04.1.454.CMB.1.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttagcagcaacttagcctggtaccagcagaacctggccaggctcccaggctccncatctatggtgcatccaccgagggccacgtcggtactcccagcctaggttcagttggctaggtgggtctgggacagngttcactcncaccatcagcagcctgcagtctgaagtattttgctagtttatttctgtcagtctaagttaattaattacgtcggtccttcgtacgtcggtacgttcggaccgtaagggaccgtaagggtacggtaacgtacgaaacgtaacgtggtacggtactacgacctaccgtactcgttacg

SEQ ID NO: 67955 - DNA, 544 bp, Homo sapiens
  misc_feature: GYAE6OF02I4QJC.37.37.D04.1.454.CMB.1.raw
  modified_base (477)..(477): a, c, t, g, unknown or other
  misc_feature (477)..(477): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcgagcgcttacaataataacacacactatgacacagacgttcgagggcaggagtccacctgaccacagatacataccacgacgcacacgacctacagtggacgctaggaaggacgccgtagagtactcgtagaccgacgacggtcgttagtttacgngtgacggaagtacgtaacaagtaattagttagtaagtcggtaactacggttcgggaccgtaacgggg

SEQ ID NO: 67956 - DNA, 533 bp, Homo sapiens
  misc_feature: GYAE6OF02IANW5.37.37.D04.1.454.CMB.1.raw
  modified_base (344)..(344): a, c, t, g, unknown or other
  misc_feature (344)..(344): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggttcccaggctcatcatctatggtgcatcccaccagggccacgtggtactcccagcccaccgtttagnggctaggtgggtctggggacaggtagttccactctccacctatcagcacgcctgcngtctgaagtnttttgcttagttttattactgtcaactagtacaatgactcggcctctctacgttcggacgggaggaccagggtggagatacgaaacgtacgttggtaggtcgtcgaccacctactcgtgttcc

SEQ ID NO: 67957 - DNA, 562 bp, Homo sapiens
  misc_feature: GYAE6OF02G4W8Q.37.37.D04.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagcagcaacttagcctggtaccagcagaaacctggccaggctcccaggctcctcatctatggtncatccacagggccactggtactcccagccaggttcagtggcagtgggtcngggacagtagttcactctcaccatcagcagcctgcngtctgaacgtntttggtattttattcgtgtactagtcgtagttacttacgttcctcgggtcctacgggtaccgtttcggaccccgtaggggaacccgtaacgggtacgtaaacgtaccgaaaacgtacgtaggtcggaccgtcggtaccaccgtattcccgtgttaccttcgtaccg

SEQ ID NO: 67958 - DNA, 296 bp, Homo sapiens
  misc_feature: GYAE6OF02HM1TV.37.37.D04.1.454.CMB.1.raw
  modified_base (249)..(249): a, c, t, g, unknown or other
  misc_feature (249)..(249): n is a, c, g, or t
  modified_base (251)..(296): a, c, t, g, unknown or other
  misc_feature (251)..(296): n is a, c, g, or t
tcagtagtgtagatcacgaccggtgctcgatttagtagcatactgttggggtttgggtgcccaagctgctggagggcacggtcaccacgctgctgagggagtagagtcctgaggactgtaggacagcccatcggtcttccccctggcaccctgctccaggagcacctccgagagcacagcggccctgggctgcctggtcaaggctacttccatctacactactgagcgggctggcaaggcgcatagacngnnnnnnnnnnnnnnnnnnnnnnnnnnnnnnnnnnnnnnnnnnnnnn

SEQ ID NO: 67959 - DNA, 502 bp, Homo sapiens
  misc_feature: GYAE6OF02GI69F.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgaccacagatacatccacgagacacagcctaacatggagctgaggagcctgagatctgaacgacacggccgtgtttactgtgcgagagtacagaatattgtaatggactacgtgggcctaacggg

SEQ ID NO: 67960 - DNA, 539 bp, Homo sapiens
  misc_feature: GYAE6OF02JG7FL.37.37.D04.1.454.CMB.1.raw
  modified_base (349)..(349): a, c, t, g, unknown or other
  misc_feature (349)..(349): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagtagtgtagatcacgaccggtgctcgatttagtagcatactgttgggtttggggacccaaaaaccacacccctccttggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcgagcgcttacaataataacacacactatncacagaagttccaggcagagtcacctgacacagatacatccagacgcaacacncctaacataggancgtagaggagcctagagatcgtacgacgaccgacggtccgttagttttacctggtgcggaaggtacgtacaaggtaattagttagtaacgtaggtacgtacggttcggggaccgtaaccggggg

SEQ ID NO: 67961 - DNA, 682 bp, Homo sapiens
  misc_feature: GYAE6OF02H955V.37.37.D04.1.454.CMB.1.raw
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcagtgaaggtctctgcaaggcttctggttatacctttagctaattagtggttaatacaacgtgggtgcgtacgacggcccctaggacaaggccagtgagtggatgggatggatcgagcgtacttaacgaataactaacacacaactatgacacgaagtaacgtccgaaggcagacgtcacccgtagaccaanacgatacactcacganacacacgcctaagataggacgcgtaggaacggtacgacccgtaggaacgtacgtacgtaccgggaaccgtaaccggtaccgggttcccgtttaacggtttttaccgtagggttaccggtaaccgggtaacgggttaaacggttaaaccggtaagggttaaaactttacgggtttaacggttaaaacgggttaccggggtttaaacccggtttaccggggttaaccgggggggtaaccccgtaaaacccggggggg

SEQ ID NO: 67962 - DNA, 537 bp, Homo sapiens
  misc_feature: GYAE6OF02JF1KW.37.37.D04.1.454.CMB.1.raw
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
  modified_base (469)..(469): a, c, t, g, unknown or other
  misc_feature (469)..(469): n is a, c, g, or t
tcagtagtgtagatcacgaccggtgctcgatttagtagcatactgttgggtttggggacccaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactggtgcgacaggcccctggacaaggtccatcgagtggatgggatggatcgagcgacttacgaataactaacacacactaatgcacagaagttccaggcagagtcacctgacacagatacatcacgagcacacgcctanatagganctgagggacnccgtagagactcgtagacgaccacgggtccgttagttttacngtcgacgtaaggaagttaccaaggtaattagttacgtaagtcggaacttacggtggggacctaacggg

SEQ ID NO: 67963 - DNA, 500 bp, Homo sapiens
  misc_feature: GYAE6OF02G7YES.37.37.D04.1.454.CMB.1.raw
  modified_base (413)..(413): a, c, t, g, unknown or other
  misc_feature (413)..(413): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttcagggcagagtcaccctgaccacagatacatccacgagcacagcctacatgganctgaggagccgtgagatcgtgacgacgacggccgttgtttactgtgcgagagtacagaatattgtaatggactacgtggggcacggg

SEQ ID NO: 67964 - DNA, 553 bp, Homo sapiens
  misc_feature: GYAE6OF02HNHJB.37.37.D04.1.454.CMB.1.raw
  modified_base (295)..(295): a, c, t, g, unknown or other
  misc_feature (295)..(295): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgttgtcgtacaggggaaagacgcccaccctctcctgcaggccagtcagagtgtaagcagcaacttagcctggtaccagccaggaacctggccaggctcccagctacctnatctatggtgcatccaaccagggccacgtggtactcccgagcctaggttcagtggctaggttgggtactgggacagtacgttcaacttcctacaccaatccagcagtcctagcttagtctgaagtatttgacttagtttattctagttcagtctagttataagttcgtcggaccttcgtaacgtgaacgttcggacgtaaggacctaaggtacgaaactacaaacgtacgtgtacggctcggaccaccgtatcgtacg

SEQ ID NO: 67965 - DNA, 554 bp, Homo sapiens
  misc_feature: GYAE6OF02G7BOY.37.37.D04.1.454.CMB.1.raw
  modified_base (205)..(205): a, c, t, g, unknown or other
  misc_feature (205)..(205): n is a, c, g, or t
  modified_base (405)..(405): a, c, t, g, unknown or other
  misc_feature (405)..(405): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagagtgttagcagcaacttagcctggtaccagcagaaacctggccaggctcccaggcctcctcatctatggtgcatccaccgagggccacgtggtactcccagccaggttcagtggcaggtgggtctggggacaggtgttcactctcaccatcagcagcctgcagtctagaagtnttttgacttagtttattctgtcagtctagttattaacttacgtcggtccttaccgttacggtcggtaccgttccggaccgaacgggtaccgtaagggtaggaaactacgaaaacgtacgttaggacggtactcgaccaacgtatcttcg

SEQ ID NO: 67966 - DNA, 576 bp, Homo sapiens
  misc_feature: GYAE6OF02IVR0J.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggccctggacaaggccatgagtggatgggatggatcgagcgcttaacaataataacacacactatgacacagaagttccagggcagagtccaccctgaccacagactacatccacgacgacaacgacgacctaacagtcgggacgctaggaaggacgccgtagaacgactcgtaggaaccgacgacgggtccgtttagttttaccgtggtacgacggtaaggacgttaacgaaggtaaattagttacggttaagtacgggtaaccgtacggtacgggggaccctaacgggg

SEQ ID NO: 67967 - DNA, 615 bp, Homo sapiens
  misc_feature: GYAE6OF02F49PH.37.37.D04.1.454.CMB.1.raw
tcagtagtgtagatcacgaccggtgctcgatttagtagcatactgttgggtttgggacccaaaaaccacacccctccttgggagaatcccctagatacacagctcctcaccatggactggacctggagcatccttttcctggtggcagcagcaacaggtgcccactctcacggttcagctggtgcagtcgtggagctgaggtgaagaagccgtgggggcctcgaggtgaaggtctccgtgcaaggtcttcgtggttacttacctttagactaatttatcggtaatcaacgtgggtgcgtacgacggcccctggacgaaggccagtgagtggatgggatggatcgagcgtacttaacaataagtaacacacaactatcgacacaagtaacgtccagggcagacgtccacctgaaccacagaactaacactacccacgacgacaacgtacgaccttaagagtacggactcgtaggacggtacgccgtagaccgtgtacgagaaccgacgtacggtccgttagtttacgtgtacgacggtaagtacgtaacgtaaggtaacgttaacgttaggtaacggttcggtaaccgtacgggttaccggggaccggtaaccggg

SEQ ID NO: 67968 - DNA, 509 bp, Homo sapiens
  misc_feature: GYAE6OF02G7EDT.37.37.D04.1.454.CMB.1.raw
  modified_base (381)..(381): a, c, t, g, unknown or other
  misc_feature (381)..(381): n is a, c, g, or t
  modified_base (458)..(458): a, c, t, g, unknown or other
  misc_feature (458)..(458): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactggtgcgacaggccctggacaaggccatgagtggatgggatggatcagcgcttacaataataacacacactatgcacagaagttccagggcagagtcaccctgaccanagatacatccaacgagacacacgacctacatggagcgtgaggagccgtgagatctgacgacacggtccgtgtttacngtgcgaagagtacaagtatagttagtaatggactacgtcgggactaacggg

SEQ ID NO: 67969 - DNA, 251 bp, Homo sapiens; identical to SEQ ID NO: 67542
  misc_feature: GYAE6OF02GQ5TV.37.37.D04.1.454.CMB.1.raw
  modified_base (247)..(251): a, c, t, g, unknown or other
  misc_feature (247)..(251): n is a, c, g, or t

SEQ ID NO: 67970 - DNA, 507 bp, Homo sapiens
  misc_feature: GYAE6OF02GUPDX.37.37.D04.1.454.CMB.1.raw
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (458)..(458): a, c, t, g, unknown or other
  misc_feature (458)..(458): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgnttacaataanaacacacactatgcacagaagttccagggcagagtcaccctgaccacagatacataccacgagcacagtcctaacagtggagctggaggagcctgagatctgacgacacggtcgtgtttacngtcgcgagatacgaagtaatagtgtaagtggactacgtggcgtaacggg

SEQ ID NO: 67971 - DNA, 249 bp, Homo sapiens; identical to SEQ ID NO: 67463
  misc_feature: GYAE6OF02GZ0X3.37.37.D04.1.454.CMB.1.raw
  modified_base (247)..(249): a, c, t, g, unknown or other
  misc_feature (247)..(249): n is a, c, g, or t

SEQ ID NO: 67972 - DNA, 616 bp, Homo sapiens
  misc_feature: GYAE6OF02H5B62.37.37.D04.1.454.CMB.1.raw
  modified_base (434)..(434): a, c, t, g, unknown or other
  misc_feature (434)..(434): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagcaattatggtatcaacgtgggtgcgacacggcccctggacaaggccaagtgaggtggagtgggatgggatcgaagcgtacttaacaataaactacaacactaactatgacacaagtaacgttccgaggacaggacgtaccacccgtagaaccacaagaactacactaccgaagacnccaacagacccttaacgacgtggaacgtcgacggaaggtacgaccgtgaacgtactcgtagaccgaacgtacggtaccgttagttttcctaggtacgtcggaaggtaacgtacgaagttaaagttaacgtttacggtaaagttacggtaaccgttacgggtaccggggaccgtaaaccgggg

SEQ ID NO: 67973 - DNA, 676 bp, Homo sapiens
  misc_feature: GYAE6OF02G31ZR.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagcaattatggtatcaacgtgggtgcgacacggccctggacaaggccatggagtggagtgggatggatcagcgtacttaacaataaactaacacaacactatgacaacgaggtaacgttaccgaaggggtacaggacgtaccaaccctaggaacccaacgaagactaacactacccgaacgacgacaaccgacgacctaacgagtacggagtacgtaggacggacgtaccgtaggaacgtacgttacgtaggaaccgtaaccgtaaccgggttccgttttaggtttttaccgtgggttacggtaccgggtaaacggtaaccggttaaacgtaaacggttaaagttttacggtttaacggttaaacggttacgggttaaccgttaacggggttacccggggaacccggttaaacccggggg

SEQ ID NO: 67974 - DNA, 635 bp, Homo sapiens
  misc_feature: GYAE6OF02H5Y0M.37.37.D04.1.454.CMB.1.raw
  modified_base (206)..(206): a, c, t, g, unknown or other
  misc_feature (206)..(206): n is a, c, g, or t
  modified_base (432)..(432): a, c, t, g, unknown or other
  misc_feature (432)..(432): n is a, c, g, or t
tcagtagtgtagatcacgaccggtgctcgatttagtagcatactgttgggtttgggggaggtaacgtgctctagttaggacccagacggaacatggaagccccagcgcagcttctcttcctcctgctactctggctcccagataccactggagaaatgtgatgacgcagtctccagccaccctggtctgtgtctccgaggggaaanagccacccgtctcctgccagggccagtcagagtgttagcagcaacttagcctggtaccagcagtaaacctggaccaggctcccaggctccctgactctagtggttcattcctgaacggccacgtggctacgtccccgagtacggttcagtcgggtcgtgggtctaggggacaggtacttccacttctcctaccagtccgagtccaagactaagacgaccgggtaanaccttctagcctagttacgttcttttcgacgttccaagtcgaagttagtcggtacgtagccgttaccgaacccgttccgtaaccggttcggacccgtaaagggacccgtaagggtacggtaaactacggtaaaaccggtacgttacggggtacggtaccgttacggacccgtaaccgttgttacgttacgttcccttaacccg

SEQ ID NO: 67975 - DNA, 653 bp, Homo sapiens
  misc_feature: GYAE6OF02JEWFZ.37.37.D04.1.454.CMB.1.raw
tcagtagtgtagatcacgaccggtgctcgatttagtagcatactggttgggtttggggacccgaaaaccacacccctccttgggagaatccccgtagatcacagctcctcaccatggactggaccctggagcatccttttcctggtggcagcagcaaccaggtgcccactctcaggttcagctcggtgcagtctggagctgaggtgaagaagccgtggggcctcagtgaaggtctcctgcaaggcttcgtaggttaataccgtttagctaattagtggtatcaacgtggtgcgacgacggccccctggacctaaggtccagtcgtaagtacggatgggatcggactacgacggtccgactttaacaaagtaaacttaaccaactacgtaactaagtcggacaacgaaggtaaacgtttaccgaaggggtaccaaggtaccgttaccaacccgttacgaacccgtaacgaacggaactaaccgaacgtaccgaacgtacgaccaacgacgtacctaacgactacggacgtcctaggacggacaccgtgagcttacgacgtacgacgtacggtccggttagtttaccgagtcgtacgaagtacgtacgagtaagttatacggtagtcggtacgtacggtacggaccgtaaccggg

SEQ ID NO: 67976 - DNA, 659 bp, Homo sapiens
  misc_feature: GYAE6OF02GORAB.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacgacggcccctggaccaaggccagtgagtggagtgggatggatcagcgcttaacaataaataacacaacactatcgacacagaacgttcgaagggcagagtccaaccctgaccacagactacactaccgaacgacgaccaacgacgaccctaacgagttacgggaacgtcgtaggaacgggaacgaccgtaggtaagacgttccgtacggaaccgtaaccggtacccggtaccggtttacggtttttaaccttcgggttacggtaccgggtaaggaacgggttaaaccgtaaggttaaacgtttaagtttaacgggtttaaacgttacggggttaaccgtttaacgggtaccggggggtacccggtaaacccggggg

SEQ ID NO: 67977 - DNA, 623 bp, Homo sapiens
  misc_feature: GYAE6OF02GV5J3.37.37.D04.1.454.CMB.1.raw
  modified_base (341)..(341): a, c, t, g, unknown or other
  misc_feature (341)..(341): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagctaatttatggtatcaacgtgggtgcgacacggcccctggacaaggccagtggagtggagtgggatggatcgagcgtcttaanaataataacacacactatgacaacagtaagttccgagggcagacgtccacccgtgaccacagactacactaccacgagaccacacgcctaacgagtaggagtcgtaggaaggacgtccgtaggaacgtacgttacgtacggaaccgtaaccgtaccgggttcccgtttacgtttttaaccgtggttacggacgggtaaggtaacggttaacgaaggtaaactttagttacggttaacgttacgggtaaccgttacgggttacgggggaacccgtaaccgggg

SEQ ID NO: 67978 - DNA, 903 bp, Homo sapiens
  misc_feature: GYAE6OF02I23DL.37.37.D04.1.454.CMB.1.raw
tcagtagtgtagatcacgaccggtgctcgatttagtagcatactgttgggttttggggacccaaaaaccacacccctccgtttggggagaatcccctacgatcacgacgctccctcgaccatacggactggaccgtggacggccaatcccttttccgtgggtgggcctaggcacgtcaaccaggtcgcccactctcgaggtttccaggctcggtcgctagtcgttgggaggttccttggaggggtgaagggtaacggccgtgggggcccttccgaagggtagggaacggttccgtacctagacgtaagggtcctttcgttcggtttacttaccgttttagaccgttaaagtttacgtttcggttaacttaccgtaaacggtttcgggttacgtccgaaccgacgggtacccccgttagggaacctaaacggccctaagttggaacggttggggaggtacggggtaaacgtcgggtaacttaccgaaggtccgtacttttaaaccgaaagttaaactaacgactaacgtacttaagtcgacgaacgacgtaaacgttaccggagggtacctaaggttacgtccgtaaccggtacgaaccgaaaccggtagtaacgttaaactacgttaccgtaacgggttaacggtccgtaaacggttaaccgttacccgttaaacctacggttaacgggaaccgtaccgggttacggggaacgggtacccgtaaccggtacggggaaaccggtagttaccgttacgggaacccggtaaccggtacccggttccgttttacgtttacggtccgtacgtaaccgggtaacggtaaccgttaacgaacggttacttaccggtttaaggtaaccgttccggtaaacccgttacggtacggggaccccgtaaaccggg

SEQ ID NO: 67979 - DNA, 569 bp, Homo sapiens
  misc_feature: GYAE6OF02HA8PK.37.37.D04.1.454.CMB.1.raw
  modified_base (206)..(206): a, c, t, g, unknown or other
  misc_feature (206)..(206): n is a, c, g, or t
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctcggctcccagataccactggagaaatagtggatgacgcagtctccagccaccctgtctgtgtctccgaggggaaanagccaccctctcctgcagggccagtcagagtgttagcagcaacttagcctggtaccagcaagaaacctggccaggctcccaggcctcctcatctatggtgcatccaccgagggccagtggtactccccgagcctaggttccaggtcggcaggtgggtctgggacagagttcactctcacntcagcagcctgctagtctagaagttntttgcttagtttattctgtcagtctaagttactaattacgtggtccttacgttacggtcggtaaccgttcgggaccgtaaggggtaccgtaaggggttcggaaaacttacggaaaacgtacgtagggtacggtaccgtgaccacctagttcttacgg

SEQ ID NO: 67980 - DNA, 552 bp, Homo sapiens
  misc_feature: GYAE6OF02FL5AT.37.37.D04.1.454.CMB.1.raw
  modified_base (490)..(490): a, c, t, g, unknown or other
  misc_feature (490)..(490): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcgagcgcttaacaataataacacacactatgcacagaagttccagggcagagtccacctgaccacagaatacactaccaacgacgacaacacgaccctaacacgtaggagcgtaggaaggacgtccgtaggacgatacgtaggaaccgacgacggtccgttagttttacnggtgacgtaagacgtacgaagtaatagttagtaatcggactacggtcgggtacctaacgggg

SEQ ID NO: 67981 - DNA, 645 bp, Homo sapiens
  misc_feature: GYAE6OF02HLBZ3.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagctaattatggtatcaacgtgggtgcgacacggcccctggacaaggccatggagtggagtgggatggatcgagcgacttaacaaataaactaacacaacactatgacacaagtaacgttccgaagggacaaggacgtaccaccctagaaccacagaactacactaccgacgacgacaacacgacctaacgagtagggacgacgtaggaacgggtacgccgtaggaacgtacgttcgtacggaaccgtaacgtacccgggtccgtttacgttttacgtcggttaggaccggtaaggtaaccggtaacgtaaaggttaaacgttaagtttacgggtaaacgttcgggtaaaccgtttaaccgggtacgggggtaacccgtaacccggggg

SEQ ID NO: 67982 - DNA, 619 bp, Homo sapiens
  misc_feature: GYAE6OF02G1R7H.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaacgtgggtgcgacaggcccctggacaaggccagtgagtggagtggggatggatcgagcgtacttaacgaataaataacaacactaactatgacaacgagtaacgttccgaagggcaagacgtccaacccgtagacccaacgagaacttaacactaccgaacgaacgcaaccacgacctaacagtgggagcgtaggaacgggacgccgttaggaagtactacgtacgaaccgtaaccgtaccggtccggtttagttttacgacgttggacggaaggtaacgtaacgaagttaacgttagtttacgtaaggttcggaaccgttacgggtacggggtacccgtaacccggg

SEQ ID NO: 67983 - DNA, 496 bp, Homo sapiens
  misc_feature: GYAE6OF02FZGUB.37.37.D04.1.454.CMB.1.raw
  modified_base (382)..(382): a, c, t, g, unknown or other
  misc_feature (382)..(382): n is a, c, g, or t
  modified_base (450)..(450): a, c, t, g, unknown or other
  misc_feature (450)..(450): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggccctggacaaggccatgagtggatgggatggatcagcgcttacaataataacacacactatgcacagaagttccagggcagagtcaccctgaccanagatacatccacgagcacagcctacatgagctgaggagcctgagatctgacgacacggcgtgtttacngtgcgagagtacagtaatattgtaatggactacgtgggctaacggg

SEQ ID NO: 67984 - DNA, 615 bp, Homo sapiens
  misc_feature: GYAE6OF02ICJW6.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggttatacctttagctaattatggtatcaacgtgggtgcgacacggcccctggaccaaggccagtggaggtggagtgggatggatcgagcgtactaacaataaactaacacacactatgacaagagtaacgttccgaagggcaagacgtaccacccgtacgaaccacagaactacactaccgaacgacgaccaacgacgtacctaacagtagggacgcgtaggaacgggacgtaccgtagacgacgtcgacggaaccgaccgtaccgggtccgtttagttttaccgtggttacgacggtaagaacggtaacgaaggttaaattagttagtaacgtaggtaaccgttacggtaccggggacgtaaccgggg

SEQ ID NO: 67985 - DNA, 630 bp, Homo sapiens
  misc_feature: GYAE6OF02JQKVR.37.37.D04.1.454.CMB.1.raw
  modified_base (139)..(139): a, c, t, g, unknown or other
  misc_feature (139)..(139): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (464)..(464): a, c, t, g, unknown or other
  misc_feature (464)..(464): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatcctttccnggtggcagcagcaacaggtgcccactctcaggttcagctggtgcagtctggagctgaggtcgaagaagccgtggggcctcgagtgaacggtctcgtgcaaggtcttcgtggttataccgttagactaattagtggtactacgaactgggtcgtccgactacggcccctaggaacctaacggtcccaggtgacggtggacgttgggactgggactcgagcgtactanaagtanacatacactncgacagagactacgngacacganccaacgtcgacacgtactactaacgactacgacgtacgacgaacgtacgaccgtaaacgngtacggagtcgtagggacggtacgcccgtaaggacgtaacgtccgtacgggaaccgttaccgaccgggttaccttaggtttaacgcgtaggtacggtaacggtaacgtacgaagttaagttacgttagtaacgcggtacgttaacggccgggtaccgtaaccgggg

SEQ ID NO: 67986 - DNA, 596 bp, Homo sapiens
  misc_feature: GYAE6OF02HZGMZ.37.37.D04.1.454.CMB.1.raw
  modified_base (468)..(468): a, c, t, g, unknown or other
  misc_feature (468)..(468): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctctgcaaggcttctggttatacctttagctaattatggtatcaacgtgggtgcgacgacggcccctggacaaggccagtgagtggagtgggatggatcaggcgcttaacaataactaacacacactatgacacaaggtaagttccgaagggccaaggacgtccaacccgtgaaccacaagactaacactaccacgacacaacacgacctaacagtagggacgccgtagggacgggaacnccgtagaacggacttcgtacggaaccgtaccggaccggtccgtttagttttacgcggttgaccggtaagacgtacgaagtaacttagttagttaagtcggtaacgtacggtcgggggacctaacgggg

SEQ ID NO: 67987 - DNA, 256 bp, Homo sapiens; identical to SEQ ID NO: 67907
  misc_feature: GYAE6OF02IU7JW.37.37.D04.1.454.CMB.1.raw
  modified_base (247)..(256): a, c, t, g, unknown or other
  misc_feature (247)..(256): n is a, c, g, or t

SEQ ID NO: 67988 - DNA, 620 bp, Homo sapiens
  misc_feature: GYAE6OF02H0KOF.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgccccactctcaggttcagctggtgcagtctggagctgaggtgaagaagcctggggcctcagtgaaggtctcctgcaaggcttctggttatacctttagctaattatggtatcaacgttgggtgcgacacggcccctggaacaaggcccatgagtggagtggggatggatcaggcgacgttaacaataataaccacactactatgcaacagtaacgttccgaagggacaaggacgtaccaccccgtgaacccaacgacgtaactaaccatacccaacgacgccaaccgacgaccctaacagttacgggacgtacgtaggacgggacgaccgtagaggtactcgtggaaccgacgtaccggtccggtttagttttaccgtggtacggtacggaaggtacgttacgaagttaattagttttaggaagttcggtaacgttacggcggggtaccgtaacccgggg

SEQ ID NO: 67989 - DNA, 596 bp, Homo sapiens
  misc_feature: GYAE6OF02HO9QC.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaacgtgggtgcgacacggcccctggacaaggccaatgagtggatgggatgggatcagcgtacttacaaataataacacacactatgctaacagaacgttccgagggcaaggacgtaccacccgtgaccacagactaacactaccaacgacgcaacagaccttaacagtggaacgctaggaggacgcccgtagaacgactcgtacggaaccgaccggacggtccggtttagtttaccgtgggtacgtaccggaagtaacggtaaccgaagtaagttagtttaggtaacgttaggaccgttaacggcgggggtaacctaacccggggg

SEQ ID NO: 67990 - DNA, 130 bp, Homo sapiens; identical to SEQ ID NO: 67457
  misc_feature: GYAE6OF02FVTOX.37.37.D04.1.454.CMB.1.raw
  modified_base (130)..(130): a, c, t, g, unknown or other
  misc_feature (130)..(130): n is a, c, g, or t

SEQ ID NO: 67991 - DNA, 266 bp, Homo sapiens
  misc_feature: GYAE6OF02IMESA.37.37.D04.1.454.CMB.1.raw
  modified_base (247)..(266): a, c, t, g, unknown or other
  misc_feature (247)..(266): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggccaccctcctccaagagcacctctgggggcacagcggccctgggctgcctggtcaaggactacttccatctacactactgagcggctggcaaggcgcatagnnnnnnnnnnnnnnnnnnnn

SEQ ID NO: 67992 - DNA, 501 bp, Homo sapiens
  misc_feature: GYAE6OF02FSOMO.37.37.D04.1.454.CMB.1.raw
  modified_base (352)..(352): a, c, t, g, unknown or other
  misc_feature (352)..(352): n is a, c, g, or t
  modified_base (456)..(456): a, c, t, g, unknown or other
  misc_feature (456)..(456): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcanagaagttccagggcagagtcaccctgaccacagatacatccacgagcacagcctacatggagctgaggagcctgagatcgtgacgacacggtccgtgttttacngtgcgagagtacagaatagttgtaatggactacgtgggctacggg

SEQ ID NO: 67993 - DNA, 622 bp, Homo sapiens
  misc_feature: GYAE6OF02HYAW2.37.37.D04.1.454.CMB.1.raw
  modified_base (215)..(215): a, c, t, g, unknown or other
  misc_feature (215)..(215): n is a, c, g, or t
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (431)..(431): a, c, t, g, unknown or other
  misc_feature (431)..(431): n is a, c, g, or t
  modified_base (459)..(459): a, c, t, g, unknown or other
  misc_feature (459)..(459): n is a, c, g, or t
  modified_base (527)..(527): a, c, t, g, unknown or other
  misc_feature (527)..(527): n is a, c, g, or t
tcagtagtgtagatcacgaccggtgctcgatttagtagcatactgttgggtttggggacccaaaaccacaccctcctgggagaatccctagatcacagctcctcaccatggactggacctggagcattccttttcctggtggcagcagcaacaggtgcccactctcaggttcagctggtgcagtctggagctgaggtgaagaagccgtgggcctnagtgaaggtctctgcaaggcttcgtgttatacctttagcaattatgtaatcaagttgggcngacacggccctggaacaaggccatgagtgagtggatggactnagcgtacttaacaataaataacaacacaaacttangaccaanaaggtaaacttcccgaagggacaggtactaccgaaccctagaaccaacagaaacctacaacctcaacgganacctaacgagtaccctaagatgggaacncgtaggaagggacgttaccagagaacttgacgaaacgacggtaaccggtaccgtttagttttaaccgngggttacggaaccggaaggtaagttaaccgaaggttaaattagttacgttaaagtacggaaccgttacgggttacgggaccggtaaacccggggg

SEQ ID NO: 67994 - DNA, 634 bp, Homo sapiens
  misc_feature: GYAE6OF02JWDSM.37.37.D04.1.454.CMB.1.raw
  modified_base (368)..(368): a, c, t, g, unknown or other
  misc_feature (368)..(368): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatacaacgtgggtgcgacgaggccctggacaggccagtgagtggagtgggatggatcgagcgtcttaacgaattaaactaacacactactatgaccgaanaagaagttccgagggacaaggacgtccacccgtaggaccctaagacgaacttaaccaactacccgaacgacgtacccaacgacgtaccctaagacgttacggaacgtacgtcggaaagggtaccgaccgtaggaccgtaatccgtaacgaccggtaccgtaaccggtccgtttagttttccgagtccggaacggtacggtaacgtaagaacgttaagttagttaggttaactacggtaacgtacggtaccggggccgtaaaccggg

SEQ ID NO: 67995 - DNA, 740 bp, Homo sapiens
  misc_feature: GYAE6OF02J0CDV.37.37.D04.1.454.CMB.1.raw
tcagtagtgtagatcacgaccggtgctcgatttagtagcatactgttgggtttggggacccgaaaaccacacccctccttgggagaatcccctagatcacagctcctcaccatggactggacctggagcatccttttcctggtggcagcagcaacaggtgcccactctcaggttcagctggtgcagtctggagctgaggtgaagagctggggcctcagtgaggtctctgcaaggcttctggttactacctttagctaattactgggttatacctaacgtggggttcgaccggtaccgagggtccccccttagggaaccaacgggtcccaacggttagacgggtggaagttggggaattgggaattcgaaggtcggtacctttaacgaaaagttaactaaacgaccgtaaccacgttatacggacaacgtaaaggtaacggttaccagggggtaccaaggacggtaccaacccgtagaacccacgaagaactaaccgactccaaccggacgtaccgaacaagtcccgtaaatacgggtacggaacgacgtaggaacgggtaccggtacgacgggtaacgtagtaccggttaccggaaacggtacccgtaccgggtacccgttttaggtttaaccgtagggtacggtaccgaaggtaaccggttaacgaaagttaacgttagtttaacggttaacttacgggtaaccgttaaccgggtaccgggggtaccgtaaacccgggg

SEQ ID NO: 67996 - DNA, 613 bp, Homo sapiens
  misc_feature: GYAE6OF02IFGDZ.37.37.D04.1.454.CMB.1.raw
  modified_base (280)..(280): a, c, t, g, unknown or other
  misc_feature (280)..(280): n is a, c, g, or t
  modified_base (356)..(356): a, c, t, g, unknown or other
  misc_feature (356)..(356): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtncgacaggcccctggacaaggccatgagtggatgggatggatcagcgtcttaacaataataaacacacactatgcanagaagttcgagggcagacgtcacccgtacgaccacacgatacactcaacgagacacacgacctacataggacgcgtaggaggacgccgtagacgtagttaccgtggaaccgaaccgtacgggtccgttttaggtttttaacgcggttaggtaccggaaggtaacggttaaccgaaggttaaaagttacgttttaacggttaaacgttaccggggtaaacctttaacggggttacgggggacccgtaaacccgggggg

SEQ ID NO: 67997 - DNA, 578 bp, Homo sapiens
  misc_feature: GYAE6OF02I9H9L.37.37.D04.1.454.CMB.1.raw
  modified_base (414)..(414): a, c, t, g, unknown or other
  misc_feature (414)..(414): n is a, c, g, or t
  modified_base (438)..(438): a, c, t, g, unknown or other
  misc_feature (438)..(438): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctctgcaaggcttctggttatacctttagcaattatggtatcaactgggtgcgacaggcccctggacaaggccatgagtggagtgggatggatcgagcgcttaacaataataacgacacactatgacacgagaacgttccgaaggcagagtccaccctgaaccacgagactaacacgtccaacgganaccaacgacacctacagtaggacncgtaggaaggacgccctagaaggcttacgtacggaccgaaccggacccggtccgtttagtttaccgtgtacgacggaagtaacgtaacgaagtaacttaagtttaggacttaggaactacggtcggggaccctaaccggg

SEQ ID NO: 67998 - DNA, 617 bp, Homo sapiens
  misc_feature: GYAE6OF02HB1I2.37.37.D04.1.454.CMB.1.raw
  modified_base (448)..(448): a, c, t, g, unknown or other
  misc_feature (448)..(448): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacgtgggtgcgacaggcccctggacaaggccatgagtggatgggatggatcagcgtacttaacaaataataacaacacaactatgacacgagtaacgttaccgaggggacaaggacgtaccaaccctagaacccaacaagtaacaacactaccaacgacgacaaccagaccctaanatagggacgccgtaggagggacgtccgtaggacgtatcgtacggaaccgtacgtaaccgggtccgtttagttttaccgtggttacggacggaaggtaacgtaacgtaaggtaaattagtttacggttaagtacggtaaccgttaacgggtacggggacccgtaacgggg

SEQ ID NO: 67999 - DNA, 259 bp, Homo sapiens
  misc_feature: GYAE6OF02G0KBN.37.37.D04.1.454.CMB.1.raw
  modified_base (247)..(259): a, c, t, g, unknown or other
  misc_feature (247)..(259): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnnnnnnn

SEQ ID NO: 68000 - DNA, 576 bp, Homo sapiens
  misc_feature: GYAE6OF02F651F.37.37.D04.1.454.CMB.1.raw
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (400)..(400): a, c, t, g, unknown or other
  misc_feature (400)..(400): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatgggatcagcgcttacaatatgacanacatatgcanagaagttcagggcagacgtcaccctgaccaacagatacatccgaacganccaacacgaccctacacgtgggaacgctaggaagggacgtaccgtcggaagtattccgtaggtaaccgaaccgtaccgggtccgtttaggtttttaccgnggttacggngaacggtacgtaacgaagtaagttactttaggttaaagtacgggtacgttacggtggggtaacccgg

SEQ ID NO: 68001 - DNA, 614 bp, Homo sapiens
  misc_feature: GYAE6OF02FWOL6.37.37.D04.1.454.CMB.1.raw
  modified_base (362)..(362): a, c, t, g, unknown or other
  misc_feature (362)..(362): n is a, c, g, or t
  modified_base (433)..(433): a, c, t, g, unknown or other
  misc_feature (433)..(433): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacacggcccctggacaaggccatggagtggagtggggatggatcgagcgtcttaacgaataactaacacacactatgacanagaagttccaggggcagagtccaccgtgaccacagatacatccacgagcaacacgacctacagtcgggacncgtggaacgggacgccgtaggaagtaactccgtaacggaaccggtaaccgtaaaccgggttcccggtttaggtttttaccgtgggttacggacggtaaggtaacggttaacgtaaggtaatttaggtttacggttaaggttacggtaacgttacgggtacgggggtaccctaacccggggg

SEQ ID NO: 68002 - DNA, 582 bp, Homo sapiens
  misc_feature: GYAE6OF02HQRPH.37.37.D04.1.454.CMB.1.raw
  modified_base (509)..(509): a, c, t, g, unknown or other
  misc_feature (509)..(509): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtcttggagctgaggtgaagaagcctggggcctcagtgaaggtctcctgcaaggcttctggttatacctttagcaattatggtatcaacgtgggtgcgacaggcccctggacaaggccatgagtggatgggatggatcgagcgcttacaataataacacacactatgcaacagaacgttccgagggcaaggacgtacacccgtagaccacaagaactacactaccaacgacgacaacagacctaacagtaggacgacgtaggacgggtagcccgttaggaacgtagtccgtacgaaccgtaccgacggtccgttagttttacgngtcgacggtaagacgtaacaaggtaattagttagtaacgtggtaaccgttacgtacggggaccgtaaccgggg

SEQ ID NO: 68003 - DNA, 515 bp, Homo sapiens
  misc_feature: GYAE6OF02G0RFA.37.37.D04.1.454.CMB.1.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgacccacagactacatccaacgagcacagccttanatgganctagagagcctgagatctgaccgacgaccggccgttagttttactggtgcggtagagtacaagaatattagtactggactacgtcgggctaacgggg

SEQ ID NO: 68004 - DNA, 641 bp, Homo sapiens
  misc_feature: GYAE6OF02G2L8X.37.37.D04.1.454.CMB.1.raw
  modified_base (283)..(283): a, c, t, g, unknown or other
  misc_feature (283)..(283): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcganacggcccctggacaaggccatgagtggagtgggatggatcgagcgtcttaacgaaattaaagtaacacgtaacaccttaatgaccaacgaaggtaaacgttccgaaggggtacagtacgtccaaccctgaaccacgagaactacactaccgacgacgaccacgacgtacctaactagtacgggacgacgtacggaagggtaacgcccgtaaggaacgtacttaccgtaccggaaccgaaccggtaccgggtccgtttacggtttaacgttcgtacggacggtaaggtaacgtaacgaaaggtaatttaacgttaagttaagtacggtaacgtaacgggtacgggtaccgtaaccgggg

SEQ ID NO: 68005 - DNA, 601 bp, Homo sapiens
  misc_feature: GYAE6OF02IOA5U.37.37.D04.1.454.CMB.1.raw
  modified_base (204)..(204): a, c, t, g, unknown or other
  misc_feature (204)..(204): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgaggggaaagngccaccctctcctgcagggccagtcagagtgttagcagcaacttagcctggtaccagcaacgaaacctggaccaggcctcccgaggtcctcctacatctatggtcgcactccacgagggcctacgtcggtactcccgagccgtaggttcaggtcggcgtaggtcgggtcgacgggacaggtacgttccactctacacctatacgagcacgcctgactacgtctaggaagttatttaggctttaacgttttattcgtagtacacgtactaagtttaacttaattacgtcgtcccttacgttacgggtacggtaccggttacgaccgtaagggtaaccgtaagggtaacgaaacgtacgaaaacgtacgtgtacggtactacggaccaacgtatctacg

SEQ ID NO: 68006 - DNA, 250 bp, Homo sapiens
  misc_feature: GYAE6OF02I1WSB.37.37.D04.1.454.CMB.1.raw
  modified_base (238)..(250): a, c, t, g, unknown or other
  misc_feature (238)..(250): n is a, c, g, or t
tcagtagtgtagatcacgaccggtgctcgatttagtagcatactgttggtttgggtgtccaagctgctggaggcacggtcaccacgctgctgaggagtagagtcctgaggactgtaggacagcccatcggtcttcccctggcaccctcctccaagacgcacctctggggcacagcgcctggctgcctgtcaaggactacttccatctacactactgagcggctggcaaggcgcatagnnnnnnnnnnnnn

SEQ ID NO: 68007 - DNA, 711 bp, Homo sapiens
  misc_feature: GYAE6OF02H61GO.37.37.D04.1.454.CMB.1.raw
  modified_base (192)..(192): a, c, t, g, unknown or other
  misc_feature (192)..(192): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggngctgaggtgaagagccgtggggcctcgagtgaaggtctcctgcaaggcttcgtggttatacctttagctaatttagtggtatcaacgtgggtgcgacaggcccctggaacaaggccagtggagtggagtgggatgggatcgagcgtacttaacaagtaataacacactactatcgacaacgaaggtaacgttccgaagggcaaggtacgtccaaccctgaacccaacgaacgtaacttaacaacttaccgaacgacgaccaacacgaccctaacagtacgggactcgtaggaacgggtacgaccgtaggaacgtacgttccgtaacgggaaccgaaccggtaccgggttacccgttttaggtttttaaccgtcgggtttacggtaccgggtaaacggttaacggtttaaaccggtaaaggtttaaaacgtttaacggttttaacgggttaaacggttacggggttaaacccgttttaaccggggttaccggggggtaaccccggttaaaacccgggggg

SEQ ID NO: 68008 - DNA, 703 bp, Homo sapiens
  misc_feature: GYAE6OF02GA5YD.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttcgtggttatacctttagctaattatggtatcaacgggggggtgtgcgacaggcccctggacaaggccagtgagtggagtgggatggatcgagcgtacttaacaataataaccacaacactatcgacaacgagtaacgttccgaaggggtacaggtaacgtacccaacccgtagaacccctaacgaaacggtaacttaacccaacgttaccccgaaaacgggaacgaacccgaaaccgaaccggtacccctaaagaacgttacggggaacgttccgtacgggaacgggtacggtacccgttaggaacggtacttacggtacggtaaccgaacgtaccgggtaccgtttggttttaaccgtggtacggaccggtaaggtaacgttaacgaaggttaatttaacggttaacggttaaagtaccgggtaaccgtttaccgggtagggggaacccgtaaccggggg

SEQ ID NO: 68009 - DNA, 542 bp, Homo sapiens
  misc_feature: GYAE6OF02GC23V.37.37.D04.1.454.CMB.1.raw
  modified_base (338)..(338): a, c, t, g, unknown or other
  misc_feature (338)..(338): n is a, c, g, or t
  modified_base (482)..(482): a, c, t, g, unknown or other
  misc_feature (482)..(482): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatgggatcagcgacttacaataanaactacacactatgacacagaagttcagggcagagtcaccctagaccacagatacactaccacgagccaacgacgacctaacagtacggacgcgtagaggacgcctagagagtcacgacgacgacggtccgttagtttacgtgnggtacgagagtaacgagtaattagttagtataggtactacggtacgggacgtaaccgggg

SEQ ID NO: 68010 - DNA, 616 bp, Homo sapiens
  misc_feature: GYAE6OF02FTRY9.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacgtgggtgcgacaggtcccctggacaaggccagtgagtggatggggatgggatcagcgtcttaacaataaataacacacactatacgactaacagtaacgttcgagggcagacgtccaccctagaccaacagaatacactaccaacgacgaccaacgagcctaacgagtaggaagccgtggaacgggagtcccgtaggacgattcgacggaaccgtaccgaccgggtccggttttagttttacgtggttcggacggtaaggtaacggttaaccgagttaaacgttagtttacggttaaacgttacgggaacctttacgggtacggggtaccggtaaaccgggg

SEQ ID NO: 68011 - DNA, 685 bp, Homo sapiens
  misc_feature: GYAE6OF02GTE7B.37.37.D04.1.454.CMB.1.raw
  modified_base (283)..(283): a, c, t, g, unknown or other
  misc_feature (283)..(283): n is a, c, g, or t
  modified_base (341)..(341): a, c, t, g, unknown or other
  misc_feature (341)..(341): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtctggagctgaggtgaagaagcctggggcctcagtgaaggtctctgcaaggcttctggttatacctttagctaatttatggtatcaacgttgggtncgacgacggcccctggacaaggccagtgagtggagtgggatggatcgagcgacttaanaattaacaacacaacactaatgacacgaagtaacgttccgagggcagacggtccacccgtagaaccacgagaactaaccactacccgaacgacgaccaaccgacgtacctaacgacgttacggacggcgtacgggaagggaccgtcccgtagaacggtacttcggtaacggaaccggtaaccgtaccgggttcccggttttacggtttttaaccgtgggtaccggtacggggtaaacggttaacggttaaacccgtaaggttaaagtttacgtttaaggtttaaacggtaccgggttaaccgtttaacccggggttacgggggaacccgttaaaccccgggggg

SEQ ID NO: 68012 - DNA, 542 bp, Homo sapiens
  misc_feature: GYAE6OF02F5BCI.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctgggggcctcagtgaaggtctcctgcaaggcttctggttatacctttagcaattatggtatcaactgggtgcgacaggcccctgggcaaggccatgagtggatgggatggatcgagcgtctacaataataacacacactatgacacagtaacgttccgagggcagacgtccacctgaccacagatacatccacgagcacacgcctaacgatggagcgtggaagggcgacctaggagactgtgaaccgtacgacggtccgttgttttactggtagcgtaaggacgtacaagtaattagttagtaatggactacgggtcgggaccgtaaccgggg

SEQ ID NO: 68013 - DNA, 599 bp, Homo sapiens
  misc_feature: GYAE6OF02JYTTO.37.37.D04.1.454.CMB.1.raw
  modified_base (409)..(409): a, c, t, g, unknown or other
  misc_feature (409)..(409): n is a, c, g, or t
  modified_base (514)..(514): a, c, t, g, unknown or other
  misc_feature (514)..(514): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccagtgagtggatgggatggatcgaggcgtcttaacaataataacacacactatgacacagaacgttacagggcagacgtcacccgtgaccagagatacataccaacganaccacgacgacctacacgtacggacgtcgtaggaacgggacgtcccgtaggacgtacttccgtacggaaccgtaccgtaccgggttaccgtttacgttttaccgnggttcggacggtaaggtacgtaacgtaaggtaatttaagttagtaacggtggtaaccgtacgggtacggggtaccgtaaccgggg

SEQ ID NO: 68014 - DNA, 580 bp, Homo sapiens
  misc_feature: GYAE6OF02FNPN7.37.37.D04.1.454.CMB.1.raw
tcagtagtgtagatcacgaccggtgctcgatttagtagcatactgttgggtttgggggacccaaaaaccacacccctccttgggagaatcccctagatcacagctcctcaccatggactggacctggagcatcctttttcctggtggcagcagcaacaggtgcccactctcaggttcagctggtgcagtctggagctgaggtgaagaagcctgggggcctcagtgaaggtctcctgcaaggcttctggttataccttttagctaattatggtatcaactgggtgcgacaggccccctggacaaggccatgagtggatggggatggatcgagcgcttacaataataacacacactatgcacagaagtcagggcagagtcaccctgaccacagatacatccacgacgcacacgcctacagtggacgcgtaggaggacgccgtagacgattcgtaggaccgaccgaccggtccgtttacgtttttacgtggttcgacggtaaggtacggtaacgaagttaagttacgtttacggttaaacgttcgggtaaccgttaccggtacgggggtacccgtaaccgggg

SEQ ID NO: 68015 - DNA, 255 bp, Homo sapiens; identical to SEQ ID NO: 67891
  misc_feature: GYAE6OF02IY40M.37.37.D04.1.454.CMB.1.raw
  modified_base (247)..(255): a, c, t, g, unknown or other
  misc_feature (247)..(255): n is a, c, g, or t

SEQ ID NO: 68016 - DNA, 630 bp, Homo sapiens
  misc_feature: GYAE6OF02G4NQB.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctgggcctcagtgaaggtctcctgcaaggcttctggttatacctttagcaatttatggtatcaactgggtgcgacacggcccctggacaaggccatgagtggatgggatggatcagcgcttacaataataacacacactatgacacagtaacgtcagggacagacgtcaccctgaccacagatacataccacgagaccaacacgtcctaacgagtacggacgtacgtaggaacgggtacacccgttaggacgtaacgttccgtacggaaccgtaaccggaccgggttaccgtttacgggtttttaacctcgggttacgtaccggtaagggtaacggttaaaccgaaggtaaaccgtttaagtttacggtttaaacgttcgggtaaccgtttacgggttacgggggtacctaaacccgggggg

SEQ ID NO: 68017 - DNA, 594 bp, Homo sapiens
  misc_feature: GYAE6OF02IX3D8.37.37.D04.1.454.CMB.1.raw
  modified_base (362)..(362): a, c, t, g, unknown or other
  misc_feature (362)..(362): n is a, c, g, or t
  modified_base (438)..(438): a, c, t, g, unknown or other
  misc_feature (438)..(438): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacttgggtgcgacacggcccctggacaaggccagtgaggtggagtgggatggatcagcgtctaacaataataacaacacaactatgacanagtaagttccgaggcagacgtccacctagacccacgagaactaacactaccgaacgacgaccaacacgaccctaanagtacggacgcgtaggacggacgtcctagagtactcgtacgaaccgaacgtacggtaccgtttagtttacgtgtacggacggaaggtaacgtaacgaagtaaactttgttaacgttaacgtggtaacgtaacgggttacgggaccgtaacccgggg

SEQ ID NO: 68018 - DNA, 582 bp, Homo sapiens
  misc_feature: GYAE6OF02F58ZX.37.37.D04.1.454.CMB.1.raw
  modified_base (281)..(281): a, c, t, g, unknown or other
  misc_feature (281)..(281): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttactacctttagctaattatggtatcaactgggtncgacacggcccctggacaaggccatggaggtggagtgggatgggatcgagcgtacttaacaataataacacaacactatgacaacagaacgttccgaagggcaggacgtccacccgtagaaccacagatacactacccgagacacacacgcctacagtggacgctggaggcgcctagagatcgtagaccgacgaccggtcgtttacgtttacgtggtcggacggaaggtaacgtaacgtaagtaactttagttacggttaagtacggtaacgttacgggtacggggacccgtaacccgggg

SEQ ID NO: 68019 - DNA, 611 bp, Homo sapiens
  misc_feature: GYAE6OF02HRGUU.37.37.D04.1.454.CMB.1.raw
  modified_base (536)..(536): a, c, t, g, unknown or other
  misc_feature (536)..(536): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctctgcaaggcttcgtggttatacctttagctaattatggtatcaacgtgggtgcgacacggcccctaggacaaggccagtgagtggagtgggatggatcgagcgtactaagaataataaacacactactagtgacaacaagtaacgttccgaagggcaaggtacgtaccacccgtagaacccagtaacgtaactacctaactacccgaaacgacgaccaaacgacgaccctaacgtacgtagggacgacgtaggaacggtcgtaccgtagacgactcgacgacgtaccgacggtcgttagtttacnggtcgtacggaagtacgtacgaagttaacgttagttacgtagtccggtaacgtacggtccgggaaccgtaacggg

SEQ ID NO: 68020 - DNA, 589 bp, Homo sapiens
  misc_feature: GYAE6OF02G7OQ1.37.37.D04.1.454.CMB.1.raw
  modified_base (343)..(343): a, c, t, g, unknown or other
  misc_feature (343)..(343): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacgtgggtgcgacacggcccctggacaaggccagtgaggtggagtgggatggatcgagcgtctacaataanacacacactatgacacgagaacgtcagggtcagacgtccaccgtcgaccacagatacactacccaacgacgacaacgacgaccctaacacgtaggacgctaggaaggacgccgtaggagtacgtcgtacgaaccgaaccggtaccggtccgtttagttttaccgtggtacgacggtaaggtacgtaacgaagtaatttagttaggttaacgtggtaacgtaccgggtacgggtaccgtaacccggg

SEQ ID NO: 68021 - DNA, 693 bp, Homo sapiens
  misc_feature: GYAE6OF02I8JX9.37.37.D04.1.454.CMB.1.raw
  modified_base (116)..(116): a, c, t, g, unknown or other
  misc_feature (116)..(116): n is a, c, g, or t
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (388)..(388): a, c, t, g, unknown or other
  misc_feature (388)..(388): n is a, c, g, or t
tcagtagtgtagatcacgaccggtgctcgatttagtagcatactgttgggtttgggggaaggaactcgctcgagttaggacccagacggaaccatggaagccccagcgcagcttcncttcctcctgttactcttggctcccagataccactggagaaatgtgatgacgcagtctccagccacctgtctgtgtctccgaggggaaangccgacctctcctgcagggccagtcagngtgtacgcagctaacttgcctggtaccagacagaacctggacctaggcctcccgaggtcctcccgtacattcctagtcgggtgcgtacgtccacggacgggtcctacgtgggtactcccgagccctaggttccagtcggactagggtgggtcgngggaactggtacgtttccacgttccgtaccaaccgtacgtcaacggccacggtccgttcgactacggtacctaggtaaacgttcgttttacggctttaagggttttaactttccgttaggtaccctaggtacctaaggtttaacttaacgtttacgtccgggttacccttccgttaacgggttcgggttaaccgttccgggtaacccgtaagggtaccgtaagggttaccggtaaaggttaacccgtaaacggtaaccgttgggtaccgtacgtaccgtacctacgtagttccgttcggttaccg

SEQ ID NO: 68022 - DNA, 586 bp, Homo sapiens
  misc_feature: GYAE6OF02JHX1X.37.37.D04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (237)..(237): a, c, t, g, unknown or other
  misc_feature (237)..(237): n is a, c, g, or t
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
tcagtagtgtagatcacgaccggtgctcgatttagtagcatactgttgggtttggggaggaactgctcagttaggacccagacggaaccatggaagccccagcgcagcttctcttcctcctgctactctggctcccagataccactggagaaatagtgatgacgcagtctccagccacctgtctgtgtctccgaggggaaancgccaccctntcctgcgaggccagtcagagtgtancagctaatcgctggtaccagcaacgaacctggccaggccnccgagctccctnctactagtggtcacactccgaaccgaggcctagtgtacctccgacgtcagttcagtcggacnggttcggcgtcggacnggtacttccactntccgactncgtagcagcctacgacgtgtagaattcgttcgagttactttacttcgtcgttacagactaacgttattaacttctacggtccttacgtacgtcggtacgttccgacgaacgggtactaacgggtacgtaaacctaacggtaaacgtagttccggttaagcccggttaacaccgtaccgtacgttcgttaacgttcccg

SEQ ID NO: 68023 - DNA, 251 bp, Homo sapiens
  misc_feature: GYAE6OF02H243E.37.37.D04.1.454.CMB.1.raw
  modified_base (246)..(251): a, c, t, g, unknown or other
  misc_feature (246)..(251): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttcccctggcaccctcctccaagagcacctctgggggcacagcggccctgggctgcctggtcaaggactacttccatctacactactgagcgggctggcaaggcgcatagnnnnnn

SEQ ID NO: 68024 - DNA, 617 bp, Homo sapiens
  misc_feature: GYAE6OF02I9KGG.37.37.D04.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgtagcagcaacttgcctggtaccagcagaaacctggccaggctcccaggcctcctcatctagtggtncactccaccgagggcccacgtcggtactccccgtagtctaggttcaggtcggctaggtggggtctggggaactaggtacgtttcacgttcctaccactatcacgcagccgttgcgtagtctaggtaagttcgttttgactttagttttactttctagtcctagctaacgtactaagtgtaacgtcggtcctttccgtaccgttaccggtttacgggacggggtaacggggtaccgtaaggggttacgggaacgtaacgtaaccggtaaaaccggtacggttacggtcggtaccgtacgacccgtacctagttaccgg

SEQ ID NO: 68025 - DNA, 611 bp, Homo sapiens
  misc_feature: GYAE6OF02JZF30.37.37.D04.1.454.CMB.1.raw
  modified_base (426)..(426): a, c, t, g, unknown or other
  misc_feature (426)..(426): n is a, c, g, or t
tcagtagtgtagatcacgaccggtgctcgatttagtagcatactgttgggtttggggacccaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggagtgggatggatcgagcgtctacaataataacacacactatgacacagaagttccaaggcagacgtcacctgaccacagatacatccaacgagaccacacgcctaacagtcgggaacngtaggaacggacgcccgtaggaagtacgttaccaggtaccgaaccggtaccggtacccgttagtttttaacccgtcggttacggaccggtaaggtaaccggttaactaaacggtaacgtttaacgtttaggttaaaacgtggtaaacccgtttacgggttaccggggaaccctaaacccgggggg

SEQ ID NO: 68026 - DNA, 256 bp, Homo sapiens; identical to SEQ ID NO: 67907
  misc_feature: GYAE6OF02IJ6ZB.37.37.D04.1.454.CMB.1.raw
  modified_base (247)..(256): a, c, t, g, unknown or other
  misc_feature (247)..(256): n is a, c, g, or t

SEQ ID NO: 68027 - DNA, 631 bp, Homo sapiens
  misc_feature: GYAE6OF02GVZL7.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggttatacctttagcaattatggtatcaacgtgggtgacgacacggtccccgtggacaaggccagtgaggtggagtgggatggatcgagcgtacttaacaataaactaacaacacactatgacaacgacgtaagttccgaagggcagacgtccacccgtagaaccaacgagtaactaccaacgtaccgaacgacaccaaccgacgaccctaacacgtaggagtcgtacggagggtacgccgtaggacgacgtcgtacgaaccgtaaccgtaccgggttccgtttacggtttacgtaggtcggtacggaagtaacggtaacgtaagttaagttagttacggtaaggttacggtaaccgtttacgggtccgggtaacggtaacccggg

SEQ ID NO: 68028 - DNA, 695 bp, Homo sapiens
  misc_feature: GYAE6OF02GE9TA.37.37.D04.1.454.CMB.1.raw
  modified_base (271)..(271): a, c, t, g, unknown or other
  misc_feature (271)..(271): n is a, c, g, or t
tcagtagtgtagatcacgaccggtgctcgatttagtagcatactgttgggtttgggggacccaaaaaccgacacccgtccttgggagaatcccctagatcacagctcctcaccatggactggaccgtggagcatccttttcctggtcggcagcagcgaacaggtgcccacgtctcaggttcagctggtgcagtctggagctgaggtgaagaagcctggggcctcagtgaaggtctcctgcaaggcttcgtggttatacgttagctaaattntggtatcaagtgggtagacgtacgaggcccctaggaccaaggccagtagtagtggagtgggatagggatcgaggcgtacttaacgaaattaactaactacaacgtaacttacgtacgacgtaactaaggtaaacgttccggaagggtacctaacggacgttaccctaacccgttagaacccgtaacgaacgaactaaccggtactacccgaaacggtacgtacctaacgtacggtacctaacgaagttcggaacgtcgtagaacggtacgccgtagacgtatacgacgaacgtacgtaccgggttaccgtttacggtttacgtggtacgaacgggtaacggtaacgttaacgtaaggttaaacttaggtttaacggtaagttaccggtaacctaccgggttcggggaaccgttaaccccggggg

SEQ ID NO: 68029 - DNA, 567 bp, Homo sapiens
  misc_feature: GYAE6OF02HZPXO.37.37.D04.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (259)..(259): a, c, t, g, unknown or other
  misc_feature (259)..(259): n is a, c, g, or t
  modified_base (284)..(285): a, c, t, g, unknown or other
  misc_feature (284)..(285): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctcagccacctgtctgtgtctccgaggggaaancgccacccgtntccngcagggccagtcagagtgtagcagcaacttagcctggtaccngcagaactgccaggctccagctccnntctagtgtncnctccacgaggccatggtacnccagcctaggtcagtgnaggtcgcgtaggacagngttcagttcncaaccngtcagcagcctagcgatcgtagtagtatttgacgttagtttattcgttagtcagtcttaagttattaacgtttacgcggttacccttaccgtacgttgggtaaccgttccggacgtaaccgggtcgtaacgggtaacggtaactacggtaaacggtactcggttacggactaccggaacccgtactaccgttcgttaccgg

SEQ ID NO: 68030 - DNA, 711 bp, Homo sapiens
  misc_feature: GYAE6OF02H18E2.37.37.D04.1.454.CMB.1.raw
  modified_base (201)..(201): a, c, t, g, unknown or other
  misc_feature (201)..(201): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagataccactggagaaatagtgatgacgcagtctccagccacctgtctttgtctccgaggganagacgccaccctctcctgcgagggccagtcagatgttagcagtcacttagccgtaggtaaccaacgagacgacctggccacggcccccaggcctcctcactcgtatgcctgccttaccctcgacgggcccagtcggccacgtaccccagccgtaggttcgaacgttcggacagggtcgggtctaggtaacgacgtaacgtacttcgaccttactcccaacctactaccgtacgaccgtaacgttacgtaacggagtacccgtaggtaaacgttacgtttttagacctttaaaccttttaacttactttacgttcgtaacctaaaccgtacgtaccgtacctaacccgtaccggtacgggttaccgggttacccgttaccggtaaccggaaacggggtaaccgtaacggggttaccggttaacgttttaaccggttaacccggtaacgtacgggtttacggtaccttacggaccctaaccgtacccgttacgttacgttacccgtttaccg

SEQ ID NO: 68031 - DNA, 590 bp, Homo sapiens
  misc_feature: GYAE6OF02FPHWF.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggtatacctttagcaattatggtatcaacgtgggtgcgacaggcccctggacaaggccagtgagtggatgggatggatcgagcgacttacaaataataacacaacactatgacacgagtaacgttaccagggcagagtccaccctgaccacgagaactacactccaacgacgcaaccacgaccctaacagtagggacgcgtaggaacgggacgccgtaggagtactcgtacggaacgaacgaccggttaccgtttagttttaccgtgtacggacggtaggtaacggtaacaaggtaacttagttacggtaagttaggaacgttacggtacggggaccgtaaccgggg

SEQ ID NO: 68032 - DNA, 604 bp, Homo sapiens
  misc_feature: GYAE6OF02FO129.37.37.D04.1.454.CMB.1.raw
  modified_base (464)..(464): a, c, t, g, unknown or other
  misc_feature (464)..(464): n is a, c, g, or t
  modified_base (596)..(596): a, c, t, g, unknown or other
  misc_feature (596)..(596): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtccgtgtctccaggggaagagccaccctctcctgcagggccagtcagagtgttagcagcaacttagcctggtaccagcagaaacctggccaggctcccaggcctcctcatctatggtgcactccaccgagggcccactggtactcccagccaggttcaggtcggcaggtcgggtctacgggactaggagttccacgtctaccgacctatccagcacgcctgacgtagtcgtagaagttacgttttgacttaactttatttacgtgtacagtacagtttaanaacttaaccgtcgggtaccccggtagtttaccggaaccgaaacgggtaccgaaacggggtcgaaacgtaccgaaacggtacgtacggttacggacgttgaacccgtacgacttcgttacgtttccgtacgtnttccccgg

SEQ ID NO: 68033 - DNA, 253 bp, Homo sapiens; identical to SEQ ID NO: 67478
  misc_feature: GYAE6OF02IGBA1.37.37.D04.1.454.CMB.1.raw
  modified_base (247)..(253): a, c, t, g, unknown or other
  misc_feature (247)..(253): n is a, c, g, or t

SEQ ID NO: 68034 - DNA, 250 bp, Homo sapiens; identical to SEQ ID NO: 67462
  misc_feature: GYAE6OF02HYDH7.37.37.D04.1.454.CMB.1.raw
  modified_base (247)..(250): a, c, t, g, unknown or other
  misc_feature (247)..(250): n is a, c, g, or t

SEQ ID NO: 68035 - DNA, 592 bp, Homo sapiens
  misc_feature: GYAE6OF02FVDQR.37.37.D04.1.454.CMB.1.raw
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggcccctggacaaggccatgagtggatgggatggatcgagcgtacttacaattaataacacaacactatcgacacgagtaacgttccagggcaggacgtccacctgaccanagactacactaccacganacacacgacctacagtacggacgcgtaggaacggacgtccgtaggagtacgtcgtacggaaccgacgtaaccggtcggttacgttttacgtggtacggaccggtaagacggtaacgaacgtaagtttaacgttaggtaacgtacgggtaacttaccggtacggggacctaaaccgggg

SEQ ID NO: 68036 - DNA, 649 bp, Homo sapiens
  misc_feature: GYAE6OF02IEVVL.37.37.D04.1.454.CMB.1.raw
  modified_base (264)..(264): a, c, t, g, unknown or other
  misc_feature (264)..(264): n is a, c, g, or t
  modified_base (370)..(370): a, c, t, g, unknown or other
  misc_feature (370)..(370): n is a, c, g, or t
  modified_base (557)..(557): a, c, t, g, unknown or other
  misc_feature (557)..(557): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaatttntaggtatcaaacgttgggtgcgacacggcccctggacaaggcccagtggagtggagtgggagtgggattcgaggcgtcttaacaagtaaactaacaacacactaancgcaacagaaacgttcgaagggacaagacgtccaacccgtgaacccaccgaagaatacaacttacccgacgaacgaccaacctaacggcctaacgtagtacgggaacgtcgttagaagggtacgccgttaaggagtaacgtacgttacgaaccgtaaccgtaccggtcccggtttagtttttaccgngttacggtcggtaagtaaccggttaacgaagtaacgtttaagtttaggtaaagttcgggaacttaccgggtacggggtaccgtaacccgggg

SEQ ID NO: 68037 - DNA, 582 bp, Homo sapiens
  misc_feature: GYAE6OF02GAE20.37.37.D04.1.454.CMB.1.raw
  modified_base (285)..(285): a, c, t, g, unknown or other
  misc_feature (285)..(285): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacnggcccctggacaaggccatgagtggatgggatggatcgagcgcttacaataactaacacactactatcgacacaagtaacgttccgagggcagacgtaccacccgtgaaccacaagactaacatcccgaacgagaccaaccgacgacctaacagtacggagcgtaggaggacgccgtagagtatcgtacgaaccgaccgaccggtcgttcgttttacgcgcggtacggaaggtaacgtaacaagtaacgttagttacgtaaggttacggtaacgtacggtacgggaccgtaaccggg

SEQ ID NO: 68038 - DNA, 599 bp, Homo sapiens
  misc_feature: GYAE6OF02GHSKQ.37.37.D04.1.454.CMB.1.raw
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
  modified_base (452)..(452): a, c, t, g, unknown or other
  misc_feature (452)..(452): n is a, c, g, or t
  modified_base (518)..(518): a, c, t, g, unknown or other
  misc_feature (518)..(518): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctctgcaaggcttcgtggttatactttagctaattagtggtatctaacgtgggtgcgacacggcccgtggaacaacgggccagtggaggtggagtagggatggatcaggcgtacttaanaaataactaaacacacactangacacgaagaacgttccgaggcaggactccaccgtacgaccaanagatacactccaagacacacacgacctaacgagtaggacncgtaggaggacgacgtaggagtactacggtacgaccgaacgtacccgggtccgtttagttttacgnggttcgaacggtaagaataacgtaagtaacttagttaacggtaaggtacggtaaccgtcgggtacggggaccgtaaccggg

SEQ ID NO: 68039 - DNA, 661 bp, Homo sapiens
  misc_feature: GYAE6OF02JPU6H.37.37.D04.1.454.CMB.1.raw
  modified_base (266)..(266): a, c, t, g, unknown or other
  misc_feature (266)..(266): n is a, c, g, or t
  modified_base (345)..(345): a, c, t, g, unknown or other
  misc_feature (345)..(345): n is a, c, g, or t
  modified_base (477)..(477): a, c, t, g, unknown or other
  misc_feature (477)..(477): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtcgtcctgcaaggcttctggttactactttagctaattntggtatcaagtgggtgcgacgacggccccgtggacacggccagtggagtggtagtgggagtggatcgagtcgacttaanaaataagtaaacacgaacactatcgacagaacgtaacgttaccgagggtacgaagtacgttaccaacccgtacgaaccaacgagtaactaaccactaccaacgacgaccaacgacgcctaacaggtacgganccgtaggaccggacgcctaggaactacgttcgacggaacccgacggtaccggtaccgttttcggtttaaccgtggtaggtaaccggtaagggtaactaacggtaaacggttaaagtttaggtttaacggttaacgtacgggttaaaccgttaccggggttacggggaacccgttaacccggggg

SEQ ID NO: 68040 - DNA, 636 bp, Homo sapiens
  misc_feature: GYAE6OF02FSQED.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttactacctttagctaattatggtatcaacgtgggtgcgacacggcccctggacaaggccatggagtggagtgggatggatcgagcgacttaacaataactaacacacactatgacacagtaagttccgaagggcaggagtaccacccgtagaccaacagataaccatacccaacgacgaccaacgacgtacctaacgaagtcggacgtcgtaggacgggacgtcccgtaggacgtagttcgtacgaaccgaccgtaccgggttccgtttacggttttaccgtgggtacggtacggtaaaggtaaccggtaacgtaaggttaagtttaagttaacggttaaggttacgggtaaccgttacgggtaccgggggtaccctaaaccccgggggg

SEQ ID NO: 68041 - DNA, 246 bp, Homo sapiens; identical to SEQ ID NO: 67894
  misc_feature: GYAE6OF02F50PV.37.37.D04.1.454.CMB.1.raw

SEQ ID NO: 68042 - DNA, 620 bp, Homo sapiens
  misc_feature: GYAE6OF02HTQ7U.37.37.D04.1.454.CMB.1.raw
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcgagcgtcttaacaataataacacacactatgcanagagttcaggcagatcaccctnaccacagatacactaccgaacgacgacacgacgacctaacagtacggagacgtaggaacgggacgacccgtaggacgacgttaccgtacggacgtaaccggaccggttccggttacgtttttaacgtcggttacggtccggtaaaggtaacggttaaacgaacggttaaagtttaaggttttacggttaagttaaccgggttaaccgttaaccgggttacgggggtacccgtaaacccggggg

SEQ ID NO: 68043 - DNA, 641 bp, Homo sapiens
  misc_feature: GYAE6OF02HX2C5.37.37.D04.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcaagaacctggccaggctcccgaggctcctacatctatggtnccatccacgaggccagtgtacncccagcctaggttcagtgcnggtggtctgggactagtattccgactctacacccatacagcacgtcctagctagtctagtaagttacttttgacgtttaagttttatttccgttcgttacgaggtacttaaacgttaatttaaacgtttacgtaccgggttacccctttaccgggttaaccgggttaggtacccgggtttaccgggtaacccgaaacggggttacccgtaaaggggtaacggttaaactaaccggaaaaccgttacgttaacgggttcggaccttacggaccctaacgtaccgttacgttacccgg

SEQ ID NO: 68044 - DNA, 251 bp, Homo sapiens; identical to SEQ ID NO: 67542
  misc_feature: GYAE6OF02G5ULL.37.37.D04.1.454.CMB.1.raw
  modified_base (247)..(251): a, c, t, g, unknown or other
  misc_feature (247)..(251): n is a, c, g, or t

SEQ ID NO: 68045 - DNA, 634 bp, Homo sapiens
  misc_feature: GYAE6OF02HEO9S.37.37.D04.1.454.CMB.1.raw
  modified_base (279)..(279): a, c, t, g, unknown or other
  misc_feature (279)..(279): n is a, c, g, or t
  modified_base (360)..(360): a, c, t, g, unknown or other
  misc_feature (360)..(360): n is a, c, g, or t
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtncgacaggcccctggacaaggccatgagtggatgggatgggatcgagcgtacttaacaaataataacacaacactatgacanagaagttcgagggcaggacgtcaccctgacccanagatacataccacgacncacacgcctacagtgganctaggacggacgccgtagacgtagtccgttaggaaccgtaaccgaccgggttaccgtttagtttttaaccgtgggttacggtaccggtaacgggttaaacggttaaacgtaaaggttaaacgtttaaggttttaacggttaaaacggttacggggtaaaccgtttaaccggggttaccggggggtaacccggtaaacccgggggg

SEQ ID NO: 68046 - DNA, 576 bp, Homo sapiens
  misc_feature: GYAE6OF02GW2HU.37.37.D04.1.454.CMB.1.raw
  modified_base (568)..(568): a, c, t, g, unknown or other
  misc_feature (568)..(568): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaaacctggccaggctcccgaggcctcctcatctatggtgcctatcccaccgacgggcccacgttggtactccccgaggccctagggttcaggtggcaggttgggtctgggacagtagttcacttctccacctatcgagcagcctgctagtctagaagtattttgacttagttttatttctgttcagtctaagttattaagttaccgtcggtccttacgtacggtggtaccgttcggacgtaacgggaccgtaaggtacggaaactaccgaaacgtacgtggtacggtccgtagaccgtaactntccttacg

SEQ ID NO: 68047 - DNA, 696 bp, Homo sapiens
  misc_feature: GYAE6OF02GL417.37.37.D04.1.454.CMB.1.raw
  modified_base (290)..(290): a, c, t, g, unknown or other
  misc_feature (290)..(290): n is a, c, g, or t
  modified_base (592)..(592): a, c, t, g, unknown or other
  misc_feature (592)..(592): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggtcttcgtggttattacctttagctaattagtggtatcaacgtgggtgcgacncggcccctggaacaaggccagtggagtggagtgggatggatcgagcgtacttaacgaaattaaagtaaccacaacgaactatcgacaacgaaggtaacgttaccgaaggggtacaaggacgtcccaacccgtacgaacccaacgaacgtaacgtaaccaactacccaacggtaacgaccaaccgaccgacccgttaaacgacgttaacgggacgtacgttagggaacgggtacgtccggtagaaggtacgttacgtaacgggaaccgaaccggtaccgggttccggtttacgtttttaccgngggttacggaacggtaaggtaacggttaacgtaaaggttaactttaggtttaaggtaacgttacgggtaaccgtttacgggtacggggaccgtaacccgggggg

SEQ ID NO: 68048 - DNA, 661 bp, Homo sapiens
  misc_feature: GYAE6OF02HVEY0.37.37.D04.1.454.CMB.1.raw
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttcgtggttatacctttagctaatttatggtatcaacgtgggtgcgacgacggccccgtaggaacgaaggccagtgaggtggagtgggatggatcagcgtacttaanaagttaaataacaacactaactatgaccaanacgtaaacgttccgaagggcaaggtacgtaccacccgtagacccaacgtaacgaactaacaactcccaaacggaacgaccaacgaccgaccgttaacgagtacgggaacgcgtaaggacggacgtaccgtaggaacgtacgtaccgtacggaaccgtacggtaccggtaccgttttcgttttaacgcgggttacgacgggtaactacgggtaactaagttaaacgtttacgttaaggtaacggtacggtaacgtttacgggtaccgggaccggtaaccgggg

SEQ ID NO: 68049 - DNA, 644 bp, Homo sapiens
  misc_feature: GYAE6OF02F6IPB.37.37.D04.1.454.CMB.1.raw
  modified_base (202)..(202): a, c, t, g, unknown or other
  misc_feature (202)..(202): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctctgcagggcagtcagagtgttagcagcaacttagcctggtaccagcagaaacctggccaggcctcccgaggcctcctcatcgtagtggtgcatccgaccgacgggccacgtggtactcccgagccgaggttcagtcggcaggtagggactaggggacaggtacgttacgagtacctaaccgagttcgagtcacgtccgtagctagtctaggaagttagttttcgggtaattttacgtttcgtggttacctaggtactaaggttactttacggtttcccgtggtacccgttcgggttaccgtttccgggacccgttaacgggaccggttaacgggtacggtaaacgtaccgtaaaaccggtacgtacggttacggtacgttacgaacccgtacctacgttaccgttcgttacctttaccgtacgttaccccg

SEQ ID NO: 68050 - DNA, 602 bp, Homo sapiens
  misc_feature: GYAE6OF02H647B.37.37.D04.1.454.CMB.1.raw
  modified_base (407)..(407): a, c, t, g, unknown or other
  misc_feature (407)..(407): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctgggcctcagtgaaggtctcctgcaaggcttctggttatacctttagctaattatggtatcaacgtgggtgcgacgaggcccctggacaggccatgagtggagtgggatggatcgagcgtacttaacaataaataacaacactaactatacgacaacgagaacgttaccgaggacgtagacgtccaacccgtgaccanacgattacactcccaacgacgaccacacgtacctaacagtcggaagtcgtaggaacggacgtccgtaggacgtactcgtacgacgacgcggttaccgtttcgttttacgtggtacgacggtaagtaacgtacgaagttaaattagtttagtaacggtacggtaaccgtttacggtacggggacccgtaaccgggg

SEQ ID NO: 68051 - DNA, 712 bp, Homo sapiens
  misc_feature: GYAE6OF02IV67N.37.37.D04.1.454.CMB.1.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatgtgatgacgcagtctccagccaccctgtctgtgtctccgaggggaaangccaccctctcctgcagggccagtcagagtgtagcagcaacttagcctggtaccagcagaactggccaggcctcccaggcctccgtcatcgtatggtgccatcccaccgngggtccacgtgtaactcccgagtcccaggttccaggtcggaccaggttacggtccgtaggggaccaggtactttccgaaccttccgtaccaaccctagttaccaacggaccaacggtccccttcgaccgtacgttaccgtaacggtaaaggttaccttttttacggaccttttaagggtttttacttttcccgttacgttaccgtaaggttaccgttaaaggtttaacttttaaacgtttaaccggtccggttacccttaccgtttaaccgggttcggtaaaccggtttccgggaaccgtaaacggggttacccgtaaagggtacggtaaaacgttcggaaaaccgtaacgttaggttacggtacgttaccggtaaacctacgttccgttaggtttccc

SEQ ID NO: 68052 - DNA, 618 bp, Homo sapiens
  misc_feature: GYAE6OF02IRWNF.37.37.D04.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (421)..(421): a, c, t, g, unknown or other
  misc_feature (421)..(421): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangccaccctctcctgcagggccagtcagagtgttagcagcaacttagcctggtaccagcagaaacctggccaggctcccgaggcctccncatctagtggtgcatcccacgagggccacgtggtactcccgagcctaggttcagtcggcaggttgggtcgtgggacaggtacgttccactcctacgaccagtccagcacgcctcgctgtactagtaagtntttgactttagttttatttcgtgttacacgtactagttaataacgtttacgtcggtacccttacgttacggtacggttaacccgttacgggaacccgtaacggggaacccgttaaggggtaaccggtaaagttacccgaaaacggttaaccgttaggtacggtaccgtacgtaccgaaccgttacgtaccgttacgg

SEQ ID NO: 68053 - DNA, 624 bp, Homo sapiens
  misc_feature: GYAE6OF02IBSXI.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctgggcctcagtgaaggtctcctgcaaggcttctggtttaatacctttagactaatttatggtatcaacgtgggtgcgacacggcccctggacaaggccaatgagtggagtggggatggatcgagcgtcttaacaataaataacaacacaactatgacaacaggaacgttccgaagggcaaggacgtccaaccctgaaccaacagactaacacgtacccaacgacgaccgaactacggacccttaacacgtacgggagtcgtaggaacgggacgtcccgtaggacgaacgttcacgggaccgaacgccgggttaccgttttagttttaccgtggtacggacggtacggtacgtaactaagtaaactttagttagtaacggttacggtaacgttacggagggtacccggaaccgggg

SEQ ID NO: 68054 - DNA, 639 bp, Homo sapiens
  misc_feature: GYAE6OF02FYZYD.37.37.D04.1.454.CMB.1.raw
  modified_base (283)..(283): a, c, t, g, unknown or other
  misc_feature (283)..(283): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcaggtgaaggtctcctgcaaggcttctggttatacctttagctaattatggtatcaacgtgggtncgacgaggccctggacaacggccagtgaggtggagtgggatggatcagcgtcttaacaataactaacacactactatcgacaacgaagtaacgttccgaagggtaccaaggtacgtacccaacccgtgaacccaacgaagtaactaaccactacccgaaacgtaccccgacaaccaacgtacccttaacagtacggaacgtcgtaggaacgggacgtcctaggacgtactacgtacggaccgaaccgtacgggttccgtttagttttacgtgtacggacggtaaaggacgtaacggtaagtaacgttagttaacggtaagtacggtaaccgttacggtcggggaccgtaaccgggg

SEQ ID NO: 68055 - DNA, 661 bp, Homo sapiens
  misc_feature: GYAE6OF02H4P7F.37.37.D04.1.454.CMB.1.raw
  modified_base (582)..(582): a, c, t, g, unknown or other
  misc_feature (582)..(582): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtgggcctcagtgaaggtctctgcaaggcttcgtggttatacctttagactaattagtggtatcgaacgttggggtagcgtacacggcccctaggacaaggccagtgaggtggagtgggatggatcgagcgtacttaacaaataactaacaactacctaacttatcgacaacgtaacggtaaacggtttcccgaagggtaccgaaggtaccgttaccaaccccgtacgaacccgtaacgaacggtaaacttaaccaacgtaacccgaacgaacgaccaacgaacgtaaccctacgtaagtcgggaactcgtaggaacggtcgaccgtaggacgtatcgacggaaccgaccgtacggtccgtttagtttccgnggttcgacggtagtaagtacaaggttaattagttaggtaacggtacgtaacgtacggtaccggggacgtaaacccgggg

SEQ ID NO: 68056 - DNA, 670 bp, Homo sapiens
  misc_feature: GYAE6OF02IKS8U.37.37.D04.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccacctgtctgtgtctcgaggggaaancgccaccctctcctgcagggccagtcagagtgtagcagcaacttagcctaggtaccagcaagaaacctggccaggcctcccgaggcctcctcatcctagtggtnactactacccgaaccgacggggccacgttcggtaactccccgaggtccctaggttcaggtcgggtctaggttggggtctggggaactaggtacgtttccacgttcctacaacctataccgagacctacggcctaggactacgtcgtagtaagttacttttgacctttaagttttctttctacgtcaagtactaaggtttaacttaaacgtttccgtcggttacctttacccgttacgggttcggtaacccgtttcgggaacccggtaacggggtaaccgtaaaggggtaacgtaaaaccggtaccgtaaaaaccgggtacttaggggttcgaccgttgaaccctaaccgttcgtaccggttacg

SEQ ID NO: 68057 - DNA, 711 bp, Homo sapiens
  misc_feature: GYAE6OF02IQFDI.37.37.D04.1.454.CMB.1.raw
  modified_base (205)..(205): a, c, t, g, unknown or other
  misc_feature (205)..(205): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagcagcacttagcctggtaccagcagaacctggccagctccaggcctcctcatctagtggtcgacactccaccgacgggcccacgtcggtaactccccgagtccgtaggttccaggtcgggcgtaggttcgggtacgtggggacaggtacgtttccaacgttcctacaccatccgagtaccagtccctgacgtagttacgtaggtaagttacgttttcggactttaacgtttttacgtttccgttagttacctaaggttaccgtaaagttttaaacgtttaaacttttaccggtaccgggttaccctttaaccggttaaccggggttacgggttaacccgggttaccggggtaccccggtaaagggggtaacccgttaaacggggggtaaagtaaaacccgttaaccggaaaaccgttaaccgggttggtacgggtaccgttaccggaccttaacccgtagttacccgtttcg

SEQ ID NO: 68058 - DNA, 563 bp, Homo sapiens
  misc_feature: GYAE6OF02GYQO4.37.37.D04.1.454.CMB.1.raw
  modified_base (480)..(480): a, c, t, g, unknown or other
  misc_feature (480)..(480): n is a, c, g, or t
tcagtagtgtagatcacgaccggtgctcgatttagtagcatactgttgggtttgggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgacacagaagttccagggcagagtcaccctgaccacagatacatccacgacgcacagcctacagtggagctggacggacgccgtaggagtactcgtacgaacgaccgaccgggtccgttacgtttttacgnggttcggacggaggtaacggtaacgaaggtaacttagtttagtaagttcggtaacgtacggttacggggaccgtaaccggggg

SEQ ID NO: 68059 - DNA, 542 bp, Homo sapiens
  misc_feature: GYAE6OF02IKQZZ.37.37.D04.1.454.CMB.1.raw
tcagtagtgtagatcacgaccggtgctcgatttagtagcatactgttgggtttggggacccaaaaaccacacccctccttgggagaatccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggccctggacaaggccatgagtggatgggatggatcgagcgcttaacaataatacacacactatgacacagaagttccagggcagagtcaccctgaccacagatacatccacgagacacagcctaacatggacgctaggaggagcctaggagtagtcgtagaccgacgacggtccgttagttttacgtgtacgacggagtaagtacgaagtaacttagttaggtaagttgggtactacggtcggggaccgtaaccgggg

SEQ ID NO: 68060 - DNA, 657 bp, Homo sapiens
  misc_feature: GYAE6OF02GR1QL.37.37.D04.1.454.CMB.1.raw
  modified_base (328)..(328): a, c, t, g, unknown or other
  misc_feature (328)..(328): n is a, c, g, or t
tcagtagtgtagatcacgaccggtgctcgatttagtagcatactgttgggtttggggacccaaaaaccacacccctccttgggagaatcccctagatcacagctcctcaccatggactgggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaacgtgggtgcgacaggcccctggacaaggccatgagtggatgggatggatcagcgnttacaataatacacacactatgacacagaacgttcgaggcaggacgtcacctcgaaccacagatacatccacgagacacgacgcctaaagcgtaggaacgtcgtaggaaagggacgtcccgtagggaaacgtacttaccggtacggaaacccggtaacgaacccgggttcccggttttacggttttttaacgtgggttacggaccgggttaacgggtaaacggttaaaccggtaacggtaaacctttaaggtttaaccggtaaaacggtttccgggtaaacccgtttaacccgggtttacggggggtaccccgttaaaacccggggggg

SEQ ID NO: 68061 - DNA, 531 bp, Homo sapiens
  misc_feature: GYAE6OF02FLAH1.37.37.D04.1.454.CMB.1.raw
  modified_base (372)..(372): a, c, t, g, unknown or other
  misc_feature (372)..(372): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (465)..(465): a, c, t, g, unknown or other
  misc_feature (465)..(465): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaagggccatgagtggatgggatggatcagcgcttacaataataacacacactatgcacagaacgttccgagggcagngtacaccctgaccanagactacatccacgancacacgcctanatgganctggagngaccgtgacgngtctgaccgacgacggtcgtgtttacngtgacggtagaacgtacaaggtaattagttagtaacgtacggtactacggtcgggactaaccgggg

SEQ ID NO: 68062 - DNA, 730 bp, Homo sapiens
  misc_feature: GYAE6OF02GSYL1.37.37.D04.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagataccactggagaaatagtgatgacgcagtctccagccacctgtctgtntctccgaggggaaangccaccctctcctgcaggccagtcagagtgtagcagcaattcgcctggtaccagacaacgaaaccgtggaccgacggcctcccgaggcctccgtacatctagtgtcgcactccgaccgagggtacctacgtcggtacctcccgacgaccgtaggtcaggtcggcgtaggtcgggtcgtacgggactagtacggttaccacgttccgtaccgaacctacgtacgaacggtccgacggtcccctggtaccgtacggtccttaggtaaagttcgttttacggaccgtttaagttttttacgtttcggttacgttacgtaacggtacttaacggtttaaattttacccgtttaccgttccggttaccccgtttaccggtacgggtttaccgggttaacccggttaccgggtaaccggtaacggggttaacccgtaaaggggtaaaccgttaaaacggtaaacccgtaaaccggtttaaccgtggggttaaccgtccgttaccggacccttaccggtagttccgtttaccg

SEQ ID NO: 68063 - DNA, 638 bp, Homo sapiens
  misc_feature: GYAE6OF02HE585.37.37.D04.1.454.CMB.1.raw
  modified_base (157)..(157): a, c, t, g, unknown or other
  misc_feature (157)..(157): n is a, c, g, or t
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (351)..(351): a, c, t, g, unknown or other
  misc_feature (351)..(351): n is a, c, g, or t
  modified_base (427)..(427): a, c, t, g, unknown or other
  misc_feature (427)..(427): n is a, c, g, or t
tcagtagtgtagatcacgaccggtgctcgatttagtagcatactgttgggtttggggacccaaaaccacacccctcttgggagaatcccctagatcacagctcctcaccatggactggacctggagcatccttttcctggtggcagcagcaacaggngcccactctcaggttcagctggtgacaggtatgganctagaggtagaagaagccgtgggcctcagtgaaggtctctgacaaggtcttcgtgttaactaccgttagactaattatggtaatcaaacgttggggtnacgacgaacggtccccaggacaacggccagtacgagtgatggatggatcgagcgcttaanaactaataaccgacaacgtactaatcggacaacgacgtaaacgttcgaaggacaaggtacgtacctaacccggtanaacccgtaacgaaggaacttaaccaacgttacccgaaacggacgaacctaacgacgtacccggtaactaagtacggagttaccagggagaccgaccgttacgagtaactcgtagaacgactaccgggtacttcgtttaactcgtagaccggtaagtacgtactaagtaattacgttagaacgtacgaacgtacggtcgggaccgtaaccgg

SEQ ID NO: 68064 - DNA, 737 bp, Homo sapiens
  misc_feature: GYAE6OF02GILEK.37.37.D04.1.454.CMB.1.raw
  modified_base (219)..(219): a, c, t, g, unknown or other
  misc_feature (219)..(219): n is a, c, g, or t
tcagtagtgtagatcacgaccggtgctcgatttagtagcatactgttgggtttgggggacccaaaaaccacacccctccttgggagaatccctagatcacagctcctcaccatggactggacctggagcatccttttcctggtggcagcagcaacaggtgcccactctcaggttcagctgggtgcagtctggagctgaggtgaagagccgtggggcctnagtgaggtctcctgacaaggtcttcgtggttatacctttagctaaattataggtatacgaacgttagggtgaccgacgacgggtacccccgtaggaacgaaacgggcctaagtggtacggtagggtagttaggggagttagggattacgaaggcggttaacttaacgaaaagttaaactaaacaacaactactatagacctaacgaaggtaaacgttaccgaaggggacctaagggtaaccgttacccgaacccgttacgaaacccgaaacgtaacggtaacttaaccaaccttacccggaaacgtaacggaacccgaacgaaaccgtccgtaaactacgttaagggacgtaccgtacgggaacggaaggttacccgagacggtaaccgtacgtacgaaccgaaccggtacggtaccgtttacgtttacgtgttacggaggtaacggtacaacgtaaagaacgttttagtaacggttaaggttacggaacgttacgggtacggggtaccgtaaccggg

SEQ ID NO: 68065 - DNA, 614 bp, Homo sapiens
  misc_feature: GYAE6OF02GH0RK.37.37.D04.1.454.CMB.1.raw
  modified_base (345)..(345): a, c, t, g, unknown or other
  misc_feature (345)..(345): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagctaattatggtatcaacgtgggtgcgacaggcccctggacaaggccatggagtggagtgggatggatcgagcgtacttaacaataanaaccacacactatgacacgaagacgttccgagggcaaggacgtccaacccgtgaacccacgaagtactaacactacccgaacgacgaccaaccacgaccctaacagtaggacgcgtaggaaggacgtccgtagacgtactcgtaggaaccgaaccgaccggtccgtttaggttttaccgtggtacggacggtaaggtaacgttaacgtaagtaagttaagttaggttaaggttacggtaacgtacgggtacggggacccgtaaccgggg

SEQ ID NO: 68066 - DNA, 559 bp, Homo sapiens
  misc_feature: GYAE6OF02JCWQK.37.37.D04.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagcagcaacttacgcctggtaccagcagaaacctggccaggctccaggctcctcatctatggtncatccacnggccacgtggtactcccagccaggttcagtgcngtggtctagggcaggtgttcactctcacntcagcacgcctgcagtcagtacgtatttcgcttattttacttcgtgtctagcttaagttaattaacgttacgtcggtacccttacgttacggtcggttaccgttaccggaccgtaacgggaccgtaagggtacggaaacgtacgaaacgtacgtggtacggtctacggacgtacctagtccttacgg

SEQ ID NO: 68067 - DNA, 725 bp, Homo sapiens
  misc_feature: GYAE6OF02IP8RL.37.37.D04.1.454.CMB.1.raw
  modified_base (153)..(153): a, c, t, g, unknown or other
  misc_feature (153)..(153): n is a, c, g, or t
  modified_base (175)..(175): a, c, t, g, unknown or other
  misc_feature (175)..(175): n is a, c, g, or t
  modified_base (213)..(213): a, c, t, g, unknown or other
  misc_feature (213)..(213): n is a, c, g, or t
  modified_base (416)..(416): a, c, t, g, unknown or other
  misc_feature (416)..(416): n is a, c, g, or t
  modified_base (677)..(677): a, c, t, g, unknown or other
  misc_feature (677)..(677): n is a, c, g, or t
tcagtagtgtagatcacgaccggtgctcgatttagtagcatactgttgggtttgggggaggaactgctcagttaggacccagacggaaccatggaagccccagcgcagccttctcttcctcctgctactctggcctcccagataccactgganaaaatagtgatgacgcagtccncgagccctacctgtctgtctcctaccggaagggaaacncgacccctacccttcctccgtgaccgacgggcctagtcgaaggtagttagtacgacacgactaacgttcgaccgtacggtaaccagtaccgaaacgtaaccgtcggaccgacggtccctaccggaggtcctccctatacttacgtagtcgggtacaccgttaacctacccgaaccgggaccgtaccgtaacgtcggttacccnccgaagtaccgttaggtacgaggtcggacgtagggtcggttacgaggaactggttacctccgtaacttccaacctacgtaacgtcgacgtaccgactcggtacgacgtacgttacggtaaagtaccgtttagtttacgaacgtttttaacgtttacggtttctacgtaacgacgttaacgtaacgtttaaacttacgttacggtccgttaccgtacgttaacggtcgtaacggttccgaacgtacggaacgtaacggtaanaacgtacgtaaacggtgtagtcgacgtacgtacacggttactgttacg

SEQ ID NO: 68068 - DNA, 542 bp, Homo sapiens
  misc_feature: GYAE6OF02G3ST6.37.37.D04.1.454.CMB.1.raw
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (479)..(479): a, c, t, g, unknown or other
  misc_feature (479)..(479): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctgggggcctcagtgaaggtctcctgcaaggcttctggttatacctttagcaatttatggtatcaacgtgggtgcgacgaggcccctggacaagggccagtgagtggagtgggatggatcagcgcttacaataataacacacactatgacacagtaagttaccgagggtcagagtccacctgaccacagactacatccacganacacacgacctacgatcgganctaggaggngccgtagagatcgtagacgacgacggtcgttgtttacngtagacggtagagtacaagtaattattagtaacgtggtacttacggtgggacccgtaacgggg

SEQ ID NO: 68069 - DNA, 690 bp, Homo sapiens
  misc_feature: GYAE6OF02F6TI4.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagcaattatggtatcaacgtgggtgcgacacggcccctggacaaggccagtgagtggatgggatggatcgagcgtacttaacgaaataaactaaacacaactaactatcgactaacgaagtaaacgttccgaaggggcaaggtacggtaccaacccgtcgaaccctaacgaggtaactaacgactaccgaaccgaacgaccaaccgacgtaccctaacgaagttacgggtaagttacgggaacgggtacgtaccgtaggtaagtacgttaccgtacggaaccgtaaccggaccggttcccggtttaagtttttacggtaggttacggaccgaaggttaacggtaacggttaaagtaacgtttaagttaggttaaacgttagggtaaacccgttacgggtaccgggggtacccggtaacggggttaacccccggg

SEQ ID NO: 68070 - DNA, 699 bp, Homo sapiens
  misc_feature: GYAE6OF02IP2B7.37.37.D04.1.454.CMB.1.raw
  modified_base (206)..(206): a, c, t, g, unknown or other
  misc_feature (206)..(206): n is a, c, g, or t
  modified_base (535)..(535): a, c, t, g, unknown or other
  misc_feature (535)..(535): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagataccactggagaaatgtgatgacgcagtctccagccaccctgtctgtcgtctccgaggggaaacncgccctaccctctcctgacgacgggcctagtcgaggtaggttcgttacgcagctaacgttacgccgttacggtaccagaccaacggaaacccgtcggaccgtacggccctaccccgaaggtcccttcccgtactacttcgtacgtcggtacacctacgtacccgaaccgacgggtcctacgttcggtacctcccgacgccgtaggttccaggtcggcgtaggttcgggtactagggacgtacggtacgttccgtaaccgttccgtacctaaccgtagttaccgacgtaccgtaacgtccgtacgacgtacgttacgtaaggtaacgttntttacggactttagtttacttcgacgtacagtactaagtttactacgttccgtacgtccttacgttacggtgtaaccgtcggaactaacgggtactagggaacgttaacgtaacgtaaacggtacgttcggtacgtacgaccgtaccgtacttcggtacctcgg

SEQ ID NO: 68071 - DNA, 605 bp, Homo sapiens
  misc_feature: GYAE6OF02HOSGQ.37.37.D04.1.454.CMB.1.raw
  modified_base (283)..(283): a, c, t, g, unknown or other
  misc_feature (283)..(283): n is a, c, g, or t
  modified_base (345)..(345): a, c, t, g, unknown or other
  misc_feature (345)..(345): n is a, c, g, or t
  modified_base (441)..(441): a, c, t, g, unknown or other
  misc_feature (441)..(441): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcgagtgaaggtctcctgcaaggcttcgtggttatacctttagctaattatggtatcaacgtgggtncgacacggcccctggacaaggccagtgagtggatgggatgggatcagcgacttaacaataanaacacacactatgcacagaacgttccgaggacaagacgtaccacccgtagaccacagaactaacactccagacgcacgacgacctacagtaggaancgtaggacgggactccgtagagtacgtaccgacggaaccgtaccggtaccgggtccgttttaggttttacctgggtacgtacgggtaacgtaggtaaccaaggttaacttacgttaaggtaacggtacggtaaccgtaacgggtacggggaccgtaaaccgggg

SEQ ID NO: 68072 - DNA, 672 bp, Homo sapiens
  misc_feature: GYAE6OF02F44E5.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggttatacctttagcaattatggtatcaacgtgggtgcgacacggcccctggacaaggccagtgagtggagtgggatggatcgaggcgtacttaacaaataaataacacaacactatcgacaacgaagtaacgttccgaagggacaaggtacgtacctaacccgtacgaacccaacgaacgtaactaaccacgtacccgaacgacgaccgacaacggaccttaacgagtacgggacgcgtaggaacggacgaccgtaggaagtacttaccgtaggaaccgaccgtaccggggttaccgtttacggtttttaccgtgggtaccgtacggtaaggtaacggttaacgaacggttaaagtttaggtttaacggttaacggttaccgggtaaccttaccggggttaccgggggacccgttaaacccggggg

SEQ ID NO: 68073 - DNA, 661 bp, Homo sapiens
  misc_feature: GYAE6OF02IZI8L.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcgaggttcagctggtgcagtctggagcgtgaggtgaaggaagccgtggggcctgagtagaaggtctctgcgaaggcttgtggttactacctttagactaattagtggtatactaacgtgggtagcgacgacggtccctaggacaaggccagtgaggtggagtgggatggactcgaggcgtacttaacaataacgaaaccacgaactactatcgacagaacgtaacgtccgaggacgaagacgtaccaccgtgaaccacgtaagtactaacacgtaccacgacgacacgacgtacctacgtacgtaggacgtacgtacggacggtacgaccgtaggtacgtacgtacggacgtaaccggaacgtaccggttcgttacgttttacgcgtacgtaacgggtaagtaacggttaaccgtaaggttaacgttagttaacggttaacggttaccggtaacggttaaccggggtaccggggtaccggttaaacccgggg

SEQ ID NO: 68074 - DNA, 637 bp, Homo sapiens
  misc_feature: GYAE6OF02J271Z.37.37.D04.1.454.CMB.1.raw
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctccgtgcaaggcttctggttactacctttagctaattactggtactcaacgtgggtgacgacgaggcccctggacaaggccatgaggtgatgggactgggatcaggcgcttacaataagtaacacacanatnacacagtacgtcagggcagacgtcacccgtagacctagacgataaccactaccgagacgacacgtacgaccttacgagttacgggactacgaggacggaaccgtccgtaaggacgtaactccgtaacgaaccgggtaaccaccggggttacccgttttagtttaacggtcccggtggaacccgggtaaacggtacggttaaacgaacgttaagttaaggttacgttaaacggtacgggtaactttaccggggtacggggacccctttaaaccggggg

SEQ ID NO: 68075 - DNA, 560 bp, Homo sapiens
  misc_feature: GYAE6OF02HRF4T.37.37.D04.1.454.CMB.1.raw
  modified_base (243)..(243): a, c, t, g, unknown or other
  misc_feature (243)..(243): n is a, c, g, or t
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (488)..(488): a, c, t, g, unknown or other
  misc_feature (488)..(488): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcagtgaaggtctctgcaaggcttntggttatacctttagcaattatggtatcaactgggncgacaggcccctggacaggccatgagngagtggatggatnaggcgctaanaataactaacacacactangcacaagacgttcgaggcagacgtcacccgtcaccacagatacagtccaacgacgacacgaacacctaacgagtggacgacgtaggaggacgccgtacgacgatacgtacgaaccggactaccggcgtttagttttacgngttacggcggtaagacgtaacgagttaatatttacggaagtacggtaacgtacggtcgggacgtaaccgggg

SEQ ID NO: 68076 - DNA, 630 bp, Homo sapiens
  misc_feature: GYAE6OF02IKDXG.37.37.D04.1.454.CMB.1.raw
  modified_base (218)..(218): a, c, t, g, unknown or other
  misc_feature (218)..(218): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctnagtgaaggtctcctgacaaggcttctggttatacctttagcaattatggtatacaacgtgggtgcgacaggccctggacaaggccatggagtggatgggatggatcgagcgtacttaacgaataataacacacactatgcaacagaacgttcgagggacagagtccacccgtagacccaagaagactaacaacgtccgaaacgtaacggccaacacgaccctaactagtagggaagtccgtaggaacgggacgtacccgtaggaacgtactcgtacggaaccgtaaccgacccgggttcggttacgttttaccgtgggttacgaccggtaaggtaacgtaacctaagggtaaacttaacggtttaggtaaacttcgggtaactaccgggtacggggacccgtaacccggggg

SEQ ID NO: 68077 - DNA, 559 bp, Homo sapiens
  misc_feature: GYAE6OF02IZJ3K.37.37.D04.1.454.CMB.1.raw
  modified_base (204)..(204): a, c, t, g, unknown or other
  misc_feature (204)..(204): n is a, c, g, or t
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttagcagcaacttagcctggtaccagcagaaacctggccaggctcccgagctcctcatctatggtgcatcccaccagggccacgtggtactcccagcctaggttcagtcggcgagtgggtctgggacngtagttcactctcaccatccagcagcctgctagtctagaattnttttgctagttttcttctgtacagtctagttattaattactcggccttcgtacgtcggtaacgtttcggaccgtaagggaccgtaaggttacggaaactaccggtaaaacggtaccgttaggtacggtactcgacctaccgtactccgttacg

SEQ ID NO: 68078 - DNA, 577 bp, Homo sapiens
  misc_feature: GYAE6OF02I823V.37.37.D04.1.454.CMB.1.raw
  modified_base (176)..(176): a, c, t, g, unknown or other
  misc_feature (176)..(176): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (460)..(460): a, c, t, g, unknown or other
  misc_feature (460)..(460): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcngctggtgcagtctggagctgaggtgaagagcctggggcctcagtgaaggtctccgtgcaaggcttcgtggttactacctttagctaattatggtatcgaacgtgggtgcgacgacggtccccctaggaaccaacgggtccaagtggagtaggagtgggagtggactcgaagcgtacttaacgaaataataacacacactatgcaacagtaacgtcgaggnagacgtcacccgtgaccacagatacacncanacgnacgacnccgtanacgtgagtcgtagaggngcgtgacgactacgcgaccgaaccgtacggtcccgtttagttacgtcgtgccggagtaactacgaagtaacgttagttacgtaagtcggtacgtacggtacgggaccggtaaccggg

SEQ ID NO: 68079 - DNA, 631 bp, Homo sapiens
  misc_feature: GYAE6OF02GC0KG.37.37.D04.1.454.CMB.1.raw
  modified_base (525)..(525): a, c, t, g, unknown or other
  misc_feature (525)..(525): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctgagtgaaggtctcctgcaggcttctggttataccttagctaattatggtatcgaactgggtgcgtacacggccctggacaacggccagtgagtggatggggatggatcgagtcgacttaacaaataataaccacacactatggacaacaacgtaagttaccgaaggggtacaaggtaggtcccaacccgtgaacccaacaggaactaactactaccacgagcaaccagaccttaacgatggagcgtggaggacgcctaggagacgtcgtacgaaccgtaaccgacgggttaccgttacgttttaccngggttacgtacggaaggtaaccgtaacgtaacggtaaagtttaagttaggttaaacggttcgggtaaacccggttacggttaccgggggtacctaaacccgggggg

SEQ ID NO: 68080 - DNA, 639 bp, Homo sapiens
  misc_feature: GYAE6OF02JA1H0.37.37.D04.1.454.CMB.1.raw
  modified_base (334)..(334): a, c, t, g, unknown or other
  misc_feature (334)..(334): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggttatacctttagctaattatggtatcaacgtgggtgcgacaggcccctggacaggccatgagtgatgggatggatcgagcgtctaanaataataacacacactatgacacgaagaacgttcgagggacaggacgtcctacccgtagaacccacgaagaactaacactacccaacgacgacaaaccgacgacccgtaacgtagtacggacgacgttaggaacgggtacgaccgtaggacgtaacttcggtacgaaccggtaaccggacgggttacccgttacggtttttacgacgggttcgaaccggggtagtaaacggtaccgaaagttaaacgtttaggttacgttaagttaccgggtagttaccggtacggggtacccgtaaacccgggg

SEQ ID NO: 68081 - DNA, 254 bp, Homo sapiens; identical to SEQ ID NO: 67868
  misc_feature: GYAE6OF02F8ZF5.37.37.D04.1.454.CMB.1.raw
  modified_base (247)..(254): a, c, t, g, unknown or other
  misc_feature (247)..(254): n is a, c, g, or t

SEQ ID NO: 68082 - DNA, 724 bp, Homo sapiens
  misc_feature: GYAE6OF02JO1TI.37.37.D04.1.454.CMB.1.raw
  modified_base (208)..(208): a, c, t, g, unknown or other
  misc_feature (208)..(208): n is a, c, g, or t
  modified_base (313)..(313): a, c, t, g, unknown or other
  misc_feature (313)..(313): n is a, c, g, or t
  modified_base (381)..(381): a, c, t, g, unknown or other
  misc_feature (381)..(381): n is a, c, g, or t
tcagtagtgtagatcacgaccggtgctcgatttagtagcatactgttgggtttgggggaggaactgctcagttaggacccagacggaaccatggaagccccagcgcagctctcttcctcctgctactctggctcccagataccactggagaaatacgtgatgacgcagtcctcagccaccctgtctgtacgtctaccgaggggtaaancgccaccctctccgtgcacgggcctagtcagagtgtagcagcaacttgcctgtaccagcaagaacctgccagccctaccaggtcctcctacattcctagtgggcncgatccccacggtggcccaacgttcggactccccgagtccgtacggttcaggtcgactgggtcggtcngggaactagtacgtccacgtccgtacacgtatccagtcctaaggccctagggcctagggtaccctaggttaaatccgttttacggacgtttaacgtttttacttccgtagttaccgacgtgtttaaaggtttaccttaaacgtttccgtccggttacccgttaacggtaaccggtttcccgggtacgtttacccccggggaacgtaaccggggggtaaccgtaagggggttttaacccggaaaaccgttaaacccgggttaaaaccggtcgttaacccggggggttcctttaaccggacccggttaaacccctacgtttaacccgggttccgtttaacccggg

SEQ ID NO: 68083 - DNA, 741 bp, Homo sapiens
  misc_feature: GYAE6OF02FPV6D.37.37.D04.1.454.CMB.1.raw
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagctggggcctcagtgaaggtctctgcaaggcttntggttatacctttagctaaagttatggtatcgaacgtgggtcgcgacncggccctggacaggccaagtgagtaggagtggggatggatacgagtacgtacgttaacaaagttaaactaaccgtaacaaccgtaacttaagtcggacctaaacgtaacgggtaaacggttaccgaacggggtacaaccgggtaacggtttcccaaacccgttacggaacccgtaacgtaacggtaactaacctacgtaccgaaaccggacgaccgtaacctaacgtacccttaaaccgacggttacggacggtccgtacgggtaacggacgggtaccgtagggaacgtactacccggtacggtaacccgggtccgtaaaccgggttcccgttttaaggttttaaccgttgggaaccggtccggtaacggtacggttaacgaaggttaaaccgttggttaacggttaggttaccgggacttaaccgggggtcggggacccgttaacccggggg

SEQ ID NO: 68084 - DNA, 623 bp, Homo sapiens
  misc_feature: GYAE6OF02IJ6EI.37.37.D04.1.454.CMB.1.raw
  modified_base (295)..(295): a, c, t, g, unknown or other
  misc_feature (295)..(295): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (442)..(442): a, c, t, g, unknown or other
  misc_feature (442)..(442): n is a, c, g, or t
tcagtagtgtagatcacgaccggtgctcgatttagtagcatactgttgggtttgggggacccaaaaaccacacccctccttgggagaatcccctagatcacagctcctcaccatggactggacctggagcatccttttcctggtggcagcagcaacaggtgcccactctcaggttcagctggtgcagtctggagctgaggtagaagagccgtggggcctcagtgaaggtctccgtgcgaaggtcttcgtggttataccgtttagactaattagtggtatacaagttgggtgcganacggcccctggaacagccatggagtggatggatggatcgagcgtactaacaaataataacacacactancncaactaagtaacgtcaagggacagtacgtacacccgagtaaccacaagactaacactccgaacgatccaagtaacncccgtaagtagacggaagtacagggaacggactaccggtagaaacggacttcgacggtaaccgacccggtaaacggtcccgttttaagtttacctggaggtaccggaagtaacgtaacgtaagaaagttttcgtaaggttaacgtaggtaaccggtacggtccgggggtaacaacccgggg

SEQ ID NO: 68085 - DNA, 745 bp, Homo sapiens
  misc_feature: GYAE6OF02GQXNU.37.37.D04.1.454.CMB.1.raw
  modified_base (117)..(117): a, c, t, g, unknown or other
  misc_feature (117)..(117): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (552)..(552): a, c, t, g, unknown or other
  misc_feature (552)..(552): n is a, c, g, or t
tcagtagtgtagatcacgaccggtgctcgatttagtagcatactgttgggtttgggggaggaacgtgctcagttaggacccagacggaaccatggaagcccagcgcagctctcttcncctgctactctgctccagataccactggagaaatgtgatgacgcagtctccagccaccctgtctgtatcctccgaaggggaaaccgcccacccttctcctgccgaaggccaggtcagagttgttgcacgtcaaacgttcgcctggtaccagacagaaacctggaccgagcctacccaggcctccgtacatctanggtcnctacncctaccgacgccctaacgcggtaacctccccgagccgtaacggttccgtaaggtccgggaccgtaagggttcgggttacgtacgggggaactaaccggggtaacgtttaccgaaacctttcccggttaccaaacccgttacgtaaccgtaaacgccggtacccgttaccgtacggtacgacgttaccggtaggtaaacgttcgtttagccgttaaaggttttcttaccgtntaccggtatacgttaagtatttaaacgttcccgtacggacccttttccgggaaacgtcgggttacccgttgggaaccccgtagggtaacccggaacgggtttaaggaaaccggttaaacccaaaaccgggttaagtttcccggtaacggggtacctaacggttacccgaacccgtttaggtccgttaacccgg

SEQ ID NO: 68086 - DNA, 259 bp, Homo sapiens
  misc_feature: GYAE6OF02H32CX.37.37.D04.1.454.CMB.1.raw
  modified_base (232)..(232): a, c, t, g, unknown or other
  misc_feature (232)..(232): n is a, c, g, or t
  modified_base (247)..(259): a, c, t, g, unknown or other
  misc_feature (247)..(259): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctcgtgggggcacagcggccctgggctgcctggtcaaggactacttccatctacactactgagcggcnggcaaggcgcatagnnnnnnnnnnnnn

SEQ ID NO: 68087 - DNA, 708 bp, Homo sapiens
  misc_feature: GYAE6OF02IORTI.37.37.D04.1.454.CMB.1.raw
  modified_base (186)..(186): a, c, t, g, unknown or other
  misc_feature (186)..(186): n is a, c, g, or t
  modified_base (430)..(430): a, c, t, g, unknown or other
  misc_feature (430)..(430): n is a, c, g, or t
tcagtagtgtagatcacgaccggtgctcgatttagtagcatactgttggggtttgggggacccaaaaaccacacccctccttgggagaatcccctagatcacagctcctcaccatcggactggacctggagcatccttttcctggtggcagcagcaacaggtgcccactctcaggttcagctggtncagtctggagctgaggtgaagagccgtgggctcagtgaaggtctctgacgaaggtcttcgtaggttatacctttagcaattagtaggtatcgaacgtgggtacgacgaacgacggacccgtaggaacgaacggccaagtaggacggtggagtgggagtggatcgagcgtactaacgaataacgaacacactactatcgacagagtaacgttcgaaggacaggactaccaccgtgaaccacgaanactaacgacaccgacgacgtaccaacgacgtactaacgagtacggtagacgtaggaacggtacgtaccgtaggtaacgtacgtacgtaacggaaccgtaaccggtacccgggttccgttttaacggttttaccggtacgggtacgggtaaccggtaacgggtaaaccggttaacggtaaagtttaaacgtttaaggttttaaacggttaaaccgggttaacgggttaacccgggttaaccggggttacccgggggtaacccggttaaaaccccggggg

SEQ ID NO: 68088 - DNA, 850 bp, Homo sapiens
  misc_feature: GYAE6OF02HFV37.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagcgtgaggtagaagaacgccgtgggcctcgagtgaaggtctccgtgacgaaggtcttcgtaggtttaacttaccgtttagactaagtttacgtaggtactaccgtaacgtgggtagaccggaacaccgggtccccttaggaaccgaaacgggtccgtaaagttggaacggttgggaacgtacgggggtagtacgggaacttacgaacggtccgtaaccgtttaaacgtaaaagttaaacgttaaaccgaacctaaccgtaacgtttaagtccggaacctaacgtaaacggtaaacgtttacccggaaggggactaacgggtaccgtacccgaaccccgttaagaacccgtaaacgaacgtaaacgtaaccgtaactacccgaaaggaaccgactaaaccgacgtacccttaaacgacggttaaggaccgtacgtaacgggaacggacggtacccgttaggaaccgtacgttaccgtaacggaacggaaccccgtacgggttacccgttttacggtttaaccgtgggttaacggtaccggaaagggttaaaccggttaacgaaacggtttaaacgttttaacgtaagggtttaaaccggttttacggggaaacccggtttacggggttaaccgggggtaacccccgttaaacccggggg

SEQ ID NO: 68089 - DNA, 661 bp, Homo sapiens
  misc_feature: GYAE6OF02IR9U8.37.37.D04.1.454.CMB.1.raw
  modified_base (219)..(219): a, c, t, g, unknown or other
  misc_feature (219)..(219): n is a, c, g, or t
  modified_base (416)..(416): a, c, t, g, unknown or other
  misc_feature (416)..(416): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctnagtgaaggtctcctgcaaggcttcgtggttatacctttagctaatttatggttatacgtaacgtgggtgaccgacgacggcccctggaactaaggccagtggaggtggagtgggatggatcgagcgtacttaacaataataacacactaactatcgacaacgaagtaacgttccgaagggacaagacgtaccaccgngaacccaacacgtaactacacgtaccacgacgaccaacgacgacctacgagtacggacgtacgtaggaacggtacgtaccgttaggacgtacttccgtacggaaccgtaaccggtaccggttccgtttacgttttaccgtggttacggacggtaaggttaacgtaaccgtaagtaaacgtttaaggtttagttaaacggttacggtaaccggtttaacgggtaccggggtaccggtaacccgggg

SEQ ID NO: 68090 - DNA, 640 bp, Homo sapiens
  misc_feature: GYAE6OF02F58AQ.37.37.D04.1.454.CMB.1.raw
  modified_base (263)..(263): a, c, t, g, unknown or other
  misc_feature (263)..(263): n is a, c, g, or t
  modified_base (443)..(443): a, c, t, g, unknown or other
  misc_feature (443)..(443): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctcagtgaaggtctcctgcaggcttctggttatacctttagctaattntaggtatcaacgtggtgcgacgcggccctgacgaagccagtgagtggagtgggatggatcgagtcgtactaacgaataacgtaacactaacgtactagtcgacaacgtaagtaacgtacgaggtacaacgacgtcccaaccgtcgaaccaacgacgtactaacctacgtcccgaaggacncgtaaccgacgtaccctaacgacgttacgggaccgtcgtaggtaacgggacgtccgtagacgtacgtcgtacggaaccgtcgaacggttccgttagtttaccggtgtaccggaacggttacgaacgtaagtaacgtaacgttagttacggtaagttccggtaaacggttccgggtaccgggtaccgtaaacccgggg

SEQ ID NO: 68091 - DNA, 897 bp, Homo sapiens
  misc_feature: GYAE6OF02HW6C1.37.37.D04.1.454.CMB.1.raw
tcagtagtgtagatcacgaccggtgctcgatttagtagcatactgttgggtttggggacccaaaaccacacccctccttgggagaatccctagatcacagctcctcaccatggactggacctggagcattccttttctcgtggcagcagcaacaggtcgcccactcctcaggttcagcttggtgcagtcgtggagctgaggtgaagacgccgtgggcctcgagtgaacggtctcgtgacaaggtcttcgtaggtttatacccgttttagacttaagtttagttacggttaatactaacggttgggtacggacggaaccgtaccgggtacccccgttagggaaccgaaacggccctaaggtaggtagggtagggtaagttgggaattgggaattcgacggcgttacttaaacaaataaaacttaaaccgaacgaacctaagttactacggaactaacgtaaaaggtaacgttacccgaaggggacgtaaaggaccgttaacccgacccgtaacgtaacccgaacgaacgtaacgtttaaaccaaacgccccggaaagtacggaaccacctaacggtaaaccttaccggtaaagttgggaaaccgtcgttaagggaccgttaacggtaccgtaggtaaccgtaacggttccgtaaccgggtaaaccggtaaccccgggtccgggttaaacccggttttttaggttttaacccgtacgggtttaacccgggttaccgggtaaaacggtttaaacccgggttaaacgtaaaaccgggttttaaaacgtttttaaagggttttacccggttaaaaggggttttccccggttaaaaaccggggttttttacccgggggtaaaacccccggggggggccccggtttttaaaacccccggggggg

SEQ ID NO: 68092 - DNA, 640 bp, Homo sapiens
  misc_feature: GYAE6OF02HPOML.37.37.D04.1.454.CMB.1.raw
  modified_base (412)..(412): a, c, t, g, unknown or other
  misc_feature (412)..(412): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttctggttatacctttagctaatttatggtatacaacgtgggtgcgacgacggcccctaggaacaaggccagtgaggtggagtgggatggatcgaggcgacttaacaataaactaacacacactatgacaacaagaacgttacgaggacaggacgtccacccgtagaccaanagaactaacgactaccgaacgacgaccaacgaacgacctaaacgagtagggacgcgtaggaacggacgtccgtaggacgacgttacgacgaaccgaccgtaccggtaccgtttacgttttacgtggttacggtaccggtaaggtaacgttaacgtaacggttaaagttagtttacggttaacgtacgggtaaccgtttaaccgggtacggggaccgtaaacccggggg

SEQ ID NO: 68093 - DNA, 629 bp, Homo sapiens
  misc_feature: GYAE6OF02F6ZGZ.37.37.D04.1.454.CMB.1.raw
  modified_base (453)..(453): a, c, t, g, unknown or other
  misc_feature (453)..(453): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggtcttctggttacttacctttagctaattatggtatcaacgtgggtgcgacgacggcccctggacaacggccatggagtggagtgggatggatcgagcgtacttaacaataacaaccacactactatcgacagaaggtaacgttcgagggacacgtactccacccgtgaaccaacgacgaactacgactaccgacgacgacaccacgacctaanacgtaggacgtcgtaggacggacgctaggacgtacgttcgtaacgacgtaccgacggttccgtttacgtttacgtcgtacggacggtaacgtaacggtaacgaaagtaagtttaagttaacgggttaacgtaaccgggtaccgttacggggtaccggggacccgtaaacccggggg

SEQ ID NO: 68094 - DNA, 621 bp, Homo sapiens
  misc_feature: GYAE6OF02GKC1Z.37.37.D04.1.454.CMB.1.raw
  modified_base (532)..(532): a, c, t, g, unknown or other
  misc_feature (532)..(532): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggtcttcgtggttactacctttagctaattatggtatcaacgtgggtgacgacacggcccctaggacaacggccagtggaggtggagtgggatgggatcgagcgtacttaacaaataaactaacgaacactactagtgacaacaagtaacggttaccgagggacaaggacgtaccaccgtagaaccacaagatactactaccaagacgacacacgaccacgagtggagtcgtaggaacggacgtcgtaggacgtactcggtacggaccgaccggacgggtccgttagttttacgngggttagtacggaaggtaagtaacgtaaggtaactttaggttacgtaacggttacgtaacggttacggtacggggtacgtaacccgggg

SEQ ID NO: 68095 - DNA, 704 bp, Homo sapiens
  misc_feature: GYAE6OF02I5MKF.37.37.D04.1.454.CMB.1.raw
  modified_base (353)..(353): a, c, t, g, unknown or other
  misc_feature (353)..(353): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggttatacctttagctaattagtggtatcaacgtgggtgcgacgacggccccgtagggaacaagggcagtgtaggtagggagtggggatgggatcgagcgtacttaanaataaactaacacactaactatgacagtagtaacgttaccgagggtacaaggtacgtaccacccgtacgaaccctaacgaacggtaactaacgtactacccgaaccgtacgaccaaccgacgaccgttaacacgttaacgggacgttacggtaggaacgggtacgtaccgtaggtaacgtacttaccggtgaaacccggtaccggtaccgggttccgttttaaggttttcggagggttccggtaacgggtaacgggtaaggttaacgaaagttaacgtttaaggtttaacgggttaacggttcgggtaaacccgtttacgggggttaccggggtaacccggtaacccgggg

SEQ ID NO: 68096 - DNA, 572 bp, Homo sapiens
  misc_feature: GYAE6OF02GX2Q0.37.37.D04.1.454.CMB.1.raw
  modified_base (280)..(280): a, c, t, g, unknown or other
  misc_feature (280)..(280): n is a, c, g, or t
  modified_base (358)..(358): a, c, t, g, unknown or other
  misc_feature (358)..(358): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcgagtgaaggtctcctgcaaggcttctggttatacctttagcaattatggtatcaactgggtncgacgacggcccctggacaaggcccagtgagtggatgggatggatcagcgtacttaacgaataagtaacacacactangacacagtaacgtcgaggcagactccacccgtgaccacagatacactaccagacgcacacgacctanacgtaggacncgtaggacggtacgccgtagaacggtatcgtacgaccgacgtacccggtcgtttagtttacgtgtcggacggtaagacgtaacgaagtaagttagttacggttaagtaggtacgtacggtacgggaccgtaaccggg

SEQ ID NO: 68097 - DNA, 627 bp, Homo sapiens
  misc_feature: GYAE6OF02IVJ5K.37.37.D04.1.454.CMB.1.raw
  modified_base (200)..(200): a, c, t, g, unknown or other
  misc_feature (200)..(200): n is a, c, g, or t
  modified_base (305)..(305): a, c, t, g, unknown or other
  misc_feature (305)..(305): n is a, c, g, or t
  modified_base (452)..(452): a, c, t, g, unknown or other
  misc_feature (452)..(452): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccacctgtctgtgtctcgagggaancgccaccctctcctgcaggccagtcagagtgtagcagcaacttagcctggaccagcagaaacctggccaggcctcccaggtcctaccgtctactctagtgggtcnctactccgaacccgagggcccacgtggtactccccgagcctagttcaggtcggctaggttcgggtctcggggaccaaggtcgtttaccagttcctaccacctatcccgaagtccgacgtccgtcggactacgtcgtaagtaacgttnttttagcctttagttttacttgtgttaccagtacgtaattattaaacgtttcgtcggtcccttacgtttacgggtacgtaccggttccgtacggtaaccgggtaacgtaagggtaactaaaccgttaaccgaaaacgtcgtgggttacgcgtaccgaccaaccgtgtaccgttcg

SEQ ID NO: 68098 - DNA, 254 bp, Homo sapiens
  misc_feature: GYAE6OF02G78TH.37.37.D04.1.454.CMB.1.raw
  modified_base (246)..(254): a, c, t, g, unknown or other
  misc_feature (246)..(254): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggacctgggctgcctggtcaaggactacttccatctacactactgagcggctggcaaggcgcatagnnnnnnnnn

SEQ ID NO: 68099 - DNA, 648 bp, Homo sapiens
  misc_feature: GYAE6OF02FUGCK.37.37.D04.1.454.CMB.1.raw
  modified_base (263)..(263): a, c, t, g, unknown or other
  misc_feature (263)..(263): n is a, c, g, or t
  modified_base (567)..(567): a, c, t, g, unknown or other
  misc_feature (567)..(567): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcgtggggcctcagtgaaggtctcctgcaaggcttctggttatcctttagcaattanggtatcaacgtgggtgcgacacggcccctggacgaaggccagtcgaggtggagtgggagtggatcgagcggtacttaacgaaataacgtaaacaactaacgaacttagcgtacaacgagtaacgttaccgaaggggcaggtagtaccacccgtacgaacccaagaacgaataaccgaactacccgaacgaacgaccaacgacgtaccgtaacgtacgtaggaacgtaccgtaggacgggaacgtccgttaggaacggtacttacgtacgggaaccgacgtaccggttccgtttagttttaccgnggtacgtacggtaaggacgttaacgaagtaagttactttaggtaacgttcggaacgttacggtacgggacccgtaaccggg

SEQ ID NO: 68100 - DNA, 261 bp, Homo sapiens
  misc_feature: GYAE6OF02F70Z7.37.37.D04.1.454.CMB.1.raw
  modified_base (247)..(261): a, c, t, g, unknown or other
  misc_feature (247)..(261): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggactacttccatctacactactgagcgggctggcaaggcgcatagnnnnnnnnnnnnnnn

SEQ ID NO: 68101 - DNA, 252 bp, Homo sapiens; identical to SEQ ID NO: 67949
  misc_feature: GYAE6OF02GEVTT.37.37.D04.1.454.CMB.1.raw
  modified_base (247)..(252): a, c, t, g, unknown or other
  misc_feature (247)..(252): n is a, c, g, or t

SEQ ID NO: 68102 - DNA, 622 bp, Homo sapiens
  misc_feature: GYAE6OF02HOREI.37.37.D04.1.454.CMB.1.raw
  modified_base (243)..(243): a, c, t, g, unknown or other
  misc_feature (243)..(243): n is a, c, g, or t
  modified_base (417)..(417): a, c, t, g, unknown or other
  misc_feature (417)..(417): n is a, c, g, or t
  modified_base (456)..(456): a, c, t, g, unknown or other
  misc_feature (456)..(456): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctcctgcaaggcttntggttatacctttagctaattatggtatcaacgtgggtgcgacacggcccctaggacaaggccagtggagtgggagtggggatgggatcgagtcgtacttaacaaataaactaacacactactatgacaagaagaacgttccgaagggacaggacgtccacccgtagacccaanaagaactaacactccaagacgacaaccgacgtacctaancgtacgggatcgtaggagggacgcgtagaagtacgtcgacgaaccgaaccggtaccggtaccggtttacgttttacgtaggtacggacggtaaaggtactaacggtaagtaagtttagttaacgttaggtacggtaacgttacggtacggggtaccctaaccgggg

SEQ ID NO: 68103 - DNA, 717 bp, Homo sapiens
  misc_feature: GYAE6OF02H69G0.37.37.D04.1.454.CMB.1.raw
  modified_base (214)..(214): a, c, t, g, unknown or other
  misc_feature (214)..(214): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
tcagtagtgtagatcacgaccggtgctcgatttagtagcatactgttgggtttgggggaggaacgtgctcagttaggacccagacggaaccatggaagccccagcgcagccttctcttcctcctgctactctggctcccagactaccacgtggagaaatcgtgatcggacgcagtctccagccacctgtctgtacgtctaccgaggggaaaacncgccaccctctcgtcgacgagggtcccatcaggagtgtagcacggcaaaccgttgccctggaccagacgaagtaaccgnggaccnggtcctcccgagggtctccctaactactcttacgttcggngacctactaccccgaaccgtacggggccctaacgtcggtaccccgtcccacgggacctaaacgggttcgaaccggttaggcgtaacgggtttcgggaccgttacggggaaccgtagggtaccttcggtaccctacgtaccgactacgtacgacgtccgaacgtccgcgactacgtcgttaagaggtacttttacggtacttaccgtttatttacgtacgttcgacgttgtaaacgttagtaaaccttaacggtcccgtaccgggtaccgtttcgggacctaaaccgggacgttaacgggacggttaaccgtaacggaaactaacggttactaccgggtactcggtacgactaacccgttagtacgttctacgttaccg

SEQ ID NO: 68104 - DNA, 627 bp, Homo sapiens
  misc_feature: GYAE6OF02F7OAI.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttactacttagcaattatggtatcaactgggtgcgacacggcccctggacaaggccatggagtggatgggatggactcgagcgtacttaacgaaataactaacacaactacgttaactggaccaacgaagtaacgttcccgaagggcctaaggaacgtccaacccgtacggaacccaacgaagaactaaccacgtacccaaacggactaccaaccgacgtaccctacgtagtacggagtacgtaggaaggtacgccgtaaggacggtaactcgtacgaaccgtacgaacccgggtcgtttacgtttacgtggtacgacgaaggtaacgtaacgaagtaattagttagtaacgttaggacgtacgggtgggacccgtaacggg

SEQ ID NO: 68105 - DNA, 778 bp, Homo sapiens
  misc_feature: GYAE6OF02JB3H4.37.37.D04.1.454.CMB.1.raw
  modified_base (282)..(282): a, c, t, g, unknown or other
  misc_feature (282)..(282): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagtctggtgcagtctggagctggagtgaagagccgtgggcctgagtagaaggtctccgtgcgaaggcttcgtggttacttacctttagacgttaattagtggttaanctaaacgttggggtcgtccgaacgacggtcccccgtagggaaccgaaacgggccctagttacggaagggttgggtaagtacggggtattacggggtattaccgaggtccggtactttaaaccgaaattaaaactaaaccgaaacgtaactaaccgttaatacggtaaccgaaacaacggttaaacgttaccgaacggggactaaaggtacgtacccgtaaccgttacccgaaacccgtaaacaacggtaactaacctaacgtacccaaacgggacctaaccgaccgtaaccgtacccttaacgaacggttaacggacgtccgtaaggacggtaacggtaccggttaggaacgtacgtaccgacggtaaccgaacggtacccggtaccgggtttctttttacgggacgttaggtaccggaacggtaagtccgtaaacgtacgtttaagttacggtaagttaccggtacgtaacgggtacccgggaccggtaaccggg

SEQ ID NO: 68106 - DNA, 290 bp, Homo sapiens
  misc_feature: GYAE6OF02G36N8.37.37.D04.1.454.CMB.1.raw
  modified_base (256)..(290): a, c, t, g, unknown or other
  misc_feature (256)..(290): n is a, c, g, or t
tcagtagtgtagatcacgaccggtgctcgatttagtagcatactgggttgggtttgggtgcccaagctgctggagggcacggtcaccacgctgctgagggagtagagtcctgaggactgtaggacagccccatcggtcttcccccgtggccacccctcctccaagagcacctcgtgggggcacagccggccctgggctgcctggtcaaggctacttccatctacactactgagcgggctggacaaggcgacatagnnnnnnnnnnnnnnnnnnnnnnnnnnnnnnnnnnn

SEQ ID NO: 68107 - DNA, 592 bp, Homo sapiens
  misc_feature: GYAE6OF02H3LFT.37.37.D04.1.454.CMB.1.raw
  modified_base (204)..(204): a, c, t, g, unknown or other
  misc_feature (204)..(204): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
  modified_base (583)..(583): a, c, t, g, unknown or other
  misc_feature (583)..(583): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctcgaaggggaaangccaccctctcctgcagggccagtcagagtgtagcagcaacttgcctggtaccngcagaacctggccaggctccaggcctccnatctagtggtnctactccacgaggccagtgtacncccagccgtaggttcaggtcgacgtaggtcgggtactggggacaggtacgtttccaacgttcctaccgacctataccgagcgacgccgtgacctagtctaaggtaagttagttttcgacttttagttttacttcgttagtctaggtactaagttaattaacgttcgtcgtacccttcgtacggtcggtaacgttccgaaccgtacggaccgtaagggtaacgtaactacgaaaccgtacgttggtcggactcgacctaactntaccgttcg

SEQ ID NO: 68108 - DNA, 734 bp, Homo sapiens
  misc_feature: GYAE6OF02GR17D.37.37.D04.1.454.CMB.1.raw
  modified_base (335)..(335): a, c, t, g, unknown or other
  misc_feature (335)..(335): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctctgcaggcttctggttatactttagctaattatggtatacgaacgttgggtgacgacacggcccccgtggaccaaggccagtaggaggtggagtgggagtgactnagcgtacttaacaataactaaacacacacttaatcgacaacgtaacggtaacgttaccggaacggggtacaagggacgtacccgtaacccgtacggtaaccccaacgaacgtactaaaccgtaccgaacccgtaacggaccggtaacctaacccgaaccgtacccgttaaaccgacggttaacgggaacggtaccggtagggaaaccgggtacggccgttacgggaacgtacgtaccgtacggaacccgtaacggtaacccgggttccgtttaacggttttacgtaggtaccggtaggtaaacggtaacgttaacgtaagttaaacgttaggttttaacggttaaacgttccgggtaaaccggtttaccgggtaccggggggaaccctaacccgggggg

SEQ ID NO: 68109 - DNA, 747 bp, Homo sapiens
  misc_feature: GYAE6OF02JSFO6.37.37.D04.1.454.CMB.1.raw
tcagtagtgtagatcacgaccggtgctcgatttagtagcatactgttgggtttggggacccaaaaccacacccctccttgggagaatcccctagatcacagctcctcaccatggactggacctggagcatcctttcctggtggcagcagcaacaggtgcccactctcaggttcagctggtgcagtctggagctgaggtgaagagcgtgggcctcgagtgaaggtctcctgcgaaggtcttcgtaggttacttacctttagactaattagtggtatactaacgtgggtgacgacgacggtccccgtaggaacgacggtccagtcgtaggtggaggtggtacgtgggatcgagccgtattaacgaaattaacgtaacacaacgtaactagtacgacaacgtaacgtaacgttaccgaacggggtacaaggtaccgtacccgtaacccgtacgaaacccgtaacgaaacgtaaccgttaaaccgaacgttaacccgaacggtaaaccgtaaccgaaaccgtaaccgaccccgttaaacgttaacggaggttaccgaaccgtaggaacgggtaaccgaccggttagaaccggtactaaccggtacgaaccgtaccggtaccggttacccggtttagttaccggttcgacggtaaccggtaaggtaacggttaacgtaagttaacgtttaaggttacggtaacggttaccggtaacgttacccggggttacggggtacccggtaaacccggg

SEQ ID NO: 68110 - DNA, 859 bp, Homo sapiens
  misc_feature: GYAE6OF02IC8H4.37.37.D04.1.454.CMB.1.raw
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctccagactaccacgtggagaaatagtgatgacgcagtctccagccacctgtctgngtctcgagggaancgccacctcnctgcagggccagtcagagttgtagcagctaacgttacgccgttggtaccagaccaagtaaaccctcggaccccgacggcctccccgagggtccctcccgtcacgttgtacgttcgggtcacctaccgtacccgaacggccgggtaccctacggttacggttaccctacccgacggtacccgtaggggttccgacgggttcgggtacgtaagggggtccggggaacgttacgggggaacttaacggggtacgtttaccgtaacggttacctaaaacccggtagtccggtaacggcgaccggttcccgtacggaccgttacgggttactaacgggttaacgtttaaggtttttacgggtttaagtttttaccgttttccgtacggtttaaccgacggtttacggtaacggttttacgttttcccgggttaccggttaccgggtacccggttttaccgggtacccgggttttacccgggtacccgggggttaaacgggtaaacccgggttaacgggggttaaccgtaaaccggttaaaccgggtaaacgttaaccgggttaaccgggtccggtaacgttaccggtaacccgttacccgtaacggtttcccttacgggtttccctttaccgttaccccgtttaacccccgg

SEQ ID NO: 68111 - DNA, 648 bp, Homo sapiens
  misc_feature: GYAE6OF02FQ4MT.37.37.D04.1.454.CMB.1.raw
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (417)..(417): a, c, t, g, unknown or other
  misc_feature (417)..(417): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtggaaggtctcctgcaaggcttcgtggttataccgtttagctaattagtgtatcgaactgggtgcgacgacggcccctggacgaacggccaaggtgaggtggagtgggatggactcgacgtcgacttaanaataactaacacacactancgacanaggtaacgtcgaagggcaggactccaaccgtgacccaanacgaacactactaccgaacgacgacctaacgacgtaccctaagtacgtacggacggacgtagggaacggtacgtccgtaaggtacgtacgttcggtaacggaccgtaaccggtaccggtaccgtttaggttttacgtcgttacgggacgtaaggaaccggttagaaggtaactttaaggttacgttaaggtaccgtaacggttaccgggtaggggaccccggtaaccgggg

SEQ ID NO: 68112 - DNA, 659 bp, Homo sapiens
  misc_feature: GYAE6OF02JXA9I.37.37.D04.1.454.CMB.1.raw
  modified_base (198)..(198): a, c, t, g, unknown or other
  misc_feature (198)..(198): n is a, c, g, or t
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
tcagtagtgtagatcacgaccggtgctcgatttagtagcatactgttgggtttggggtacccgaaaaaccaaccacccctccttcgggagaatcccctagatcacagctcctcaccatggactggacctggagcatcctttcctggtgcagcagcaacaggtcgcccactcctcaggttcagctggtgcagtctgganctggaggtgaagaaggccgtggggcctcgagtgaacggtctccgtgacgaaggcttcgttggttactacctttagctaattagtggtatctaacgttgggtcgccgtaacgcggtacccccgtgggaccaacggccagtgagtggacgtgggacgtggattcgaggtacgccttaagaaattaaactaacgacctanaaccgtntacgacgaacacgtaacgttcggaacggcgaacgagcgtaaccctcgaccacgagatacataccagacacgtaccacgacctacagtcgagtaccgtaggaccggaagtccgaggtacgtatacgtacggaaccgtcggacccggtaccgtttacgtttaccgtaggttacgcgggaaagtacggtaaccgaagttaacgttaagttacgtaacggttacgggaccgtttacggccggggtaaccctaacccggggg

SEQ ID NO: 68113 - DNA, 620 bp, Homo sapiens
  misc_feature: GYAE6OF02I7CL7.37.37.D04.1.454.CMB.1.raw
  modified_base (279)..(279): a, c, t, g, unknown or other
  misc_feature (279)..(279): n is a, c, g, or t
  modified_base (369)..(369): a, c, t, g, unknown or other
  misc_feature (369)..(369): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
tcagtagtgtagatcacgaccggtgctcgatttagtagcatactgttgggtttggggacccaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggctcgagtgaaggtctcctgcaggcttctggttataccttagctaattacgtggtatcaacgtgggngtcgtacacggccctggacaaggccaagtgaggtcggagtagggagtggactcgagcgtcttacgaataataactacactactatgacanacgagttacaggcagataccacctaggaccaagacgataacactacccaacgagacaacgacgacgtaacagttacggganacgtacgngggacncccgtagacggatcgtaacggaccgtaaccggacggtacccggttagttttaaccgtgttaacgggacccgttaaggtaacgttaacgaaggttaagttagttaggttaaaccgtaggtaacccgtaaggttacgggggtacccgttaaaccgggg

SEQ ID NO: 68114 - DNA, 658 bp, Homo sapiens
  misc_feature: GYAE6OF02GLMOY.37.37.D04.1.454.CMB.1.raw
  modified_base (490)..(490): a, c, t, g, unknown or other
  misc_feature (490)..(490): n is a, c, g, or t
tcagtagtgtagatcacgaccggtgctcgatttagtagcatactgttgggtttggggacccaaaaaaccacacccctcctttgggagaatcccctagatcacagctcctcaccatggactggacctggagcatccttttcctggtggcagcagcaacaggtgcccactctcaggttcagctggtgcagtctggagctgaggtgaagaagccgtggggcctgagtgaacggtctccgtgacaaggtcttcgtggttactaccgtttagactaattagtgtatacgaacgtgggtgacgacgacggcccgtaggacgacggcagtcggaggtggagtgggatggatcgagtcgtacttaacaattaaacaaccacaactactatcgacaacgtaaggtaacgtccgaaggacaacggtacgtcccgaccgtacgaacccaacgaagtaactaacaacgtacccgaacgacgaccaacgaccgtacccgtaanacggtcgggaacgtacggtagggaacggaccggtaccgtaggacgtacgttacgtacggaccgtaccggtaccggttcgtttacgtttcgtaggtacggtacggtaagtacgtacgaagttagttagttaggtaagttacggacgtacgggtaccgggacgtaaccgg

SEQ ID NO: 68115 - DNA, 859 bp, Homo sapiens
  misc_feature: GYAE6OF02FZ4D4.37.37.D04.1.454.CMB.1.raw
  modified_base (355)..(355): a, c, t, g, unknown or other
  misc_feature (355)..(355): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacgttcgccgtggtaccagcaagaaacctggaccaggcctccccgaggccttcctcattctagtggtgacctactcccaaccggtacgggaccctacgttcgggttaacncccccgaaggtccgtaacggtttccgaggtacgggcgtaggggttcggggtccgttagggggaactaacgggtagttttcccgaaacccgtttcctccccgaaaccctacgtacccgtaagggacccgtaaccgggcccgttaccggaccgttaagtttacccgttaagggtaaacgttttaacggtttttttacggaccgtttttaagtttttttacttttccgtttacgggttacccgtaagttacgtttaaagtttaaaccggttttaaacgttttaccggttaccgggtttacccccttttaaccggtaacccggggttttacgggtttaacccggggttaccccggggttaacgggtaaaccgggggtaacccggttaaacgggggtttaaaccggtaaaaccggtttaacccgaaaaacccggggttacgtttaacggggttcgggtacccgttaaccgggtaccctaaccccggttacggtttaccgttttacccgg

SEQ ID NO: 68116 - DNA, 759 bp, Homo sapiens
  misc_feature: GYAE6OF02ITSZQ.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagcgtggtgcagtctggagctgaggtgaagaagccgtggggcctcagtgaacggtctccgtgcaaggtcttcgtggttatacctttagactaattagtggtatcgtaactggggtagccgtaacgacggtccccccgtggaaccgaaggggtaccccaagttggtaacggttggggtaaacgttagggggaacttcggggtaataccgaacggtccgtacgtttaacgtaaaattaacgtaaaccaacctaacaaccctagttacgactaaacgaggtaaacgttacccgaaggggtacaggtaacgtcccaacccgtggaaccccaacgtaagacgtaaccgtacttacccgaacggacgaacccaaccgacgttaccctaacgtaagtcgggtaccaccgggttaggaacggtacggtaccctaaggaacgtaacgttccgtaacgaacccgggtaccgaaccgggttacccgttagttttaccggtagttcggtaaccggaaggttaaccggacgtaagtaaacgttagttacgttaacgtcgggaaccgtacggttacccggggacccgttaaaccgggg

SEQ ID NO: 68117 - DNA, 617 bp, Homo sapiens
  misc_feature: GYAE6OF02GHXMS.37.37.D04.1.454.CMB.1.raw
  modified_base (288)..(288): a, c, t, g, unknown or other
  misc_feature (288)..(288): n is a, c, g, or t
  modified_base (486)..(486): a, c, t, g, unknown or other
  misc_feature (486)..(486): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctcgtggcagcagcaacaggtgcccactctcaggttcagctggtgcagtctggagctgaggtgaagaagccgtggggcctcaggtgaaggtctcctgcaaggcttctggttatacctttagctaattatggtatcaacgtgggtgcgacncggcccctggacaacggccagtgagtggagtgggatgggatcgagcgtacttaacaataataacacaactactatacgacacgaggtaacgttccgaagggtcaggagtacccaaccgtagacccaacgagaactaccactacccgaacgacgacctaaccgacgtaccctacagttcgggagctggacggacgtacnggtaagtacttcggtacgaccgaccggtaccgggtaccgtttaggttttaccgtggtaggtcggtaaggtacgtaacgtaagtaactttagttagtaagtcggtaactacgggtacgggaccgtaaccggg

SEQ ID NO: 68118 - DNA, 693 bp, Homo sapiens
  misc_feature: GYAE6OF02HEUW0.37.37.D04.1.454.CMB.1.raw
  modified_base (294)..(294): a, c, t, g, unknown or other
  misc_feature (294)..(294): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcgagtagaaggtcctcctgacaaggtcttcgttggttacttacctttagactaattagtggtatcaacgtgggtncgacgacggccctaggacaggccagtgtaggtaggagtgggagtgggatcgacggctacgttaacaaattaaacaaacactaactactaactacaacgagtaacgttccggaagggtaccaaggtaccgtacctacccgtacgaaccacgtaacgaactacaccgtaccgacgacgaccaacacgtaccctaacgtagtacgggacgtacgcgggtaacggcggtactacggacgtacgtacggtacggtaaccgtaccggtaacccgggttccggttttaacgttttacgtggtacgtacgggtaacgtaacggtaacgtaaggtaaagtttacgttaggttaagtacgggttaccgttaacgggacccggggtaccggtaaccggggttaaccccgg

SEQ ID NO: 68119 - DNA, 647 bp, Homo sapiens
  misc_feature: GYAE6OF02HNR51.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctcagtgaaggtctctgcaaggcttcgtggttatacctttagctaattagtggtatcaacgtgggtgcgacgacggcccctggacaaggccagtgagtggagtgggatggatcgagcgtcgttaacgaataactaacgacaacgtactagtcgacaagacgtaacggttccgaagggacaacggtacgtacccaacccgtacggacctaacgaagtaactaacgaaccgtaccgaaccgaacgtaccgaacgacgaccctaacgacgttaggacgtcgtacggaggacgccgtaggacgtagtaccgaggaaccgaccggacggttccgtttaggtttaccgtgggtacgacgggtaagtacgttaacgaagttaatttagttaggttaaggtcggtaacggttacggtccggggaccgttaacccgggg

SEQ ID NO: 68120 - DNA, 598 bp, Homo sapiens
  misc_feature: GYAE6OF02I4QNJ.37.37.D04.1.454.CMB.1.raw
  modified_base (204)..(204): a, c, t, g, unknown or other
  misc_feature (204)..(204): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcagaaacctggccaggcctcccgaggcctcctcatctagtggtcgcactccaccgacggccacgtggtactcccagccaggttcagtcggacaggtcgggtctaggggactaggtacgttcacttctaccacctactacacgacacgtccgtgactagtctagtaacgttattttgacttagttttattctagtactagtactagttaattaagtttacgtcggtaccttaccgttacggtcggtaacggttaccggaccgtacgggaaccgtaaggggtaacgtaaacgtaacgaaacgtacgtaggtacgtcgtagacctaacgagttccttacg

SEQ ID NO: 68121 - DNA, 705 bp, Homo sapiens
  misc_feature: GYAE6OF02FWBXC.37.37.D04.1.454.CMB.1.raw
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
  modified_base (496)..(496): a, c, t, g, unknown or other
  misc_feature (496)..(496): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaagccgtggggcctnagtgaaggtctctgcaaggcttcgtggttatactttagctaattagtggtatcaacgtgggtnacgagacggccccgtggaacaacggccagtgaggtaggagtggggagtagggactcaggccgtacttaacgaaataaactaaccgaacaacaacgttaagcgtacgaacgtaagtaacgttaccgaaggggactaaggacgttacccaacccgtacgaacctaaacgaacgtaactaaccgaactaccgaacgacgaccaacgcgacccttanagttcggagcgtaggtaaggacgtccgtaggacgtacttacgaacgtaacccggtacggtaacccggttttcggtttaaccgtttacgggttaggaccggtaggtaaaccggttaaccggtaaacgtaaagttaagtttttaaggtaacggtttaaggttaacccggttacggtacccgggggttacccggtacgggttaaaccccggg

SEQ ID NO: 68122 - DNA, 627 bp, Homo sapiens
  misc_feature: GYAE6OF02JXE5P.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaggtctcctgcgaaggcttctagttatacctttagactaattagtgtatctaacgtgggtgtcgacacggccccgtaggacgaacggccgagtgacggtggagtgggagtggtatcgagcgtacttaacgaataataacacacaatagcgacaacgaagtaacgtacgaggtacaggacgtacctacccgtacgaccaacaagactaacactaccgaacgtacaccgaactacgaccgtaactaggtacgagtacgtaggacggtacgtacgtagaatacgtacgtacggtaccgaacgtaccgggttacgtttagttaaccgtggtacggacgtaacgtacgttaagagttaacttagtaacgtacgtacggtacctacgggtacgggtaccggtaacccgg

SEQ ID NO: 68123 - DNA, 622 bp, Homo sapiens
  misc_feature: GYAE6OF02F38ZW.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaactgggtgcgacaggccctggacaaggccatgagtggatgggatggatcgagcgtacttacgaaataagtaacacacactagcacagaagtacgtaggacgacgagtacgaccctacgacaaccagacgtacactactacgaacgacgaacacgaccgtactaacgaggtaggactaggaggacgaccgttacggacgagtacgtacgaacgggaacgaccggtaccgttacggttttaccgtttaggtacggtacggaacggtaaggtacgttaaacggaaagtttagttaggttaacgttaacggtaccggttaacggtacggggttaccggaaccggtaacccgggg

SEQ ID NO: 68124 - DNA, 250 bp, Homo sapiens; identical to SEQ ID NO: 67462
  misc_feature: GYAE6OF02FLOAK.37.37.D04.1.454.CMB.1.raw
  modified_base (247)..(250): a, c, t, g, unknown or other
  misc_feature (247)..(250): n is a, c, g, or t

SEQ ID NO: 68125 - DNA, 607 bp, Homo sapiens
  misc_feature: GYAE6OF02JD76S.37.37.D04.1.454.CMB.1.raw
  modified_base (287)..(287): a, c, t, g, unknown or other
  misc_feature (287)..(287): n is a, c, g, or t
  modified_base (364)..(364): a, c, t, g, unknown or other
  misc_feature (364)..(364): n is a, c, g, or t
  modified_base (528)..(528): a, c, t, g, unknown or other
  misc_feature (528)..(528): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattatggtatcaacgtgggtgcgtacnggtcccctggacaaggccaagtgagtggagtgggataggatcgagcgtacttaacgaattaataacacacacgttancgacacgaagaacgttcgagggtacaggacgttaccaacccgtgaaccctaacgacggtaacttaacacctaccgaacgacgacaaccacgtacctaacagtcgacgcgtagaggtacgcgtagacgtatcgaggacgacgtacgggtccgtttagttttacgnggttcggacggtaggtactaacgaagtaacgttagttacggtaagttacggtacgtacggttacgggacgtaaccgggg

SEQ ID NO: 68126 - DNA, 862 bp, Homo sapiens
  misc_feature: GYAE6OF02JRHT2.37.37.D04.1.454.CMB.1.raw
tcagtagtgtagatcacgaccggtgctcgatttagtagcatactgttgggtttggggacccaaaaccacaccctccttgggagaatccctagatcacagctcctcaccatggactggacctggagcatccttttcctggtggcagcagcaacaggtcgcccactctcaggttcagctggtcgcagtctggagtctggaggtgaagaacgccgtggggcctcgaggtgtaacgggtcttcccgtggaccgtaaggtcctttacgttacgggtttaacttaacccgtttttaggaccttaaaagttttacgttacgggttaactaccgttaaaccggttgggggttacgtaccggaaccgtacccggggtcccccgttagggggacctaaaccgggtccctaaggttcggtaagggttcgggaaggtaggggtagtacgggtacgtacgtaacggtccggtaccttaaacggtaaacttaaacgttaacccaaacgtaccaaacgtttagaccgacgtaacgaaaacggttaaccggttaccgaaggggtacctaagggtaccgtaccctaacccggtacggtaaccaacctaaaggtaaccctaactaaccgtaccccgtaaacggaccgtaacccgaaccgaccgttacccgtaaacgtacggtaacggtaccgacggtaacggaacgggtaaacggtcccgtaaagtaaccggtaccgtacggttaacgggaaacccggtaccggtaaccgggtttaccgtttaacgggtttaccgtagttccggaacggtaacgtacgttaagacgttaaacgttagttacggttagtaccgtacggtacgggacgggtaacccgtacgg

SEQ ID NO: 68127 - DNA, 617 bp, Homo sapiens
  misc_feature: GYAE6OF02IRKL2.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattagtggtatcaactgggtgcgacacggcccctggacaaggccatgagtggagtgggatggatcgagcgctacaataataacacacactatgacacaagagttcgaggcagagtcacctgaccacagacacactaccacgacgaccacagaccctaacgagtacggacgtacgtaggaacggacgccgtagaacgtagttaccgtacggaaccgaaccgtaccggtaccgtttaggtttttaccgtggttacggaccggtaaggtaaacggttaaccgaaggttaaactttaagtttacggttaaaggttacgggttaaccgtttaacgggtacgggggtacccgtaaacccggggg

SEQ ID NO: 68128 - DNA, 713 bp, Homo sapiens
  misc_feature: GYAE6OF02FYKYU.37.37.D04.1.454.CMB.1.raw
tcagtagtgtagatcacgaccggtgctcgatttagtagcatactgttggggtttgggggacccaaaaaccacacccctccttagggagaatccctagatcacagtctcctcaccatggactggacctggacgcatccttttcctggtggcagcagcaacagggtgccccgactctctaggttcagcgtggtgcagtctggagtctgaggtgaagagcgtgggcctcagtgagtctctgcaggcttgtggtactacttgctaagttagtgtatcaacgtggtgacgagacggtccctaggaacgaggtcgagttcgaggtaggtagtcggggtatgggatacgacggtctaccgtttaaacaaacgttaaagtaaaccacctaacgtaaccgttaatacgactaacggaaacgtaaccggttacgtaacgggacctaagggtactacccgtaacccgtacggtaaccctaaacgacgaaactaccggtactaacccggacgtacgtaacccgtaaccgacgtacctaacgtacggtacgggagtaccgtgtaaccggtacgttaccgtagttacggtacttcggtaacggaccgtaaccaccgggttacgtttagtttccggtagtcgggaaccgtagggtaacgtaacgtaaggtaacgtttaggttaacgttacggtacggtaaccgttcgggtacggtaccgtaacccggg

SEQ ID NO: 68129 - DNA, 251 bp, Homo sapiens
  misc_feature: GYAE6OF02H5PVE.37.37.D04.1.454.CMB.1.raw
  modified_base (246)..(251): a, c, t, g, unknown or other
  misc_feature (246)..(251): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctgcctggtcaaggctacttccatctacactactgagcgggctggcaaggcgcatagnnnnnn

SEQ ID NO: 68130 - DNA, 641 bp, Homo sapiens
  misc_feature: GYAE6OF02IV5FH.37.37.D04.1.454.CMB.1.raw
  modified_base (234)..(234): a, c, t, g, unknown or other
  misc_feature (234)..(234): n is a, c, g, or t
  modified_base (310)..(310): a, c, t, g, unknown or other
  misc_feature (310)..(310): n is a, c, g, or t
  modified_base (371)..(371): a, c, t, g, unknown or other
  misc_feature (371)..(371): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgcccaccctctcctgcagggccagtcagngtgttagcagcaacttgcctggtaccaggcaacgaaaccgtggccacggcctcccgaggctcctcatctagtggtnctactcccaccgagggcctacgtggtactcccagtccaggttcaggtgcgtaggtcgggtngggacaggtgttcactctaccgaacctctaccagccgacgtcccgtagtccgtagtccgttaggtaaaccgttacgttttcggactttaagtttttactttcgtaggttaccagtactagttaacttaacgttacgtcggccttaccgttacggtacgggtaccgtttcgggacccggtaaggggtaccctaaggggtacggtaaactaaccggtaaacggtaccgttggtacggtaccgtacggaacctaaccgtacgttccgttacgg

SEQ ID NO: 68131 - DNA, 635 bp, Homo sapiens
  misc_feature: GYAE6OF02HM7PH.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctcaggtgaagtctcctgcaaggcttcgtggttatacctttagctaattatggtatacaacgtgggtgcgacgaggtcccctggaacaaggccagtcgagtggagtgggatgggactcgacggcgtacttaacgaataaacgtaacacactactagtcgacaacgaagtaacgttaccgagggacaggtacgtaccaccctacggaccacgaagactacgactaccgacgacaccaacgacgacccttagacgtagggacgcgtaggacggacgtccaggtagactacgtacgaaccgtaccggtaccggtaccgttttgtttacgtggtcgacgggtaagtaccggtaagtaacgttaacgttaagttacgttaacgtacggttaacggttacgggtaccggggtaaccctaaccgggg

SEQ ID NO: 68132 - DNA, 261 bp, Homo sapiens; identical to SEQ ID NO: 68100
  misc_feature: GYAE6OF02IQU1X.37.37.D04.1.454.CMB.1.raw
  modified_base (247)..(261): a, c, t, g, unknown or other
  misc_feature (247)..(261): n is a, c, g, or t

SEQ ID NO: 68133 - DNA, 825 bp, Homo sapiens
  misc_feature: GYAE6OF02IVO7K.37.37.D04.1.454.CMB.1.raw
  modified_base (354)..(354): a, c, t, g, unknown or other
  misc_feature (354)..(354): n is a, c, g, or t
tcagtagtgtagatcacgaccggtgctcgatttagtagcatactgttgggtttggggagaactgctcagttacggacccagacggaaccatggaagccccagcgcagcttctcttcctcctgctactctggcctcccagataccactggagaaatagtgatgacgcagtctccagccaccctgtctgtgctccgagggaaagacgccaaccctctccgtgaccagggcctacgtccagtaaggttcgttaagccgagaccgtaacctttagcccgtggtaacctagccaacggaaaaccgtcggaccgacggtacctaccccgaaggtcctaccttcagttcctaagtggtacnccgtactcccaaccgacgggacctaacgtcggtaaacctcccgaagtacccgaacggtttacaacggttcgggaccgtacggtcggggttaaccgtgggggtaacctacggtacgtttaccgtacccgttaccgtccctaacccgtaacgtaccgaacgtcccgtaacggtcccctgggtaccctacgggttactagggtaaaccgtttagttttacggacgttttaacggtttttactttaacgtttcgggtacaacggttacctttaaaaggtttaactttaaaccgtttacccggtaccggttacccgttaacccggtttaacgtacgggtttacccgttacccgggtacccggtaacggggtaaacccggtaaggggtaaccggttaaaccttaaacgggtaaaccgtacggtaaaccgtttcggaacgggttaccctcggtaacccttaccggtaactttcccggg

SEQ ID NO: 68134 - DNA, 602 bp, Homo sapiens
  misc_feature: GYAE6OF02GJ4HS.37.37.D04.1.454.CMB.1.raw
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (499)..(499): a, c, t, g, unknown or other
  misc_feature (499)..(499): n is a, c, g, or t
  modified_base (525)..(525): a, c, t, g, unknown or other
  misc_feature (525)..(525): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtctggagctggagtgaagagcgtgggcctgagtgaggtctccgtgacaaggtcttcgtggttactaccgtttagactaattagtggtactacaacggttgggtcgcgaaccgccggtccccgtaggaaccgaacggcctagtacggaggtggagtggggagtaggactacgaaggcttacttaagaaaataacaacacaacactatcgactaacgagtacgtcgaaggcagactaccaccgtanaccanagactacaacgtcagacacacgacgccttaagagtggacnacggtagactcgagactntacgngaccgtacgtcgtacgttttagtcgnggtactacggaaggtaacgtacgtaagttaagttagttaggaagtcggtaaccggtaggtccgggaacgtaaccggg

SEQ ID NO: 68135 - DNA, 641 bp, Homo sapiens
  misc_feature: GYAE6OF02JZ0GP.37.37.D04.1.454.CMB.1.raw
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (362)..(362): a, c, t, g, unknown or other
  misc_feature (362)..(362): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttactggttatacctttagctaattatggtactcaactgggtncgacaggcccctggtacaaggccagngacgtggagtgggactgggatcagtcgcttagaataataacgactacgactatncaacaagaacttccgaagggtcaaggtacggtaccacccgttaggaaccacgaacgtataacacgtaccaacgagaccacaacgcctaacgacgtcggtacgacgtaggacgggtaccgcgttaacggacgtacgtcgtaacggaacgtaccgtaaaccggtccgtttacgtttttaccggagttaccggttaacggaacggtacggttaaccaaaggttacctaagtttacggtaacgtacggttaacgtacgggtacggggaccgttaaacccgggg

SEQ ID NO: 68136 - DNA, 632 bp, Homo sapiens
  misc_feature: GYAE6OF02IGUJR.37.37.D04.1.454.CMB.1.raw
  modified_base (400)..(400): a, c, t, g, unknown or other
  misc_feature (400)..(400): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (526)..(526): a, c, t, g, unknown or other
  misc_feature (526)..(526): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcgaggttcagctggtgcagtctggagctggaggtagaagaagccgtggggcctacgagtggaacggtctccgtgacgaaggtcttcgtggttattaccgtttagacttaattagtggtaatacgacggttgggtcgacgaacgccggtccccgtagggaaccgaacggcctagtggaggtgggagtgggagtggactcgagtcgtacttaacaaataactaacacacactangacacgaagtacgtcgaggacagacgtcacctagaccaganacacacncacganacacacacctanagagncgaggaggcgacgtagagatcgacgacgaccggtcggttccgtttagttttccgngggtacgtacggtaacggtaacgtaagtaaggttaatttaagggtttacggtaacggttacgggtaaccggtttaccggggtccgggtaacccgggtaaaccgggg

SEQ ID NO: 68137 - DNA, 677 bp, Homo sapiens
  misc_feature: GYAE6OF02FN7A0.37.37.D04.1.454.CMB.1.raw
  modified_base (204)..(204): a, c, t, g, unknown or other
  misc_feature (204)..(204): n is a, c, g, or t
tcagtagtgtagatcacgaccggtgctcgatttagtagcatactgttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanacgccacctctcctgcagggccagtcagagtgttagcagctaacgttacgccttaggtaccagcaacgaaacctcggaccaggcctccccgagggcctccctacgtacttcttaagtcggtcgacctactcccgaaccgacgggccctaacgttcggtacctccccgaggtcccgtaggttccgaaggttcggggactacggggtcgggtacgtcggggaacaggtaacggtttcaccgttactaccgacctatcgaggcctacgcccgtagccgtacgtctaacggtaaacgttagtttttacgacgtttagttttactttcgtgtacctagtactaagttaattaacgttaacttccggtaccttacgttaccggtacggttacggttaccgaccggacgggaacgtaacgggaggtaaacgtaacgtaaaccgtaggtcggtacgacgtagacccgaacgtctgttaccg

SEQ ID NO: 68138 - DNA, 765 bp, Homo sapiens
  misc_feature: GYAE6OF02HAJW4.37.37.D04.1.454.CMB.1.raw
tcagtagtgtagatcacgaccggtgctcgatttagtagcatactgttgggtttggggacccaaaaaccacaccctccttgggagaatccctagatcacagctcctcaccatggactggacctggagcatccttttcctggtggcagcagcaacaggtgccactctcaggttcagctggtgcagtctggagctgagtgaagaagcctgggcctcgagtgaacggtctcctgacgtaaggccttcgtggttactaccgttttagctaatttagtggttactcaacgttgggtcgtcgaccgaggtcccccttgggaaccaacgggcccaagtcggagttgggaagtggggaacttggatcaggtccgacttaaccaaagttaactaaaccacctaacgaccttaatcggacacgtaagtaacgttcccgaagggcccaagggtaccgtcaaccccgttagaacccgaacgtaacggtaaacttaaacccgaacgttaacccgaacggtaaccgaccgtaaacccgtaaccggtaacccgttaacgaaaccggtttccgggaaacgtcccggttaagggaaccgggtacggttacccgtaggaaacgtacgttacgttaacgggaaccgtaaccgtaccgggtttacccgtttacgttttacccgtggtaacggtaccggtaacggtaaggttaacgaacgttaaagtttcgttaaggttaaccgttaggtacctttacggggttacgggacccggttaaacccgggg

SEQ ID NO: 68139 - DNA, 282 bp, Homo sapiens
  misc_feature: GYAE6OF02H56VG.37.37.D04.1.454.CMB.1.raw
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (259)..(261): a, c, t, g, unknown or other
  misc_feature (259)..(261): n is a, c, g, or t
  modified_base (263)..(268): a, c, t, g, unknown or other
  misc_feature (263)..(268): n is a, c, g, or t
  modified_base (270)..(282): a, c, t, g, unknown or other
  misc_feature (270)..(282): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggccaccctcctccaagagcaccctcgtgggggcacgaggccggcccgtgggctgcctggtcaaggtctaaccttcatctacactactgacggcgggntggacaaggccgnanagnnnannnnnngnnnnnnnnnnnnn

SEQ ID NO: 68140 - DNA, 768 bp, Homo sapiens
  misc_feature: GYAE6OF02F17Z4.37.37.D04.1.454.CMB.1.raw
  modified_base (183)..(183): a, c, t, g, unknown or other
  misc_feature (183)..(183): n is a, c, g, or t
  modified_base (219)..(219): a, c, t, g, unknown or other
  misc_feature (219)..(219): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtncagtctggagctgaggtgaagaagccctgggccctnagttagaacggtctacctgcaaggtccttacgtggttaacttacctttaggactaagtttacgtagggtaactaccgtaaaccggttgggttcggccgtaaaccggtacgggtaccccccgttagggaacccgaaacggtcccgtaaagttcggtaaggttcgggtaagttgggggtaacttaggggcttacggagttaccggtaccttaaacgaattaaacgtaaacctaccgaaccgtaccttaagtaccgtaaccgtaacgtaacggtaacggttaccgaacgggctaacgggtacgtacccaccgttacgaacctaacgacgttaagaaccctatacccgaacgtacgaaccgtaccgaacgacccttacgagttacggacggtcgacggacgggaacgttccggaagtacggtacttacggtaaccgacgttaacccggacgtttcccgttagtttacgtggacgtaccgggaagttaacgccggtaaagttactttaggtacgtaaggtacgttaacctcgggtaccgggaaccgtacccggg

SEQ ID NO: 68141 - DNA, 793 bp, Homo sapiens
  misc_feature: GYAE6OF02I7BLT.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagacgccgtgggcctcgagtgaagtcctccgtgacaaggtcttcgtaggttactaccgtttagacctaatttagtggttaataccgaacggttggggtgccggaaccgaccggtccccccgtagggaaccaacgggtccctaaggtcggtaaggtacggggaaggttggggtaagttacgggtaacgttacggaaccggtaccgttaaccttaaacgtaaaacttaaaagttaaacccaaccgtaaaccgtaacttaaggtccgtaaaccaacgtaaacggttaaccgttaccgggaaacggccgtaaacggtaccgtaccctacccggtaacgaacccgaaccgtaagtacctaacctaccgtaccgaacgtaaccgaccgtaaccgtacgtaccccttaagtaggtacgtaacgcgttaacgggacggacccgtcgtaaggaccgtagtaccggaccgaacgggtacccgtaccgggttactttacggtttaccgaggtacgacgtaacggtaaactaacggtaagttaagtttaggtacgtaacggttaggtaccggtacggggtccggggtaacccttaacccgggg

SEQ ID NO: 68142 - DNA, 268 bp, Homo sapiens
  misc_feature: GYAE6OF02GPNZJ.37.37.D04.1.454.CMB.1.raw
  modified_base (249)..(268): a, c, t, g, unknown or other
  misc_feature (249)..(268): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctcgtgggggcacagcggccctgggctgcctggtcaaggactacttccatctacactacgtgagcggctggacaaggcgcatagnnnnnnnnnnnnnnnnnnnn

SEQ ID NO: 68143 - DNA, 620 bp, Homo sapiens
  misc_feature: GYAE6OF02G3DKO.37.37.D04.1.454.CMB.1.raw
  modified_base (289)..(289): a, c, t, g, unknown or other
  misc_feature (289)..(289): n is a, c, g, or t
  modified_base (313)..(313): a, c, t, g, unknown or other
  misc_feature (313)..(313): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (376)..(376): a, c, t, g, unknown or other
  misc_feature (376)..(376): n is a, c, g, or t
  modified_base (534)..(534): a, c, t, g, unknown or other
  misc_feature (534)..(534): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcaggtgaacggtctcctgcaacggcttcgtggttatacctttagcaattatggtatcaacgtgggtgcgtanacggtccccgagaacaggcctagngtagtcggagtgggatggatacgngcgtacttaanaattaaataaccaacacatatgaccaanacgtaacgttcgagggcaacggagtaccacccgtacgaccacagtactacacctacgacgagtccaacctacgacctcgagtagacgtctagggacgggactcgagtaagacgttacgtacggaccggaacgtccggttaaccggttgttttaaccgnggttacggaggtaacggtaggttaacaaggttaacgttagtttaggtacgttaggacccgtaaggtcccggggacgtaacccgggg

SEQ ID NO: 68144 - DNA, 594 bp, Homo sapiens
  misc_feature: GYAE6OF02G8V9Z.37.37.D04.1.454.CMB.1.raw
  modified_base (282)..(282): a, c, t, g, unknown or other
  misc_feature (282)..(282): n is a, c, g, or t
  modified_base (517)..(517): a, c, t, g, unknown or other
  misc_feature (517)..(517): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctgggcctcagtgaaggtctcctgcaaggcttctggttataccgtttagctaattatggtatcaacgtgggtancgacacggcccctggacaaggccagtcgagtggagtgggatggatcgagcgtctaacaataataacacacactatcgacacgaagaacgttccgagggtacaaggacgtaccacccgtagacccacaagacttaaccatacccaagtacgacaacgacgacctaacgagtcggaacgcgtagacggacgccgtaggacgtactcgtacgaccgtacgacggtccttagtttacgnggttacgaccggtaagtacgtaacgagtaacttagttacgtaagtggtaaccttacggtacgggaccgtaaccgggg

SEQ ID NO: 68145 - DNA, 633 bp, Homo sapiens
  misc_feature: GYAE6OF02IYVS8.37.37.D04.1.454.CMB.1.raw
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggtcttcgtggttactacctttagcaattatggtatcaactgggtagcgacgacggtcccccgtggacgtaacggtcagtcggaggttggaggtggggatggatcgagtcgacttacaataaataaccaanacactangcaacagtaacgtaccgagggacagacgtactacccgtcaccgacaagactaacacctaccaacgacgaccaacgacgactacatacggagctaggaggtacgccgtagagactcgtacggaaccgaacgtaccgggtccgtttagtttacgttacgtacggtacggaacggtaaccgttaaccgaaagtaacgtttaagtttaaccggtaaggttaccggtaaccggttaccggtacggggacccgtaaacccggggg

SEQ ID NO: 68146 - DNA, 689 bp, Homo sapiens
  misc_feature: GYAE6OF02IRJHM.37.37.D04.1.454.CMB.1.raw
  modified_base (373)..(373): a, c, t, g, unknown or other
  misc_feature (373)..(373): n is a, c, g, or t
tcagtagtgtagatcacgaccggtgctcgatttagtagcatactgttgggtttggggacccaaaaccacacccctccttgggagaatcccctagatcacagctcctcaccatggactggacctggagcattccttttcctggtggcagcagacaacgaggtcgcccactctcgaggttcagcgtggtgcagtcgtggagctggaggtagaagaggcgtgggcctcgagtgagtctcctgacagtcttactggttactactttagactaattagtggtactacgtaacgttgggtcacggacgacgggtcccctagggaaccgaacggcctaagtggaggtaggagtgggatggtatcgaagtcgtacgttaanaaaacgtaactaaacacctaacgtactatcggactaacgaaagtacgttacggaacgggataacggacgttaccaacccgtcgaaaccgtaagacgaaactccgaacacccggaagaacgaccaacgaaccgtacctaagtagtaacgggactacggtacggagggactccgtagacgtacgttccgaggtaaccgaccggtacggtaaccgtttgtttaccggagttcgggaaccgtaaggacgtaaactaaggttaactttagttaaccggtagtacccggttaaggtaaccgggtcggaacccggttacgggg

SEQ ID NO: 68147 - DNA, 282 bp, Homo sapiens
  misc_feature: GYAE6OF02JXVJ6.37.37.D04.1.454.CMB.1.raw
  modified_base (256)..(256): a, c, t, g, unknown or other
  misc_feature (256)..(256): n is a, c, g, or t
  modified_base (258)..(282): a, c, t, g, unknown or other
  misc_feature (258)..(282): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttcccctggcaccctcctccaagagcacctcgtgggggcacagcggcccgtgggctgcctggtcaaggactacttccacatacgtcacgtgacggcgggctaggacaaggtcgacagtagnannnnnnnnnnnnnnnnnnnnnnnnn

SEQ ID NO: 68148 - DNA, 910 bp, Homo sapiens
  misc_feature: GYAE6OF02F122R.37.37.D04.1.454.CMB.1.raw
  modified_base (192)..(192): a, c, t, g, unknown or other
  misc_feature (192)..(192): n is a, c, g, or t
  modified_base (765)..(765): a, c, t, g, unknown or other
  misc_feature (765)..(765): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtgcagcagcaacaggtgcccactctcaggttcagctggtgcagtctgganctgaggtgaagaacgccgtgggccctcaggtgaacggtctccgtgcaacggtcttcgtggttactacctttacgactaacgttatacggttactaccgtaacgtcggggttacgaccggaccgtaccgggtacccccctagggaaccctaacggaccctagttacggaaggtttacggaggttacggggtacgttacgggtaacttccgaacggtaccggttaaccttaaaccgtaaaacttaaaccggttaaaaccctaaccgtaaacccgtaaccgttaacttaccggtaaccgtaaaccgtaaaacggttaaaccggtttacccgggaacggggtaccgaacggtaaccggttacccaaccccgttacgaaacccctaacgaacgtaaaccttacccgaaccgtaccccgaaaccggtaacgtacccaaccgtaaaccgtacccttaaacgacggttacggaaccgtacctacgggaacggacgtaccggtacgtaacgtaaccgttaccgtaacggtaaacccgggtacccgttaccggggttaaccgttttacgggttttaaaccggnggttaacccgggtacggtttaaacgggaaccgttaaaccggtaaacggttaaccgttttaaaccggttttaacgggtaaaccggttaaccgggtaccccgtttaaaccgggggtacccggggtaaccccggttaaacccccgggg

SEQ ID NO: 68149 - DNA, 737 bp, Homo sapiens
  misc_feature: GYAE6OF02I1867.37.37.D04.1.454.CMB.1.raw
  modified_base (423)..(423): a, c, t, g, unknown or other
  misc_feature (423)..(423): n is a, c, g, or t
  modified_base (619)..(619): a, c, t, g, unknown or other
  misc_feature (619)..(619): n is a, c, g, or t
  modified_base (646)..(646): a, c, t, g, unknown or other
  misc_feature (646)..(646): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttcgtggtggcagcagacacgaggtcgcccactctcgtaggttcagtcgtggtcgcgtagtcgtggacgtctggaggtaggaaacggagtccggtcggggcctacgaggtacggaggtcctcgtaggacgtaacggtcttacggttcggttaacttaccttttaggaccttaatttcgtaggttactacgaaggtgggtacgccggtacgacggtcccgtaggacgaggacctagtggtacggtggaggtaggtagtaggaccttagggacggtctaaccgtttaanaaagttaaactaaacacttaaccgaactttaacgacgaaacgtaacgttaacggaacgtaccggaagggactaccggaaagtttcccctaacgaccggaacaaagtaacgtaaacttacccggaaactccgaacggaacaaccgaagtccgaactagtaacggacggacttagacggacgtacgtcgagagttacnctacggcgtaaacgtcggtaaccgttntttaacgcggagtaccggaagaacgttcgaaattaaggttacgtaaaggttccgaagttaccgggaacgggttaccggccgtttaaaccgg

SEQ ID NO: 68150 - DNA, 731 bp, Homo sapiens
  misc_feature: GYAE6OF02G8KOS.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaacgccgtggggcctcgaggtggaaggtctcctgacgaaggcttcgtggttactacctttagcaatttatggttactcaacgtgggtgcgacgaggcccctaggacacggccagtggaggtggagtgggagtggacgtacgacggtccgacttaacgaaattaaacgtaaaccaacgtacctaaacttacgtacgaccaaacgtaacggtaacggtttaccggaacggggtaccgtaacgggtaacgtacccaaccccgtacgggaaacccaacgaaacggtacctaaaccaccgttaaccccgaacggaccaccaaccgaccgtaccctaagacgttagggaacggtcctagggtaacgggacgccggttacggacgttacgtaccgtacggtaaccggaaccggtacccggttaccgttttcggtttaacgtcgggttaaggccggtaaggtacgtaacgtaaggttaaacgtttgttaaggttacgttacggtacgtaacgggtccggggaagtaaccccgggg

SEQ ID NO: 68151 - DNA, 560 bp, Homo sapiens
  misc_feature: GYAE6OF02HBSS8.37.37.D04.1.454.CMB.1.raw
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (482)..(482): a, c, t, g, unknown or other
  misc_feature (482)..(482): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagcctggggcctcagtgaaggtctcctgcaaggcttctggttatacctttagctaattatggtatcaacgtgggtgcgacacggcccctggacaaggccatgagtggatgggatggatcgagcgnttacaatacaacacacatatgacanagatccaggcagngtccacctgaccacagactacataccatgagcacagacctacagtgggactcgtacggaggacgtcctggatacgtcgtacgaacgtacgaccgggttcccgttaggtttttacnggttacgcgggtaagaacggttaacaggttaatttacgtttacggaaagttgggaaccttacggggtcgggaacccgg

SEQ ID NO: 68152 - DNA, 758 bp, Homo sapiens
  misc_feature: GYAE6OF02HTDEU.37.37.D04.1.454.CMB.1.raw
  modified_base (195)..(195): a, c, t, g, unknown or other
  misc_feature (195)..(195): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacgaggtcgcccactctcaggttcagctggtgcaggtctggngctggaggtagaagaacgccgtgggcctcgagtgaaggtctcgtgacacggtcttcgtgttataccttagactaattagtgtatacgaacgtggcgacgacgacggcccgtaggacgaacggcagtggaggtaggagtggataggactcgagcgtactaacgaataaactaaccaactacaacttatagacctaacgaaggtaaccgtacggacggtacgaacggtaccgtaccacccgtacgaacccgtaacgacgtaaacttaacgaaccttaccggaaccgtaacgaccgtaaccggtaacgtaacccgttaacgaggttacggagtaccgtaggaaccgggtacgtccgttaacggaacgttaccgttaacgaccgggtaaccggaaacccgttaccggggtttaccgttttacggttttacggtacggttaccgggttaacggtaaacggttaaacggtaaaccggttaagtttaaacgtttaacggtttaaacggttaacggttaaccggttaaccggtttaacggggacccggggtttaaccgggaaaccccgggg

SEQ ID NO: 68153 - DNA, 797 bp, Homo sapiens
  misc_feature: GYAE6OF02GLVSI.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgcctaccctctcctgcagggccagtcagagtgtagcagctaacttgccgtggtaccagcaagaaccgtggaccacggcctcccgaggtcctccgtacacttacgtagtcggtcgactacctcccgacggacggccctacgttcgggtacctccgacggtaccgtaacggtttcaacggttcggacgtacgggttgggtcgtacgggtaacgtagttaaccgttccgaaccttccgtaacccacgtactcgaacgtccgtacgccctgggacctacgggttacttaaggtaacgtttcttttaacgaccttttaaacgtttacgtttaacgttacgttaaccttaaagtaaacggtttaactttaaacccggttaaacccttttttacccgggtaacggttttaacccgggttaacccggtaaaacccggttaaacggggtaaacccgtttaaaggggtaaccgggttaaacccgtaaaccggttaaacggtaaccgggtttttccgggtaccgggttaacggttaccgaaccgttaaccgttacgtttacccggtttaacgttttcccgtttaacctccgtttaccccccgg

SEQ ID NO: 68154 - DNA, 581 bp, Homo sapiens
  misc_feature: GYAE6OF02I6NU6.37.37.D04.1.454.CMB.1.raw
  modified_base (204)..(204): a, c, t, g, unknown or other
  misc_feature (204)..(204): n is a, c, g, or t
  modified_base (444)..(444): a, c, t, g, unknown or other
  misc_feature (444)..(444): n is a, c, g, or t
  modified_base (486)..(486): a, c, t, g, unknown or other
  misc_feature (486)..(486): n is a, c, g, or t
  modified_base (559)..(559): a, c, t, g, unknown or other
  misc_feature (559)..(559): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagtagtgttagcagcaacttagcctggtaccagcaagaaaccctggccaggcctccccgaggcctcctcatctatggtcgtcactcccaccgacgggccacgttggtactccccgagccgtaacggttcaggtggcctaggtcgggtcgtggggacaggtacgttcaccgtctccgacctatccgagccgtagccctgcagtcctagtaagttntttggacttagtttacttcgtagtccagtcatactaattcgnggtacctcgtagcggttacgtcgacgtacgggtacaaggtggaaactacggaaaccgttagcggttcgacgtntcccgaacgtacttacttccgg

SEQ ID NO: 68155 - DNA, 810 bp, Homo sapiens
  misc_feature: GYAE6OF02HQHPK.37.37.D04.1.454.CMB.1.raw
  modified_base (151)..(151): a, c, t, g, unknown or other
  misc_feature (151)..(151): n is a, c, g, or t
  modified_base (209)..(209): a, c, t, g, unknown or other
  misc_feature (209)..(209): n is a, c, g, or t
tcagtagtgtagatcacgaccggtgctcgatttagtagcatactgttgggtttgggggaactgctcagttaggacccagacggaaccatggaacgccccagcgcagcttctcttcctcctgctactctggcctcccagactaccactgganaaatgtgatgacgcagtctccagccacctgtcctagtcgtcctccgaaggggaaaacncgcccaccctctccgtagacgacgggccagtcaggagtgtacgcagacctaaacttcgccttaggaccagcaacgtaacctcggaccacggtcctacccgacggcctaccgtactaatccgtagtcggtcaccactacccgaccgtacgggccctaacggttaccggtactaccccgtaacgcggttaaccgggttcgaacggtcgggtaacgcggggttcgttcggtaagggacgtacgttaacgttccctaaccgttcaaccgaccctagtacaacggtcctacggtccgacgtataaccgttcgtaaggtaacgttttacttacgaccgtttaaacctttaacgttacgtaccgaccgtaggtaaaccttaaaggtttaaaccttaaaccggtaacccgggtccccgggttaacccgtacgggttaaccggtaacccgggtaaaaccgaaacgggttaaaccgggggttacgaaaacccggttaaccggtaaaaaccgtaccgggttaaccggttacggtaacccgttaccggaacccggtaccctaaccgggttttactaaccggtttccgttttacccgaccgggttttaaccccc

SEQ ID NO: 68156 - DNA, 668 bp, Homo sapiens
  misc_feature: GYAE6OF02IB7RH.37.37.D04.1.454.CMB.1.raw
  modified_base (204)..(204): a, c, t, g, unknown or other
  misc_feature (204)..(204): n is a, c, g, or t
tcagtagtgtagatcacgaccggtgctcgatttagtagcatactgttgggtttgggggagaactgctcagttaggacccagacggaaccatggaagcccccagcgcagcttctcttcctcctgttactctggctcccagataccactggaagaaatagtgactgacgcagtctcagccacctgtctgtgtctcgaaggggaaancgtccaccgtctctgcagggccagtcagagtcttagcagcctaaacgttcgccttggtaccagcaacgaactggacacggcctaccgaggtacctccgtacaatccgtaagttcggtacgacctacgtaccgaccgaacgggtacctaaccggttcggtaaccttcccaacggaccgtaacggtttacaaggttcggacggtaagggtcgggtacgtcgggaacacggttacgttacaaccgttctacgaactcgtacaggcacgtctgacctagtcgtacgtaaagttgttttagacgtttagtttttacttcgtcgttacgtaagtaccgtaaagtttaacttaaacgttcgtcggtaaccttcggtaacggttcggtacgtaccgacgtaaggacgtaaaggtaacgaactaacgtaaacgtcgttaggtcgacgtccgacaacctgttaccctttacccg

SEQ ID NO: 68157 - DNA, 670 bp, Homo sapiens
  misc_feature: GYAE6OF02GM1MO.37.37.D04.1.454.CMB.1.raw
  modified_base (584)..(584): a, c, t, g, unknown or other
  misc_feature (584)..(584): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctgggcctcagtgaaggtctcctgcaaggcttcgtggttatacctttagctaaattatggtatcaacgttgggtgcgacgaggccccgtggacaaggccatgagtggagtagggatggatcgaggcgtcttaacaaattaaacgtaacacaactaactatagaccaacgaacgtaaacgttccgaaggggtaccaaggtaacggtacccgaacccgtacgtaacccaacgtaaacgaacttaaccctaactaaccccgaacgaacgaccaacgaacggccctaacgacgttacgggatacccgtaggaccgggacgtcccgtaaggacgtagtaccgtacggaacgaaccgtaccggtccggtttgttttaaccgngttacggacgaagttaacgtaacgtaagtaacgttagttaacgttaacgtacgggtaactaacgggttcggggtaccgtaaccggg

SEQ ID NO: 68158 - DNA, 796 bp, Homo sapiens
  misc_feature: GYAE6OF02GDSFP.37.37.D04.1.454.CMB.1.raw
tcagtagtgtagatcacgaccggtgctcgatttagtagcatactggttgggtttgggggacccaaaaaccacacccctccttgggagaatcccctagatcacagctcctcaccactggactggacctggagcatccttttctggtgcagcagcaacaggtgcccactctacaggttcagtcgttggtcgcctagtctagggagtcgtggacggtagaaggaacgccggtcggggcctgacggtagtaacggttctccgtgacaacggtctttagttaggtttaacttaccgtttagacttaatttgtacggttattacgaacgtggggtacgccgtacgacggtccccgtaggacctaacggcctagtcgggtacgtacgggtacgtagggtagtacgggacttcggaagtcggtaacctttaacgtaaacgttaaactaacctacggtaactaaccgtaggttacgaacaaacggtacggtttaaaccggttcccgaaggggtaccaaacgggtacgttaccccaaccggtacgaacccaagtaaccggaacttaccaacgtaacccgaggtactaccggacctaaccggaccttacgtacggcgtacgacgtggtaacggacgttaaccgacggtaaccgtacgttacggtaccgaaacgggtacccgtaccgggttacgttttacgtttacggtagtaccggtacgtaaaggtaccgttaacggtaattacgttaagtttacggtaaggttacccggtacggtttacgggtaccggggtaacccctaccgggg

SEQ ID NO: 68159 - DNA, 766 bp, Homo sapiens
  misc_feature: GYAE6OF02HTFBX.37.37.D04.1.454.CMB.1.raw
  modified_base (140)..(140): a, c, t, g, unknown or other
  misc_feature (140)..(140): n is a, c, g, or t
  modified_base (209)..(209): a, c, t, g, unknown or other
  misc_feature (209)..(209): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttccnggtggcagcagcaacaggtgcccactctcgaggttcagctggtgcagtctggagctgagtgaagagcgngggctgagtgaagtctctgcaaggcttctggttatacttagactaattagtggtatacaacggtggtcgacgacgacggtcccctaggaccgaaggtcctaagtggtaaggtgggaacgttaggggattaggggtacttacggaagtccgtacttaaacgtaaaagttaaactaaacgaacctactaaacgtagtacgtacaaacgtaacggtaaaccgttaccgaagggaccgtaaagtcgtaacccgtaaccccgtaacggtaaccaacgtaaacgtaaaccgtaactaaccgttacccgaacggaaacgaccgtaaacgaccgtacctaaacgagttaacgggacgtcgtaaggaggtaacgtccgtaaggggtaactacgttaacggaccggtaacgtaaaccgggtacggttaccgtttaagttttacggtacggttacgggtaaccggtaacggaacgggttaagaaaccggtttaaagttaacggttttaaggaaacggttcgggttaaccggtaacggggttaccggggtaacccgttaaaccgggggg

SEQ ID NO: 68160 - DNA, 605 bp, Homo sapiens
  misc_feature: GYAE6OF02FRZDO.37.37.D04.1.454.CMB.1.raw
  modified_base (399)..(399): a, c, t, g, unknown or other
  misc_feature (399)..(399): n is a, c, g, or t
  modified_base (446)..(446): a, c, t, g, unknown or other
  misc_feature (446)..(446): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtacccactctcaggttcagctggtgcagtctggagctgaggtgaagaagccgtggggcctcagtgaaggtctcctgcaaggcttcgtggttatacctttagctaattatggtatcaactgggtgcgacgacggccccctggacgaaggccagtgagtggagtggagtggatcgagcgcttaacaataataacacacactatgacacagtaacgtcgaggcagacgtccaccgtacgaccanagatacactccgaacgagccaaccacgacctaacgagtcggacgccnggtaaggacgtcctaggaggtactcgtaggaaccgaccgtacgggtcccgtttagttttacgtggttacggcggaagtacggtaacgaggtaactttaagttaaggttaacgtagggtaaccgttacgggtacggggacccggtaacgggtaaccccgg

SEQ ID NO: 68161 - DNA, 697 bp, Homo sapiens
  misc_feature: GYAE6OF02G6NT2.37.37.D04.1.454.CMB.1.raw
  modified_base (195)..(195): a, c, t, g, unknown or other
  misc_feature (195)..(195): n is a, c, g, or t
  modified_base (382)..(382): a, c, t, g, unknown or other
  misc_feature (382)..(382): n is a, c, g, or t
  modified_base (470)..(470): a, c, t, g, unknown or other
  misc_feature (470)..(470): n is a, c, g, or t
  modified_base (560)..(560): a, c, t, g, unknown or other
  misc_feature (560)..(560): n is a, c, g, or t
tcagtagtgtagatcacgaccggtgctcgatttagtagcatactgttgggtttggggaacccaaaaccacacccctccttgggagaatcccctagatcacagctcctcaccatggactggacctggagctattccttttccgtggtggcagcagccaaacgaggtcgacccactctcgtaggttcagcgtgggtncagtcgtcggagcgtaggaggtagaaagtacgccggtcgggacctgacggtagtacggtctccgtgacgaaggtcttcggtagttaacttaccgttagacttaagtttagcggttacactaggttagggcgtaccgacggccggccccgtaggaaccgaacgccgtagtagacggtgaggtggtagnggtactacgacggactaacttaacaaagttaaccaacgtacaagtctaagacgaactaagaacgtacggtacgacggtacagtacccnccgtaacctacgtaccgaaacgtacgtaactccgaacgtaaccgacggactaccgacaacgttccaaagcgtagacgtcgtaggacgtanaccgtggactagtccgtacgaacgttccgacggtttcgttacggggttacctgacggtagaacggtaccgttaagaattaacggttgtaaacggttcggaccgttaaggtaccggggtaccggtaacgtaacccggg

SEQ ID NO: 68162 - DNA, 685 bp, Homo sapiens
  misc_feature: GYAE6OF02I94HP.37.37.D04.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (321)..(321): a, c, t, g, unknown or other
  misc_feature (321)..(321): n is a, c, g, or t
tcagtagtgtagatcacgaccggtgctcgatttagtagcatactgttggggtttggggacccaaaaaccacacccctccttgggagaatcccctagatcacagctcctcaccatggactggacctggagcatccttttcctggtggcagcagcaacaggtgcccactctcaggttcagcgtggtgcagtctggagngtgaggtgaaagagccgtgggcctnagtgagtctcngcaggtcttgtgttactaccttagactaagttataggtatcgtaacgtgggtgacgaccgcggccctggaaccgaggaccagtggaagngggagtagggactggatgacgtctgtaactaataacacacacgatatcacagaacgtacgtcgagggacacgactccaaccgtcgaacccgtaagacgtaatacccgatacccggaacgtaccgtaccaacgtaccgtacctaactcggtaagcggtacgtagggaaccggtacgtcccgtaggaagtacgtacgtaacggggaccgtaaccgacccgggtttaccgtttacggtttacgttacggtacggtacggtacgggtaaagttaacggaacggtttaacttttaaggtttaacggtttaaacggtaccggggttaacgttacccggggttacggggaacccggttaaacccccggggg

SEQ ID NO: 68163 - DNA, 954 bp, Homo sapiens
  misc_feature: GYAE6OF02IQPRQ.37.37.D04.1.454.CMB.1.raw
tcagtagtgtagatcacgaccggtgctcgatttagtagcatactgttggggtttgggggacccaaaaaccacacccctccttgggagaatcccctagatcacagctcctcaccatggactggacctggagcatccttttcctggtggcagcgagacaacaggtgcccacgtctcaggttcagcctggtcgcgagtccgtggagcgtaggaggttagaaggaacgtccggtcggggtccctcgtaggtaggtaagggttcctcccgtaggaccaaacgggtccttttcgttacgggtttaacttaacccggtttaagtacctaaatttagttaggttaacttccgtaaaaccgttggggttacggaccggaacccgtaacggggccccccgttagggaaccgaaaccgggtacccgtaagttaccgggtaacggttaggggacggtacgggggtaagttaggggtaacttacggaccgggtaccgtaccgtttaaaacctaaaacgttaaattaaaccgaacctaaccggtaaccgtttaagtacggtaccctaaacggaaacggtaaccggttacccgaaggggacccaagggtaacccttacccgaaccccgtttacggaacccgtaacgtaaccggtaacttaaaccgaccgtaacccgtacggaacaaccgtaacccgaccgttaaccgtaccgtaagtacgggtaaccgaggtaccgggaaggttaccgggtaccgttaggtaacgtacgttaccggttaacggaacccggtaacgggtacccggtttaaccgggttttacggttttaaccgttcgggtaacggttaaccggtaacgggttaaccggttaacggtaaccggtttaacgttaaacggttttacgttaaacgggttacggggttaacccccgtaagggggttacccggggtacccggttaaacccccggggg

SEQ ID NO: 68164 - DNA, 710 bp, Homo sapiens
  misc_feature: GYAE6OF02GN1BR.37.37.D04.1.454.CMB.1.raw
  modified_base (185)..(185): a, c, t, g, unknown or other
  misc_feature (185)..(185): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
  modified_base (549)..(549): a, c, t, g, unknown or other
  misc_feature (549)..(549): n is a, c, g, or t
tcagtagtgtagatcacgaccggtgctcgatttagtagcatactgttgggtttggggacccaaaaaccacacccctccttgggagaatcccctagatcacagcctcctcaccatggactggacctggagcattcctttcctggtggcagcagcaacaggtcgcccactctcaggttcagctggtnctagtcgtggagctggaggtagaagacgccgtggggacctcgaggtaggacggttctccgtgaccgaaggtcctttacgtggtttaacgtacctttagacttaagttagtaggtatacgtaacgtgggtacgccgaacgacggtccccctagggaacgaaggtcccagttcggaaggtcggtaaggtgggaagtcgggaatcgaaggtctaccttaagtaaactaaanaaccgtaacaacacgtttaancggactaaacgtaaggtaaacgtcccgaagggtactagggaacttcccacgtacgaacccagtacgaactacaactaccgacaagaccaagaccgtacctaccgtaagtcggganacggtacgagggtaccgccgtagaacgttacgatacggacgtaaccggccggttacgtttgttacgtcggtaaggtccgaaggtaacccgtaggaacgttaagttacggtaactttagggtaaccgacggtttaacgggacgggtaacccggtaacccggg

SEQ ID NO: 68165 - DNA, 621 bp, Homo sapiens
  misc_feature: GYAE6OF02H8RNG.37.37.D04.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
tcagtagtgtagatcacgaccggtgctcgatttagtagcatactgttgggtttgggggagaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgccaccctctcctgcagggccagtcagagtgtagcagcaacttagcctggtaccagcaagaacctggccaggctccgaggctcctnactctatggtnctatccacgacggcctactggtacncccagcctaggttcaggtgcgtaggtcggtcgtggactggtaacgttcaccgtctaccaacccgtataccgagccgtacgtccctgactacggtctaagtaagttacttttcgactttagttttatttcgtcgtcacgtactaagttaacttaacgttacgtcggtaccttaccgtacggttacggtaaccgttaccggaaccgtaacggggtaacccgtaagggtaacggtaaaaccgtactaaaccggtaacgttggtacggaccgttacgacccgtactacgtcgttacg

SEQ ID NO: 68166 - DNA, 856 bp, Homo sapiens
  misc_feature: GYAE6OF02HJGGN.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagagccgtggggcctcagtgacggtctctgacaaggtcttcgtaggttatacctttagactaattagtaggtactacgtaacgtggggtgaccgtaccggacggcccccgtagggaaccaacgggtaccagtggtacggtagggagtaggggtacgtagggactacgacggtacgtacgttaacgaaaacttaaactaaccgaacctaaccgtaacttaggtacgaaccgtaacgtaaaggtaaaccgttacccggaagggtaccgtaaacgggtaccgttaccccgtaaccccgttaaccggaaacccgtaaccgaaaccggttaacctaaacccgttaacccgtaacccggtaaaccggaaccgttaacccgaacccgtacggtaaccccgttaaacggtaaggttcgggaaaccgtccgttaagggaacgggttaccgacccgttaaggaccgtaacggttacccggtaacggtaaacccggtaacggtacccgggttacccgtttttaaggtttacccgtagggttacgggaacccgggtaaggtaaccgttaaacggaaacggtttaacgtttaagggtttaacgttaacgggttaccggtaacccgggtttaacggggtacccggggtaaacccgggttaacccggg

SEQ ID NO: 68167 - DNA, 631 bp, Homo sapiens
  misc_feature: GYAE6OF02FPH32.37.37.D04.1.454.CMB.1.raw
  modified_base (194)..(194): a, c, t, g, unknown or other
  misc_feature (194)..(194): n is a, c, g, or t
  modified_base (368)..(368): a, c, t, g, unknown or other
  misc_feature (368)..(368): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctgganctgaggtgaagaagccgtggggcctcgagtgaaggtctcctgcaaggtcttcgtggttaacttacctttagactaaattagtggttactacgaacgttggggtcgacgacgacggccccgtaggaaccgaacggccagtggaggtggagtgggagtggatcgagcgtacttaanaaataactaacacaactactatcgacacaagtaacgttcgaagggacaggtacgtccaaccgtgaaccagaacgtataactacgggtacaacggacaccaacacgacctaacgagaggacgacgaggacggacgcgtaggagacgtacgtacgaacgaccgtacggtacgtttagttacgtgtacgtacggtaaggacgtaacgtagtaattacggttagtaaggttacggtaacggttacggtacgggtaccgtaaccgggg

SEQ ID NO: 68168 - DNA, 633 bp, Homo sapiens
  misc_feature: GYAE6OF02GZLEQ.37.37.D04.1.454.CMB.1.raw
  modified_base (421)..(421): a, c, t, g, unknown or other
  misc_feature (421)..(421): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaacgtgggtgcgacacggccctggacaaggccatgagtggagtgggatggatcagcgtcttacaataactaacacactaactatgacacgagaacgttcgagggcaaggacgtccaccctgacctacaaggtactaacgactaccgacganaccgacacgtacctacgaagtcgggaagcgtaggaacgggtcgccggtaggagtacgtcgttaccgaacgaccgtaaccgggtccgttttacgttttaaccgtcggttacggacggtaacggtaacgtaaccgtaagttaaacgttaagttttacggtaaacggttcggttaaaccgttaccgggttacggggtacccggtaaacccggggg

SEQ ID NO: 68169 - DNA, 616 bp, Homo sapiens
  misc_feature: GYAE6OF02FUOUD.37.37.D04.1.454.CMB.1.raw
  modified_base (358)..(358): a, c, t, g, unknown or other
  misc_feature (358)..(358): n is a, c, g, or t
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtctctgcaaggtcttctggttatacctttagctaattatggtatctaactgggtgcgacaggcccctggacaaggccagtgagtggatgggatggatcagcgtacttacaataaactaacactacactangacacagaagttcagggcagtacgtaccacccgtagaacccacgaacgaactaacgactacccgaaacgtacaccaacgaccgacctaacacgtggacgcgtaggaacggagccgtaggagtactacgtacgaaccgaaccgaccgggttaccgtttacggttttaccgttaggtcggacggaaggtacgtaacgtaagtaagttaagtttacgttaacggttaggtaccgtacggtaccgggggacgtaacccgggg

SEQ ID NO: 68170 - DNA, 677 bp, Homo sapiens
  misc_feature: GYAE6OF02JYZ6B.37.37.D04.1.454.CMB.1.raw
  modified_base (218)..(218): a, c, t, g, unknown or other
  misc_feature (218)..(218): n is a, c, g, or t
  modified_base (254)..(254): a, c, t, g, unknown or other
  misc_feature (254)..(254): n is a, c, g, or t
  modified_base (297)..(297): a, c, t, g, unknown or other
  misc_feature (297)..(297): n is a, c, g, or t
  modified_base (504)..(504): a, c, t, g, unknown or other
  misc_feature (504)..(504): n is a, c, g, or t
  modified_base (530)..(530): a, c, t, g, unknown or other
  misc_feature (530)..(530): n is a, c, g, or t
  modified_base (578)..(578): a, c, t, g, unknown or other
  misc_feature (578)..(578): n is a, c, g, or t
  modified_base (637)..(637): a, c, t, g, unknown or other
  misc_feature (637)..(637): n is a, c, g, or t
tcagtagtgtagatcacgaccggtgctcgatttagtagcatactgtttggggtttgggggaggaactgctcgagttaggacccagacggaaccatggaagccccgagcgcagcttctcgttcctcctgctactctggcctcccgagactacccacgtaggagtaaatagtgatggacgcacgtctccacgccaccctgtctgtgctaccgaggggaancgcccaccctcgtcccagcgacggccagtcagtgtntagcacgacaattacgccgtgtaccagaccgaacgtaaaccgnggaccacggtaccgtaccccgtaggccccttcctcctaaggttcctagttcgggacctaccctacgtaccccgaccggaacgggtcctaaacccgggttgtaaccctccccggaagtccgtacgggttcagggtcggtacgtggggttcgggtccgtagggacttacgggtcttaccacccgtctaaccgacctagtacacgccacnccgtgacctagttaccgagtaagttnttcggtactttagttttactgtacctatacgtgttaatactacgttcncgttccgtacttacggtacggtacgtccgggaacaccgggtagttacggattaaaccgngtaacgacgttgtaaccgcgtaagcctacggtactcgtac

SEQ ID NO: 68171 - DNA, 298 bp, Homo sapiens
  misc_feature: GYAE6OF02IYCMD.37.37.D04.1.454.CMB.1.raw
  modified_base (247)..(249): a, c, t, g, unknown or other
  misc_feature (247)..(249): n is a, c, g, or t
  modified_base (251)..(298): a, c, t, g, unknown or other
  misc_feature (251)..(298): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctcgtgggggcacagcggccctgggctgcctggtcaagctacttccatcacactactgcgcggctggacacggcgcagtagcnnncnnnnnnnnnnnnnnnnnnnnnnnnnnnnnnnnnnnnnnnnnnnnnnnn

SEQ ID NO: 68172 - DNA, 685 bp, Homo sapiens
  misc_feature: GYAE6OF02GWOXE.37.37.D04.1.454.CMB.1.raw
  modified_base (465)..(465): a, c, t, g, unknown or other
  misc_feature (465)..(465): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtatggagctgaggtgaagaagccgtggggcctcagtgaaggtctccgtgcaaggtcttcgtggttatacctttagctaattatggttatcaacgtgggtgcgacgacggccccgtaggacgaacggccagtgaggtggagtgggatgggatcgagcgtacgttaacaaataaactaacacaacgactaatacgacaacaaggtaacgttccgaagggcaacggtacgtacctacccgtacgacccaacgagaactaaccacgtacccaagacaccaacncgacctagagtaggcgtcgaggacggcaccgtaggacgtactccgtaacggaaccgtaaccggtaccggttaccgttttacgttttaccgtgggttaccggtacggtaaacggtaacggttaacgtaaaggttaaagttttaacgtttaagggttaaacgttaccggggttaaaccgtttaacccggggtaccgggggtaaccccggtaaaccccggggg

SEQ ID NO: 68173 - DNA, 657 bp, Homo sapiens
  misc_feature: GYAE6OF02JNQVV.37.37.D04.1.454.CMB.1.raw
  modified_base (398)..(398): a, c, t, g, unknown or other
  misc_feature (398)..(398): n is a, c, g, or t
  modified_base (530)..(530): a, c, t, g, unknown or other
  misc_feature (530)..(530): n is a, c, g, or t
  modified_base (611)..(611): a, c, t, g, unknown or other
  misc_feature (611)..(611): n is a, c, g, or t
tcagtagtgtagatcacgaccggtgctcgatttagtagcatactgttgggtttggggacccaaaaccacacccctccttgggagaactcccctagatcacagctcctcaccatggactggacctggagcatccttttcctggtgcagcagcaacaggtcgcccactctcgaggttcagcttggtgcagtcgtggagctggagtagaagacgccgtggggcctcgagtgaaggtcctcctagcaaggctttcgttggttattacctttagacctaattagtggtactactaacgttgggtcgtaccggacgacgggtcccctagggacaacggtacccagtaggtagtaggtagtagggtatacgggagtccgagggtacctacttaaacgaacttaanaacaacgtacgtactaagcgaacacgaacgtacggtccgaggtcgaagtacgtcccgaacctaccggaactacaacggtaactactacgacccgaagtccggaacacgtacgacctacgtagacggaaccgngttaaggacgtcgacgtgaaacgtctccgtaagacgttaaccggacgtcgtttagttcgagtcggacgtaagtaccgtaanaggttactagttacggagtacgttcgacgggtacgggacctaacgg

SEQ ID NO: 68174 - DNA, 746 bp, Homo sapiens
  misc_feature: GYAE6OF02G7Z2U.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcgaggttcagcgtggtgcagtcgtggagtctaggaggtagaaagaacgccgtggggcctcgagtagaacggtcctcctgacgaacggtcttcgttaggttacttacctttagactaatttagtggtatactaacggttgggtacgacgacgaccggtccccgtaggaacgaacggccagtaggaggtaggtaggtgggtagtggacttcgagtcgttacttaacgaaaattaaactaaaccaccgtaactaacttagtaccgaacgaaccgtaacggttaacggttaccggacgggtaactaacggtaccgtacccgtaacccgtacgaaacccaacgtaagtaaccttaaccacgttaacccgaaagtaccgaactaaccgtaccgaaccttaaacgcgttacggacgtcgtacggacggtacgtaccgtaaggacgaacttcggacggaaccgtacggtaccgttacgtttcgtttacgtgggtacgttaacgggaagttaacgtacgtaaagttacgtttaagttagtaacggtaggttacccggtaagggtacccggggaccgttaacccggg

SEQ ID NO: 68175 - DNA, 680 bp, Homo sapiens
  misc_feature: GYAE6OF02FWL6I.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagagccgtgggcctcagtgaggtctctgcaggcttctggttatacctttagactaattagtggtatctaacgtgggtgacggaccgacggtcccccgtaggaacaacggcctagtggaggtaggagtgggagtggagtacgacgcgtacttaacgtaaataactaaactaacactaactactacgacgaacgtaacggtaacggttaccggaggggacaacgggtaccgttacccaacccgttacgaaccctaacgaacgtaacttaaccgaccgtaccgaacggtacaaccgacgaccggtacccttaacgacgttacggacgcggtaggaacggacgacgtagacgtacgtaccgacgaccgaaccgtcggttaccgttaggtttaccgtaggtcgtacggtacggtaaacgtacgtaaagttactttagttaacgtacgtacggtacgtaaccgggtacgggaccgtaacccggg

SEQ ID NO: 68176 - DNA, 760 bp, Homo sapiens
  misc_feature: GYAE6OF02I5SPR.37.37.D04.1.454.CMB.1.raw
  modified_base (205)..(205): a, c, t, g, unknown or other
  misc_feature (205)..(205): n is a, c, g, or t
  modified_base (335)..(335): a, c, t, g, unknown or other
  misc_feature (335)..(335): n is a, c, g, or t
tcagtagtgtagatcacgaccggtgctcgatttagtagcatactgttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtgtagcagctaacttgcctaggtaccagacaagaaaccgtcggccacggtccctccccgagggtccttacccttactaacttccttaagtcgggtacnccgtaaccttaccccgaacccgacggggtaccctaacggttacgggtacctacccccgagtaccccggtagggttaccgtagggtacgggactaacgggggtttcggggtaccggttaggggactaagggttagttacccaaccgttctaacccgactactacgaacgcgaacgccgtcgacgtacgttacgtaggttaagttacgttttacgactttagtttttacttcgttacgtactacggtactaagttaacgttacgtttacgtacggtcccttacgggttaccggttacgggttaccggttaccggtaacccggtaacgggtaaccgtaacggggtaacgtaaaccgtaaccgtaaaccggtaacggtacgggttaacggaccggtacgtaacccggtaccttacgttaccgttaccgg

SEQ ID NO: 68177 - DNA, 771 bp, Homo sapiens
  misc_feature: GYAE6OF02H6OGY.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgccccactctcaggttcagctggtgcagtctggagctggaggtgaaaggaagtccgtgggggcctcgacgtggaacggtcctccgtgacgtaacggtctttcgttggtttaacttaccgtttagactaattattaggtactacgtaacgttgggtcgaccgaacgaccgggccccctagggaaccgtaacggccctagtagaggtggagtggatggtatcgagccgtacttaacgaactaataacacaactaatgtacgactaaacgtagtaaacgttccgaagggacaacggtacgtacccgtaacccgtacgaaacccgaacgtaacgtaactaaccgaacctacccgaaccggaacgtaaccaaacccgtaacgtaacccgttaacgtaacggtaacgggacgttcggaaaggaaccgggtaacgaccgttaacggacgtacgttaccggtacgaaccgtaacccggacggttaaccggtttacgttttaaccggttaggacggtaccggtaaaggttaaccggtaacgttaagtaaacgtttagtttaacggttaaacgttacccgggtaacggttaaccgggttaccggggaccgtaaccccgggg

SEQ ID NO: 68178 - DNA, 832 bp, Homo sapiens
  misc_feature: GYAE6OF02HX9AN.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtcgccctactctcgtaggttcagctggtgactagtcgtgggagtctggagggtagaagaacgtccggttcggggcctacgaaggtggtaaacgggttccttccgtaggaccgtaacggtccgttttacgttagggtttaacttaacccgttttaagacttaaattttagtggtaactaccgtaacggttgggtcgaccgaacgaccgggtccccgttagggaaccaaacgggtccctaagtcgggtaagggtcgggtaaggtgggtagtcgggtactccggagtacgtacttaaacgaaaattaaaacaaccgtaactaaccgtaacttacgtacgacgtaacgtaacgtaacgttcccggaagggtacacggtaccgtaccctaaccgtacgaaccgaacgaacgtactaacgtacgtaccgaacgtacgaccaaccgacgtaaccgtaacgtacggtacggtacgtacgtacggacggtaccgtacgtacggtaacgtagttaccgtaccggtaaccggtaacccggtaccgggttcccggttttacggttttacgtacggttaacgggtacggtaaaggtaaccgttaacgtaaacggttaagttaacgtttaaggttaacggttacgggtaaccggttaccggttaccgggggtaacccgtaaccgggg

SEQ ID NO: 68179 - DNA, 748 bp, Homo sapiens
  misc_feature: GYAE6OF02HZ4YB.37.37.D04.1.454.CMB.1.raw
  modified_base (592)..(592): a, c, t, g, unknown or other
  misc_feature (592)..(592): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttccgtggtggcagcacgacaacgaggtcgaccccactcgtactaggttcagtcgtggtcgcagtcgtggagcgtggaggtagaacgtaacgccggtcgggtcctacgagtaggaacggttcctcgtcggacgtaaggtccttcgttaggttaacttaccgttagactaagttagtaggtaactacaacggtgggtacaccgacgtaccggtccctaggaaacgtaacggcctaagtggtaggtaggagtacggggtaatacggactacacggtcgtacttaaacgaataaaacaccgtaacacgtaactgtacgactaacggtagtaacgtacggaacgtacgaacggtaccgtacctaaccccgtaagaacccaaacggtactaaccgtaacctaacgtacccgaaagccgtaaacaacccgtaacgtaaccccgtaagtaacgagggttaccncgtagggaaacgcgtcgttagaagaccgtcgtaacgacgtaaccgtacggttaccgtttagttaacgtgggacgacgtaaaggtaaccgtaagaacgtttaatgtttaaacggtaacgtacggtaaccgtaaaccggtcgggaacctaaaccgggg

SEQ ID NO: 68180 - DNA, 630 bp, Homo sapiens
  misc_feature: GYAE6OF02F74W2.37.37.D04.1.454.CMB.1.raw
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (401)..(401): a, c, t, g, unknown or other
  misc_feature (401)..(401): n is a, c, g, or t
tcagtagtgtagatcacgaccggtgctcgatttagtagcatactgttgggtttgggggacccaaaaaccacacccctccttgggagaatcccctagatcacagctcctcaccatggactggacctggagcatccttttcctggtggcagcagcaacaggtgcccatctcaggttcagctggtgcagtctggagctgaggtgaagaagccgtggggcctcagtgaaggtctcctgcaaggcttctggttactacctttagctaattagtgtatcaagtgggtgacgacncggcccctaggacaaggcangagtggagtgggatggatcgagcgacttaacaataagaacacaactactatgacagagtaagttaccgagggcaagacgtccaccgtgaccanagaactaacactaccaagacacgaacgacgtaccctagacgtacggacgactaggaacgggacgtccgtaggtaagacgttacggtacgaaccggtaaccgaccgggttacgtttacgttttaccgttcggtggtaacggtaggtaaacggttaacgaaagttaaagtttagtttaaagggtacgttaacggtaccggttaaccgggtacggggaccgtaacccggggg

SEQ ID NO: 68181 - DNA, 655 bp, Homo sapiens
  misc_feature: GYAE6OF02FWXL0.37.37.D04.1.454.CMB.1.raw
  modified_base (352)..(352): a, c, t, g, unknown or other
  misc_feature (352)..(352): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctcagtagaaggtctcctgacaaggtcttcgtggttaactacctttagactaattagtggtatcgaacgtgggtgcgacacggccccctggacaaggccagtgaggtggagtgggatggactcgagtcgtacttaanaaagtaactaacacgaacactatgacaacagtaacgtccgaggacacgtagtaccaccgtgaaccacgaagtaactaacgtactacccgaacggtacgaccaacgacgtacctacgagtacggacgtcgtagggacggacgccgtagtacgtaacgttcgagggaaccgaacgtaccggtaccgttttacgtttaccgtagtaccgtacggtaacggtacgtaaccgaaggttaaacgttagtttaacggttaacggtacggttaaccgtaaccgggttacgggggacccttaaacccggggg

SEQ ID NO: 68182 - DNA, 743 bp, Homo sapiens
  misc_feature: GYAE6OF02H6F67.37.37.D04.1.454.CMB.1.raw
tcagtagtgtagatcacgaccggtgctcgatttagtagcatactgttgggtttggggacccaaaaccacacccctccttgggagaatcccctagatcacagctcctcaccatggactggacctggagcattccttttcctggtggcagcagcaacaggtgcccactctcaggttcagctggtgcagtctggagctggaggtagaagacgccgtgggcctcgagtgaacggtctccgtgacaggtcttcgtaggttacttacctttagactattatggtatacgaacgtggtacgccgactaccggcccgtaggacgaacggcctagtacggaggtaggaggtgggtacgtggtactcggagtacgtacgttaaactaaactaacgtaaaccgaactaccacgtatcgaccgaacgtaacggttaacggttaccggaaggtacgtacggtaacgtcccgtaaccccgtacgaacccacggtaacgtaaacctacgtaaacctaccccggaacgtaacccgacccgaaaccgaccgttaacccgttaacgtaacgggtcgggtacgtaccgtagggaacggtcgttaccggtagaacgtacttccggtacgtaaccgtacccggacggtttacgttttacgtttcggacgttcgggaacgttaggtaactacggttaaagttaacgttagttaaccggtggttaccggtaccggtttacggggacccggttacgggtaacccggg

SEQ ID NO: 68183 - DNA, 693 bp, Homo sapiens
  misc_feature: GYAE6OF02GS8Y6.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaacgtgggtgcgacacggcccctggacaaggccagtgagtggatgggatggatcgagcgacttacaataaatacacacactatgacaacgagtacgttacagggcaagacgtccacccgtagacccaacgagaactacaactcccgaacgtacgaccaacgacgaccctaaacgagtacgggaacgtcgttaagggaacgggacgtaccccgttagggtaaccgtaacgtttcgtaaccgggaaccgaaacccggacccggggtttacccgtttacgggtttttaaccgtgggtacggtaaccgggaagggttaaaccgttaacgtaaacggtaaacgttttaagtttaacgggttaaacggtttaccggggtaaacccgtttacggggttacccgggggaacccgttaaaaccccggggggg

SEQ ID NO: 68184 - DNA, 251 bp, Homo sapiens
  misc_feature: GYAE6OF02G5APY.37.37.D04.1.454.CMB.1.raw
  modified_base (245)..(251): a, c, t, g, unknown or other
  misc_feature (245)..(251): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttcccctggcaccctctccaagagccacctcgtgggggcacagcggccctgggctgcctggtcaaggactacttccatctacactactgagcgggctggcaggcgcatgnnnnnnn

SEQ ID NO: 68185 - DNA, 649 bp, Homo sapiens
  misc_feature: GYAE6OF02IQ5PG.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaggtctcctgcaaggcttctggttatacctttagctaattatggtatcaacgtgggtgcgacacggccctggacaggccagtggagtggagtgggatggatcgagtcgtacttaacaataataacacaacactagtgacacagtaacttcggaggcagacgtccaccgtgaccacaagactaacactaccaacgagaccaacgacgtacctaacgacgtgggaacgtccgtaaggacgggacgtaccgtaggaacgtacgtacgtacggaacccgtaacgggtcccggttaccggtttagtttttacggttaggtcggtaacgggtaaggtaacggtaacgttaaaggtaacgtttaaggtttaacggtaacggtttacgggtaacccgttaaggggttacccgggggtaccggtaaacccggggg

SEQ ID NO: 68186 - DNA, 861 bp, Homo sapiens
  misc_feature: GYAE6OF02IUZSZ.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtacggggcctcaggtgaaggtctccgtgcgaaggcttcgtggttataccttttagctaatttagtggttatcgtaacgttggggtagccgaacgacggcccccttagggaccgaacggccctagtggtacggtagggagttagggtagtgggatcgaggtccgtacgttaacgaaattaaactaaacgaacctaaccgtaattaacgtacggtaccaacggaaaggttaaaccggttaccgaacgggggtacctaagggtaccgtaccccgaacccggtttaccgaaacccgaaaccgtaagggttaaacctaaccgtaaaccgtccccggtaaaaccgggtacggtaaccctaaccgtaaaccgggtaccccttaaaccggtaggttaccgggggtaacttcgggttaaggaaaccgggttcgggtaacccgtaagggtacgtaaacgttcccggttaacgggaacccgtaaccgggtacccgggtttaccggttttaccggttttttaaccgcggggtttaacgacccggggttaaaaggtccggttaaaacggtaaggtttaaaccgtttaagggtttaacggttaaaggttacccggggtaaccgtttaaccggggtaccgggggtaaccccggttaaacccggggg

SEQ ID NO: 68187 - DNA, 832 bp, Homo sapiens
  misc_feature: GYAE6OF02FO5I3.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctcaggtgacggtctcctgacgaaggtcttcgtggttactacctttagactaattagtaggttactactaacgttggggttcgaccggaacgtacgggtccccccgttagggaaccaacggggcccaacgttggtaacggttagggacgttggggtaacttaggggaacttaccggaacggtccggtaacctttaaacgtaaaattaaacgtaaccaactaaccgtaacgttactaccgaaccgtaaccgtaaacgggttaaccgtttacccgggagggggttaccaaacgggtaacccgtttaccccgaaccccggttacggaaccccgtaacggtaacggtaaccttaaccgtaccttaacccggaaaccggttaaccgaccgtaaccgaccgtaaccgtaacctaaggtacggacggtcgtacgggacgggtaccggtccgaaggtacgtacggttaccggaacgaccggtaacccggttaccgggttccgtttaacgttttacggtacgggttacggaacgggtaaggtaacggttaacgtaaggttaacttaaggttacgttaacggttacggtaaccggttacggggtaccgggaccggttaaccccgggg

SEQ ID NO: 68188 - DNA, 749 bp, Homo sapiens
  misc_feature: GYAE6OF02F0V4S.37.37.D04.1.454.CMB.1.raw
tcagtagtgtagatcacgaccggtgctcgatttagtagcatactgttgggtttggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagtccgtggggcctcgagtgaacggtctcctgacaaggcttctggttactaccgtttagctaattatggtatacgaagtgggtgcgacgacggcccgtaggaacacggcagtgaggtggagtgggagtggactacgacgtacgtacttaacaaataaactaaccgaacaaccgtaactatacgactaacgaaggtaacgttacggaaggacgtacggacgtacccaccgtacgaacccacgagtaactaactaccgtaccgaacgacgtaccaacgaccgtaacctacgaagtcgggtaaccgtacgtacgggaaacgggtaccggtaccgtacgggacgttaacgttcccgaaacgggtaacccggtaaccggttaccccgggttcgtttttaacgtttttaccggtagggttacgggacggttaaacggtaacggttaaaccggtaaaaggttttaaacttttagggtttaacggtaaacggtttaccggggtaaaccctttaccggggggttacgggggaaaccccgttaacccgggggg

SEQ ID NO: 68189 - DNA, 640 bp, Homo sapiens
  misc_feature: GYAE6OF02FLESN.37.37.D04.1.454.CMB.1.raw
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
tcagtagtgtagatcacgaccggtgctcgatttagtagcatactgttgggtttgggggacccaaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagctaattanggtatcaacgtggggttcncgacacggcccctgggacaacgggccagtggacggttggactggggacttgggatcaggcgacttacaaatataacactaactactatcgtacaacgagtaaacggttccgaacggggactaggaacgttaccaacccgtacggaaccaaacgaacggtaataaccaacgttacccaaacggacgtacaacgaacgtacccttaacgagtagggacgtcgtaggaacgggtacggccgtagacgtaacgttctacggaacaccgtacggtccgttaggttacgtgtgacgtaaggagtaacgagtaaattagtagttaaggtcgtaacgtacggtacggggaccgtaaccgggg

SEQ ID NO: 68190 - DNA, 256 bp, Homo sapiens
  misc_feature: GYAE6OF02FP7UZ.37.37.D04.1.454.CMB.1.raw
  modified_base (248)..(256): a, c, t, g, unknown or other
  misc_feature (248)..(256): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcaccctcctccaagagcacctctgggggcacagcggccctgggctggcctggtcaaggactacttccatctacactactgagcgggctggcaaggcgcatagnnnnnnnnn

SEQ ID NO: 68191 - DNA, 765 bp, Homo sapiens
  misc_feature: GYAE6OF02GUVC7.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagtactaccactcggagaaatagtgtatgacgcagtctccagccaccctcgtcttgtgtctccgaaggggaaagcgcccaccctctcctgcgagggccagtcagagttggttagcagtctaacgttcgccgtacgtaaccacgaccaacggaacccgtggacccgacggaccctcccgacggtcctaccgtctacgttcgtagtcggtcgacaccgtcccgaccgtacgggcctacggtacgtacctcccgaacgtccgtaggttcgaggttacggacggtaggtcggggtagtacgggactacgtacttaccgtccttaccgtaccacccgtacgtacgacgtaccgtacggtccgtagaccgttacgtcgttaacggttaacgttcttttacggttacgtttacgtttttacctttacgtacgttaccgtacggtaacgttaacggttaacgtttaaccggttacggttaccgttcccgttaccgggttaacggtaccgggtaccggttaccggggtaaccggtaacgggtaaccgtaacggggttaacgtaaaccggttaacggtaaccggtaacgttacggaccggttaccgtacggaacccttacgttaccgttccgttaccg

SEQ ID NO: 68192 - DNA, 812 bp, Homo sapiens
  misc_feature: GYAE6OF02JZRI4.37.37.D04.1.454.CMB.1.raw
  modified_base (448)..(448): a, c, t, g, unknown or other
  misc_feature (448)..(448): n is a, c, g, or t
tcagtagtgtagatcacgaccggtgctcgatttagtagcatactgttgggtttggggacccaaaaccacacccctccttgggagaatcccctagatcacagctcctcaccagtggactggacctggagctattcccttttccgtgggtggacagcagcaacgaggtcgcccactctcgtaggttcagcgtggtgcgagtctggacgcgttaggaggtagaagacgccggtgggggcctgacgtaggtacggtcctccgtgacgtacggtcttgttacggttacttaccgttagactaacgttagtcggtatcgtaacgtgggtcgacgacgtcggtacccgtaggaccacggactaggtaggtacggtaggtaggttagggtactagggtacgtacgtacggtaccgttaactaacgtaactaaacgtaaccgaccgaactacgttanacggtaaccgtaacgtaaacggttacggttaaccggaggggtaacctacggtacccgtacccgtaccgtaaccggtaaacgaaccgtaacgtaaaccgtaccgtaaaccgtacccggtaaacggaacgtacgtacccgttaaccggaccgttaagtaaccgggtagtaccggttaaccggacgggtaaacggtaccgtaccggtaacggtcgtttaacccggtacggtaacgtaacccgtacggtacccgggttaccgtttaggttcggtacgtccggtaaggtaacggtacgtaacgtaaggttaactttcggtagttaaaccgggtcgtaagggttccgggaacggttccggtaaacccggg

SEQ ID NO: 68193 - DNA, 717 bp, Homo sapiens
  misc_feature: GYAE6OF02GVVLS.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctcagtgaggtctctgacagcttcgtgtataccttagctaattatggtatcaacgtgggtagtcgacgacggccccgtaggacgtaaacgggccctagtggacgtagggagtaggggagtgggactcgacggcgtacgttaacgtaaattaaacgtaaacctaaacctactaacctaagtcgtaaccgtaacgtaaaggtaaaccggtttaaccgaagggggtaccgaacggtaacgttcccgtaaacccgttacgaacccgaacgtaacggaaactaccgtaaactacccgaaacgtacgaccacccgaacgtaccgtacctagtaggacgtcgtacgacggacgtacgtacggaagtacgtcgaacggtaccgaacggtaccggtaccgggttacgttttacgtacggttacggacggtaaggtaacgtaggtaaacgtaagttaacggttaggtaacggttaggaaccgttacgggttacgggcccggtaaacccgggg

SEQ ID NO: 68194 - DNA, 786 bp, Homo sapiens
  misc_feature: GYAE6OF02HVCSN.37.37.D04.1.454.CMB.1.raw
  modified_base (150)..(150): a, c, t, g, unknown or other
  misc_feature (150)..(150): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcngcaacaggtgcccactctcaggttcagctggtgcagtctggagctggaggtagaaagaacgccgtggggcctcgaagtggtaacggtcctccgtaggacgaacggtctttacgtacggtttattaacccgttttagacctaaagttttagtagggttaactaccgtaaacggttgggtacggaccggtaacgaccgggtccccgtaggaaccgaacgggaccctagtgggtaacggtgggtaagtaggggtacgttagggacttacggaaggtcccgtaactttaaacaaaacttaaacgaaaccacgtaactaacgtaactacgactaacgtaaacgtaaacgttccggaacggtacgtaacggtaccgtaccctaccggtacaaccgtaacaacggtaactaccgaaccttacccgagaacgactaaccaacggtacctaaacgagtacgggtaccgtagtacggtaaacggcgtaccgtagtaacgcgttacgtacgaaccgtaacccgggtcggttacgtttacggttctagggtacgacggaagtaaccgttaaagtaacgttaaagttaccgtttaagggttaccgtacggtaaccggtttacgggaccgggttacccggtaaaccgggg

SEQ ID NO: 68195 - DNA, 734 bp, Homo sapiens
  misc_feature: GYAE6OF02HN0BX.37.37.D04.1.454.CMB.1.raw
  modified_base (140)..(140): a, c, t, g, unknown or other
  misc_feature (140)..(140): n is a, c, g, or t
  modified_base (289)..(289): a, c, t, g, unknown or other
  misc_feature (289)..(289): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttccnggtggcagcagcaacaggtgacccactcgtcgaggttcagcgtggtgcgagtctggacgcgtgaggtgaagaacgccgtggggcctcgagtgaaggtcctcgtgcgaaggtcttcgtggttactaccgtttagactaagttagtggtanacgagtggcgacgacgacggcccgtggaacgaggtccagtgacggtggaggtggagtagtacgtcgagcgtacgttaacgaaataaacgtaactaccaacgtaacgttagacgtacgtaacgtaaggtaaccgttacggacggtacgtacggtaccgtaacccgacccgtacgaaccgtaacggtagtaaccctaaaccgtaccgtaccggaaacggtacgacccaaaccgggtaccgtaaccgttaagtcgggacgtaccggtctaccgggaaggtacgtcccggtaagtaccgttacgtacggtacgaaaccgttcggtaccggttaacgttttgttaaccgcggtacgtcccggtaaaaggtacccgtaacggtaagtttaaaggtacgttaggtaacggtccggtaaaccggttacggggtccgggaaccttaacccgggg

SEQ ID NO: 68196 - DNA, 837 bp, Homo sapiens
  misc_feature: GYAE6OF02FXMW3.37.37.D04.1.454.CMB.1.raw
  modified_base (195)..(195): a, c, t, g, unknown or other
  misc_feature (195)..(195): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtcgcccactctctaggttcagctggtgcagtctggancgtgaggtgaagacgcgtagggcctcagtgaacggtcttccgagacgaaggtcttacgttgttaacttaccgtttacggacttaattagtaggtatctaacgtagggtgaccgtacggaccggtccccgtaggaacggtacgggacctaagtaggacgggttggagtacggggtagtagggtaactcggaaggttccgtaacgttaaactaaaagtaaaaccttaaacaaccgtaaactaacgttaagacgtaacaacggtaacggttaacggttaccgaacggggtcaagtacccggtaccccaaccgtaccggaacctaacgaaggtaacctacggtaaccctaaccggtaaaccggaaccgtacccaaagtacccggaacccttaacggtacggttacgggaacctacggggtagggtaacggaccgttacgggtaaggcttaacgttcggaaccggttaacggggtaacccgtacccgggtttaccggtttacgttttaccggtagggtttaccggaaccggtaaagggttaaccgggaaacttaaaagggtaaccgtttaagggtttacccggttaaacgttcggggtaaaaccggtttaacgggtacccggggggtaacccgttaaaccccggggg

SEQ ID NO: 68197 - DNA, 622 bp, Homo sapiens
  misc_feature: GYAE6OF02HHEN4.37.37.D04.1.454.CMB.1.raw
  modified_base (475)..(475): a, c, t, g, unknown or other
  misc_feature (475)..(475): n is a, c, g, or t
  modified_base (539)..(539): a, c, t, g, unknown or other
  misc_feature (539)..(539): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtgggcctcagtgaaggtctcctgacaaggtcttctggttatcctttagctaattatggtatcaacgtgggtgcgacgacggcccctaggaacgaacggccaggtcggaggtggtagtgggaagtgggatcgaagcgtacttaacgaaataaacgtaacaaccaactacgtatacgactaacgagtaacgttccgaaggcagacgtaccaccgtgaaccagagaactacactaccgagtacacaaccgatacctaagagaggtacncgtagaacggacgccgtaggacacgttcgacgtaccgaccggtacgggttctttacgtttacgngttaccggacgtaacggtaatacgtaagtaagttacgttaggtaacgtacggtaacgttacgggtcgggaccgtaacccgggg

SEQ ID NO: 68198 - DNA, 659 bp, Homo sapiens
  misc_feature: GYAE6OF02FRFQ9.37.37.D04.1.454.CMB.1.raw
  modified_base (412)..(412): a, c, t, g, unknown or other
  misc_feature (412)..(412): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcgagtgaaggtctcctgcaaggcttctggttactacctttagctaattatggtactcaacgtgggtgacgacacggcccctggacaacggcagtgagtggagtgggatggatcgagcgtacttacaataactaacactaacactatcgacacacggtaacgtccgaagggcaaggacgtaccaccgtgaacccngaagtaactaactacgtaccgaacgacgaccaaccgacgtaccttaacgagtacggacgcgtacggacggaccgtacgtaggtacgtactacgtacggaaccgtaccggacccggttacgttttacggtttacgtacggtacgggtacggaaaggttacggtaaccgtaaaggttaacgtttaaggtttaggtaaacggtttacgggaaccggtttaccgggtaggggtaaccccggttaaccgggg

SEQ ID NO: 68199 - DNA, 645 bp, Homo sapiens
  misc_feature: GYAE6OF02FMFJ0.37.37.D04.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatgtgatgacgcagtctccagccaccctgtctgtcgtctcgaggggaaangccaccctctctgcgagggccagtcagngtgtagcagcaacttgcctggaccagcagaacctgccaggccaccaggcctcctcatctatggtncactccacgacggcctacgtcggtacnccccgagtccgtacggttcgaggtcggacgtaggttcggtacgtgggtaacaggttcttacctaccgtctaccaaccgtagtccgacgtaccgacggtccttacgccgtaggttacgtaggtaaacgttctttacgtacgttaacgtttttaactttcgacgttactacgtactaagttacttaacgtttaccgtcgtacccgttaccgtaccggttggtaccgggtaccgaccggtaacgggtaccgtaacgggtaacgtaaccgtaaccgtaaaggtaccgttgggacgtaccgtaccgactaccgttagttcttaaccg

SEQ ID NO: 68200 - DNA, 721 bp, Homo sapiens
  misc_feature: GYAE6OF02HFWHS.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcgaggttcagctggtgcagtctggagctgaggtgaagaagccgtggggcctcagtgaaggtctctgcaggcttgtgttactacctttagactaattatggtatacgaacgtgggtcgccgacgaccggtccccgtagggaacctaacggccgaacgtggtaaggtgggagtcgggagtcgggatacgagcgtacttaacaaagtaactaacgaactaacgtactagtacgactaacgaacgtaacgttaccgacgggtacgaaggtacgtacccaccgtacgaacccgtaacgaacgtaactaacaactacccgaacgaccgaccaaccgtacgacccgttaacgtaacggtacggacggtaccgtagggaaccggtacggtacccgtaggtacgtaccgtaaccgtacggtaaacccgtaccggtacccgggttacccggtttacgtttaaccggacgggttcgacgggtaggtaaccgtaagaaccgttaagttacggtttaaggtaaggtaccgttaacggttacgggtaccggggtacgtaacccgggg

SEQ ID NO: 68201 - DNA, 746 bp, Homo sapiens
  misc_feature: GYAE6OF02G1QO9.37.37.D04.1.454.CMB.1.raw
  modified_base (153)..(153): a, c, t, g, unknown or other
  misc_feature (153)..(153): n is a, c, g, or t
  modified_base (206)..(206): a, c, t, g, unknown or other
  misc_feature (206)..(206): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagactaccactgganaaatagtgatgacgcagtctccagcccacctgtctgtgtctccgaggggaaancgccaccctctcctgcgagggccagtcagagtgtagcagactaactgccgtggtaccagtacaacgtaaaccgtggaccacggtccctacccgaggccttaccgtacacttcgttagtcggtcacctaccgtacccgaaccggacgggtccctaacggttcggtaacctcccccggaaggtacccgttaggttaccgacgggtcggtacgttggggttacgggttacggacggggaaccttaaggtaccgttttaccaaccgttcccgttaacccggaactacgttacccgaacggtacctaaccgggtaccctacgggtaccgttacggttaaccgtaagggttaaacgtttctttacgggttacttttaacgttttcgttttaacgcgttaccgagttacgttaagttaacgtttacgttccggtaccgtaccttacgttaggtccgtaacggttcgaaccgtaaggacgtaagggtacgaaacgtaccgtaaacggtacgttcgggtacgcttacggaccctacgtgttccgttacg

SEQ ID NO: 68202 - DNA, 625 bp, Homo sapiens
  misc_feature: GYAE6OF02FLL9F.37.37.D04.1.454.CMB.1.raw
  modified_base (203)..(203): a, c, t, g, unknown or other
  misc_feature (203)..(203): n is a, c, g, or t
  modified_base (407)..(407): a, c, t, g, unknown or other
  misc_feature (407)..(407): n is a, c, g, or t
  modified_base (458)..(458): a, c, t, g, unknown or other
  misc_feature (458)..(458): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagcccaccctctcctgcagggccagtcagagtgttagcagcaaacttgccgtggtaccagcaacgaaacctggaccaggcctacccgaggcctcctcactctagtcggtcgaccagtcccgaccgacgggcctaacgtcggtacctcccgagccgtaagttccgaggtggacgtaggtcgggtcgtagggacaggtacgttccncgttctaccactctacgtagctacgcctgaccgtagtcgtaggtaacgttntttacggtactagtttttcttctgtctagtacgtgtaatttacgttacctaccgggtccttacggtacgtcgggtaccgttacggtaaccggtacgggaccgtaaggggtaacgtaactaaccggtaaacgttagtcgtacggctaccgaccgtacgatttcttacg

SEQ ID NO: 68203 - DNA, 857 bp, Homo sapiens
  misc_feature: GYAE6OF02IBEL7.37.37.D04.1.454.CMB.1.raw
  modified_base (185)..(185): a, c, t, g, unknown or other
  misc_feature (185)..(185): n is a, c, g, or t
tcagtagtgtagatcacgaccggtgctcgatttagtagcatactgttgggttgggaccaaaaccacaccctccttggagaatccctagatcacagctcctcaccatggactggacctggagcattcctttcgtggtggcagcagcaacgaggtcgcccactcctacgtggttacagccgtggtcnctagtcgtggagtcgtgaggtagaacgagccgtgggcctagagtgtaacggtcctccgtgacaaggtcttacgtcggttatacctttagactaagttacggtatacgtaacggtgggtcgccggtaacgaccgggtccccgtagggaaccgtaacgggtcctaaggtggtaaagggttcggaaacgggttggggtacttcgggaacgttacccggacggtaccggttaacctttaaaacgaaaccgttaaaacgtaaacctaacgaaacccgtacgttaaggtaccgacgtaaaaccgtaacggttaaacggttacccgaacggggtaaccaacggtaaccgtaccctaacccggtaacgaacccgtaaaggaaccgtaaacgtaacccgtaaccgaaccccggtaaaggtacccgaaaccgtaaacccgtaccggttaaccttaaacgggacgttaccggggaagttcccgtaacgggacggtaacgtacggttaaccgggagttaacggtcccgtaagggaaacccgttacccgggtacggtttaacccggtttaagttcggtacgtacgggtaaccggtaggtaaccgtaaccggttaaggtaacgtttaacgacgttttaaacggcggttaaacccgttcggggaacggtaccggacccggttaccgg

SEQ ID NO: 68204 - DNA, 688 bp, Homo sapiens
  misc_feature: GYAE6OF02ICA7Y.37.37.D04.1.454.CMB.1.raw
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
  modified_base (485)..(485): a, c, t, g, unknown or other
  misc_feature (485)..(485): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaaacaggtcgcccactctcaggttcagctggtgcagtcgtggagctggaggtgaaagaacgccgtggggcctcgaggtggaaggtcctccgtgacaaggtccttcgttggtttaacttacccttttagacttaaatttataggttaactacgaacgttgggtcgaccgacgaccggccccgtaggaaccaaggcccagtggaggtggagtagggatggatcgagcgtacttanaaataacaacacacatancgacaacagtaacgtccgaggacagacacctaccgacaacagaacgtactacactaccaagacaccaacgacgtacccttanacgtacggagtaccgtaggaaccggcgtaccgtaaggacgtacgtaccgtacggaaaccggtaccggtaccggttccgtttttagtttacgtacgggttacgacgggttaaacggaccggttaaactaaggttaaactttaggtttacgtaaagggtttacccggtaacggtccgggttaccggggacccgttaaacccgggg

SEQ ID NO: 68205 - DNA, 725 bp, Homo sapiens
  misc_feature: GYAE6OF02FYFMJ.37.37.D04.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (701)..(701): a, c, t, g, unknown or other
  misc_feature (701)..(701): n is a, c, g, or t
  modified_base (710)..(710): a, c, t, g, unknown or other
  misc_feature (710)..(710): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaattgtgatcggaacgctagtctccagccctacctctctgtgtctccaggacgaagngcccacctcnccgtggtacggccagtcagtagtgttacgacttacaacttaggcctggtacccaggccaagaaacccgtggaccctaagggtttcccccaggggtctacgactacagttacgtagtcggtgcctaacgtcccgaccgaacggggcccaacgttcgggttaacgtcccccaggtaccctaaccgttttacggtcggtaccgtaaggggttcgggtaccgtagggggtaaccaaggttaacggttaccctaactcccgtttacccggaaacctaccggttaaaccgcgaccggaacgtccccggttaggtacctacgggttaaccgtaagaaacgttacgtttgtaaccgttaaggttttaaccacgttcgttaacgaaactaagttaaccgtaaatcggtacgtacggtctaccgttattccgtttccggaacgggcgtaactagggtgaagtacggaactaacggtactaggtacgtcgtanaccgtaccncgtcttgttcctacg

SEQ ID NO: 68206 - DNA, 679 bp, Homo sapiens
  misc_feature: GYAE6OF02HW7NJ.37.37.D04.1.454.CMB.1.raw
  modified_base (288)..(288): a, c, t, g, unknown or other
  misc_feature (288)..(288): n is a, c, g, or t
  modified_base (316)..(316): a, c, t, g, unknown or other
  misc_feature (316)..(316): n is a, c, g, or t
  modified_base (400)..(400): a, c, t, g, unknown or other
  misc_feature (400)..(400): n is a, c, g, or t
  modified_base (496)..(496): a, c, t, g, unknown or other
  misc_feature (496)..(496): n is a, c, g, or t
tcagtagtgtagatcacgaccggtgctcgatttagtagcatactgttgggtttgggggacccaaaaaccacacccctccttgggagaatcccctagatcacagctcctcaccatggactggacctggagcattccttttcctggtggcagcagcaacaggtgcccactctcaggttcagctggtgacagtctggagctgaggtgaagagccgtgggcctgagtggaggtcctacctgacgaggtcttgtggttactactttagactaattagtggtatcaacgtgggncgacgacggccctggaccgaagcctagngtacggaggagtgggatggatcgagctactaaacaataaactaacaacgacactaactgacaacgacgtaagtaccgaagggtnaacggtacgtaccgtaccctaacgacccagaagtaactaccaacgtacccgaacgaacgccaaaccgtccgtaacctaacgtaacggtcgggtaanacgtggggaacgtacgttacccggagtaagtacttcggaaccggtaacgacccgggtttaacggtccgttttaggtttaccggtcggttaggaccggaaggttaacccgaaaggtacggttaaagttacgttaggttaaggttacccggtatttaacccgggaggggtaccccgttaaccggg

SEQ ID NO: 68207 - DNA, 725 bp, Homo sapiens
  misc_feature: GYAE6OF02IW8IA.37.37.D04.1.454.CMB.1.raw
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (401)..(401): a, c, t, g, unknown or other
  misc_feature (401)..(401): n is a, c, g, or t
  modified_base (598)..(598): a, c, t, g, unknown or other
  misc_feature (598)..(598): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccatctcaggttcagctggtgcagtctggagctgaggtgaagagccgtggggcctgagtgaagtcctctgacaggcttcgtggttaactacctttagactaagttntggtactcaacgtggggtnaccggtacacggccccgtgggaacacgggtacccagttggacggtgggacgtggggaacttgggaactacgaggccgtacttaacgaaattaacgtaacaacgtaaccacgttancgtaaccacgaaagtacctacggaggcctacggagtccctacacggaaccacaagtactacgtatcccgaacggacaccaccgacgtacccgttaacagttacgggaccgcggttacgggacggaacggtccgtacggtaacgtaccgttggtaccggaactaacccgggtaccggtttagtttacggttttaccgngggttaaccgtaccggggtaaacggtttaggaaaccggttaaaggttaaacgttaaggtttaacgttaacggtaccggggttaaccgtttaaccggggtaccgggggtaccccggttaaaccggggg

SEQ ID NO: 68208 - DNA, 756 bp, Homo sapiens
  misc_feature: GYAE6OF02HS6JN.37.37.D04.1.454.CMB.1.raw
  modified_base (234)..(234): a, c, t, g, unknown or other
  misc_feature (234)..(234): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagccgtggggcctcagtgaaggtcctccngacaaggtcttcgtaggtttactacctttagctaattagttggtatctaacgtggtgaccgacgaccggcccgtaggacgaacggcctagtgaggtggagtgggatgggactcgacgtcgtaccttaacaaattaaactaaaccaacaccgtaactatacgacaacgaaacggtaacgttaccggaagggacaacggtaacgttaccccaaccccggtaaccgaaacccaccgtaaagtaaccgttaaaccacgttacccgaacggactaaccgaccgaaccgtacctaacctaggtacgggacgtaacgtgggtaaacgggtactcccgggtaagaccggtattccggtaacggaaacccggtaaccgggtacccgggtttaccggttttaccgttttaacgtcggggttacgaccgggtaaggtaaacgtaacggtaacgtttaaagtttacggtttaacggttaacggttacggtaaccggttaacggggttacccgggggtaaccgttaaccccgggg

SEQ ID NO: 68209 - DNA, 816 bp, Homo sapiens
  misc_feature: GYAE6OF02I5561.37.37.D04.1.454.CMB.1.raw
  modified_base (144)..(144): a, c, t, g, unknown or other
  misc_feature (144)..(144): n is a, c, g, or t
tcagtagtgtagatcacgaccggtgctcgatttagtagcatactgttgggtttggggaccccaaaaaccacacccctccttgggagaatcccctagatcacagcctcctcaccatggactggaccctggagcattccttttccnggtagcagcagacaacgaggtcgacccactctacgtagggttccagcgttggtgcagttcgtaggagctgacggtagaacgaacggccgtgggcctacgagtagtacgtcctacgtgacgtaaggtccttacgtacggtttaactaaccgtttagacttaaagttagttacgggttactacccgtaaggttcggggtactaccggtaccggtaccggtcccccggttaagggaacctaaacgggccccttaaggtacggtaacgggtttaggaacgggtgggtaaactcggggtaactacgtaacgggccttaacgtaaacttaaacgtaaacctaaccaaccgtaactacggtacacgtaacctagaaaccgggtaaacggttacccggaagggtaccaaacggaccgttaccccaaaccgtcgtaaacccagtaacgaaacttacgtaacgaccgtaaacgaccgacctaccgaaccgtaacccgtaacgtaagtacggacggtactacgggacgtacggacgtacggtactacgtacgtacggtaaacccgtggtaacccggttacgtttaccgtttacgtacgtcgtaacggtcgtaacgtaacggtaattacgttaaggttaccgtagggttaccaacggtaccggacgggtaccccgtaacccggg

SEQ ID NO: 68210 - DNA, 681 bp, Homo sapiens
  misc_feature: GYAE6OF02F5KGF.37.37.D04.1.454.CMB.1.raw
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaagaagcgtgggcctcgagtgaagtctcctgcagcttctggttactacttagctaattntggtatacgagtgggtncgacncggccctaggacaacggccagtggagtggagttgggatggactcgacggtcgtacttaacgaacttaacaacgacaactacttacgtcgactaacgacgtaacggttccgagggtacaacggtacgtacccaaccgtacgaacccaacggtaactaactaaacccgtacttaaccccggaaacggcgaacccgaaacggtacccgtaccgtaaggtaacggttacgggacgttaccgtacggggaggacgtacccgaggtacggacttcggtaccgaacgtaccggttacccgggttacgttttacgttttacgaggttaccgtacggtaaggtaacggtaactaaggtaatttaggtagttaacgtacggtacgtacggtccgggaccgtaacccggg

SEQ ID NO: 68211 - DNA, 599 bp, Homo sapiens
  misc_feature: GYAE6OF02FIJ1W.37.37.D04.1.454.CMB.1.raw
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
tcagtagtgtagatcacgaccggtgctcgatttagtagcatactgttgggtttgggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagaacgccgtggggcctcgaggtgaacggttctccgtgacaaggtcttcgttaggtttactaccgttttagactaattatggtatacaacgtgggtgcgagccggccctggacaaggccatgacgtggatgggagtggatcagcgtctanaataaacacanacactatgacaacagtacgttcgagggtacagcgtaccaccgtagacccacgaagataccacgtacaccgtacgaccacgactcctaataggagacgtacgtaggacggacgtacgagaacggtntaccgnggaaaccgcgtacccggttcgtttcgttacgttgcgacggaagtacgaaccgtaagtattacgttagtaaggtaacgtacgtagggtaccggacggtaacccggg

SEQ ID NO: 68212 - DNA, 1023 bp, Homo sapiens
  misc_feature: GYAE6OF02I1LJP.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcgaggttcagctggtgcagttatggagctggaggtagaagacgtccgtggggtcctacgaggtgaacggttcctccgtcgacgaacggtcctttcgttacgttacttaccgttttagactaaattttacggtacggttataaccgtaacggttggggtaccgaccggaaccgtaacccggggtcccccggttaacgggaaccgaaacgggtccccgtaaaggtcgggttaacggggttagggtacgggttagggggaaacgtttaggggtaacccgttacgggtaaacccggtaccgtttaaaaacccgttaaaacgttaaaaacgttaaaaaccgtaaaaacccgtacccgtaaaccgtaaacccggttttaaagaccgtaaaccgtaaaccgggtaaaccggtttaaaaccggtttaacccggggaaaaccggggttaaccgttaaacgggggtaaaccccccgttaacccgtttaacccccgggtaaaccggtaaacccccgtaaacgttaaaaaccggtaaacccttaacccggttaaaccccgttacccgggaaaccgtaaccggtaaacccgtacccgaacgttaaccccttaaggtaacgtcgggtaacctaacggggtacggaaccggggtaacctccgggtaaggtaaccggtacttaccggaacggtaccccggtaaaccgggttaccccggggtttaccttttacggttttaccgggtagggttacccggttaacggtaccgggttaaatttaaacggtaacgttaaggttttacgtaacgttaaacgggttaccggttaaacggtaccccggggttaccgggaaacccgggtttaaccccggg

SEQ ID NO: 68213 - DNA, 731 bp, Homo sapiens
  misc_feature: GYAE6OF02H9LTK.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcattccttttcctggtggcagcagcaacaggtgcccactctcaggttcagctggtgcagtctggagctggaggtgaagaagccgtggggcctcagtggaacggtcctcctgacaaggtcttcgttaggttacttaccgttttagacttaattatggttaactacgaacgttggggttagaccgacgacgggtccccctagggaaaccaaggcccaagttgggaacggttaggaggttaggggagttagggtactacgacggtcgtacgtttaaactaaagttaaaactaaaccgaactaactaacttatacgacaacgtaaggtaacggtccgaggggacaggtaccgcctaacccgtgaaccacgaacgaataactactaccgaacgacgaccaacgacgtacctaacgacgtagggagcgtaaggaaggacgtaccgaaggtaacgtacgtaccgtacggaccgtaaccggtacggttacccgtttacgtttttaccgtcggtacggagtaacggtaacgttaagaaacgttaagtttaagttaaggttaacggttaacggtaaccgtttaccgggtaccggggtaaccggtaacccgggg

SEQ ID NO: 68214 - DNA, 625 bp, Homo sapiens
  misc_feature: GYAE6OF02I0LJ7.37.37.D04.1.454.CMB.1.raw
  modified_base (140)..(140): a, c, t, g, unknown or other
  misc_feature (140)..(140): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
  modified_base (403)..(403): a, c, t, g, unknown or other
  misc_feature (403)..(403): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
tcagtagtgtagatcacgaccggtgctcgatttagtagcatactgttgggtttggggacccaaaaaccacacccctccttgggagaatccctagatcacagctcctcaccatggactggacctggagtcatccttttccnggtggcagcagcaacaggtgcccactctcgtaggttcagctggtgctagtctggagctgaggtgaagagcgtgggctgagtgagtctctgcagcttntgtatcttgctatngtntcagtggngcgancgccgtggacaggcatcgngtggagngganggactgagtcgcttaacgaaattaagaaaccnctaacaagtataccgaanaacgtaacggtaacgttcggaacggntaacggtactaccgaccctaggaacccaanaaggtactaacgtactaccgaacgggtacacaacgtacncttaacnggtaggacgacgttaggaccggaggtccgtagtagtacgtacgtacggaaccgtcgtcggtaaccgtttttgtaaccgtggttaacggaccgttaagggaacttaacggtaagttagtttacggtaagttacgggtaaccggtagtaccggggttacgggaccgttaaccccgggg

SEQ ID NO: 68215 - DNA, 745 bp, Homo sapiens
  misc_feature: GYAE6OF02FZCFG.37.37.D04.1.454.CMB.1.raw
  modified_base (322)..(322): a, c, t, g, unknown or other
  misc_feature (322)..(322): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgccccactctcaggttcagctggtgcagtctggagtctgaggtgaaggaagccgtggggcctcgaggttaggaacggtctccgtggacgaacggtcgttcgtaggttacttaaccgtttagacgttaaatttagtggtaatacgtaaggtgggtatccgaacnccggtccccgtaggaacgaacggtaccgtaagtcggaggtaggacgtgggtaagtaggacgtcgacggtacgtacttaaacgaaattaaacgtaaccaactaacgtaacgttacgtacgaactaacgaaagggtaccgttacgggaacgggtacaaccgggtaacttaccccgaacccgttaccggaaccctaaacggtaacgtaaacttaacccgtacgttaaacccgaaccgggtacaacccgtaaccgacccgtaacctaacgtacggttaggacgtacgtaggacgacggtacgtagacgtactacgacgaccgtaaccgcggttcgttagtttacgagtggaacgtaggaacgtaagaacgttaatttaacggttagtaacgttacggtaaccgtacgggtacggcccggtaaccggg

SEQ ID NO: 68216 - DNA, 669 bp, Homo sapiens
  misc_feature: GYAE6OF02FH6ZW.37.37.D04.1.454.CMB.1.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
tcagtagtgtagatcacgaccggtgctcgatttagtagcatactgttgggtttggggaggaactgctcagttaggacccagacggaaccatggaagccccagcgcagcttctcttcctcctgctactctggctcccagataccactggagaaatagtgatgacgcagtctccagccacctgtctgtgtctccaggggaangccacctctctgcagggccagtcagagtgttagcagcaacttagcctggtaccagcagaaaccnggccaggcctccaggtcctcctcactctatcggtgcatccgacgacgggccacttggtactcccgagtccgaggttcaggtcggactaggtcgggtacgtcgggactaggtagttccgaacgttctaccgtaacccgtagttacccgaggtacctaacggccccgttaggccctaagggttcctaaggtacgttaagttttcggacgttacgtttttacttcgttgtaccgacgtcgtaacgttaattaacgttacgtacggttacccttaccggtaacggttcgggtaaccggtttccgggaacccgtaacggggaaccctaggggttaaccggtaaacgttacccgaaacgggtacttacgggtaccggacttaccggacctaaccgtacgttaccgtaccgg

SEQ ID NO: 68217 - DNA, 839 bp, Homo sapiens
  misc_feature: GYAE6OF02GVR5G.37.37.D04.1.454.CMB.1.raw
  modified_base (142)..(142): a, c, t, g, unknown or other
  misc_feature (142)..(142): n is a, c, g, or t
  modified_base (191)..(191): a, c, t, g, unknown or other
  misc_feature (191)..(191): n is a, c, g, or t
  modified_base (206)..(206): a, c, t, g, unknown or other
  misc_feature (206)..(206): n is a, c, g, or t
  modified_base (474)..(474): a, c, t, g, unknown or other
  misc_feature (474)..(474): n is a, c, g, or t
tcagtagtgtagatcacgaccggtgctcgatttagtagcatactgttgggtttggggaacccaaaaaccacacccctccttgggagaatcccctagatcacagctcctcaccatggactggacctggagcattccttttccnggtggcagcagacaacgaggtcgcccatctacgaggttcagcgttggtnaccagtcgtaggacngttggaggtgaaagacggtccggtacgggcctacaggtcggtaaggtcctccgtagaccgaaggttccttggttacggttaactttaccgtttagacttaagttagttagattacgaaggtcgggtcgacgtacgaccggtccgacggtaacgaccggtacctaagtgggtacggtaggtaggttacgggacgttaggacgtacgtcgtaacggttaccttaaacgtaaaacgttaaccgtaaaccaacgttaacgtaaccgtttaanaccgaaccgtaacgtaacggttaaccggttaccggaagggtaaccaacgggtacgtaacccccttaacgaaccgtaacccgtaggaacctttaaacgaccgacgttaacccgaacgacgaaaccacgtaaccggactttaacggtacggacgtacggtaaaccggtacggaaccggtaggaaccgttaacggtaacgtaaccgtttcggaacccgtaaacggtacccgttaaccgggttcggttttaacgtttaccggaggtacccggtaaggttaacggaacgttaaacgggtgtttaaacgttaggtaacggttaagttcccggttaaccggggtacgggttacccgggaccgtaaaccccgg

SEQ ID NO: 68218 - DNA, 887 bp, Homo sapiens
  misc_feature: GYAE6OF02FG895.37.37.D04.1.454.CMB.1.raw
  modified_base (193)..(193): a, c, t, g, unknown or other
  misc_feature (193)..(193): n is a, c, g, or t
  modified_base (750)..(750): a, c, t, g, unknown or other
  misc_feature (750)..(750): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtgcagcagcaacaggtcgcccactctcaggttcagctggtgcagtctgganctgaggtgaagagccgtggggcctcgagtgaacggtctccgtgcgaacggtctttcgtaggttacttaccttttagctaattctaggtactaccgtaacgtggggttacgccgtaaccgaccgggtcccccctaggggaaccaacgggccctaagtcgaggtaggtagtacggggtattcgggtaacttcggacggtaccgtacctttaaaaccgtaaactttaaacaaacccgtacctaaacgtaacccgttagtaccggaccgtaaacgtaaaacggttaaccggttcccgaacggggacccgtaaacggtaccggttacccaaccccgtagaaaccccaacgtaacgtacctaaacctaccgttaccccgaaacgggaccaaccccgttaacgtaacccgaacccgtttaaacgtaacggttaccggggaaatcccggttagggaaaccgggttaccgtacccggttaacgggtaacgtacccggttaaacggttaaccggaacccgggtaaaccgttaccggggtttacccgtttttagggttttttaaccgngggttaacccgggtaacgtaaaccgggttaacggtaaaccgttaaaggttaaaccgttttaaggttaaacggttaaaccggtttaccgggtaacctttacccggggggtacgggtaacccggttaaacccccggggg

SEQ ID NO: 68219 - DNA, 788 bp, Homo sapiens
  misc_feature: GYAE6OF02IMT4A.37.37.D04.1.454.CMB.1.raw
  modified_base (699)..(699): a, c, t, g, unknown or other
  misc_feature (699)..(699): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttctggtggcagcagcaacaggtgcccactctcaggttcagcgtggtgcagtcgtggagctgaggtgaagaagccgtggggcctgagtgaacgtctcctgacgaaggtcttcgttggttactaccgtttagactaagttagtggtactacgtaacgtgggtcgacgtacgaccggtcccccgtaggaaccgaacggtccaacgtggtaagggttcgggaaggtagggtaagtcgggaactcgaacggtaccgtaaccgttaaacgtaaagttaaaactaaaccgtaaccctaacgttaacctaacgtacgtacctaaacgtaaaggtaaaccggtcccggaaaggggacctaaacgggtaccgtacctaacccccgtggaaacccctaaagtaaccggtacttaaaccaccgttaacccgaaaccgggacgaacctaaaccgtaacccgttacccgtaaacgttaccggaagggttaacccgtcgggtaacgggaccgggtacgacccgttaaggtacgtactacgtacggaacgtacccgtcggtttaacgttcgtttacggngttacgggacgtaagaccggttaatacgttaaagttaggtttacgaacggtccggtaaaggttccgggtaccgggcggttaacccgggg

SEQ ID NO: 68220 - DNA, 234 bp, Homo sapiens
  misc_feature: GYAE6OF02GRG7S.37.37.D04.1.454.CMB.1.raw
  modified_base (193)..(193): a, c, t, g, unknown or other
  misc_feature (193)..(193): n is a, c, g, or t
  modified_base (215)..(234): a, c, t, g, unknown or other
  misc_feature (215)..(234): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtcgtagngctgaggtagaagacgccggtnnnnnnnnnnnnnnnnnnnn

SEQ ID NO: 68221 - DNA, 806 bp, Homo sapiens
  misc_feature: GYAE6OF02HQOL2.37.37.D04.1.454.CMB.1.raw
  modified_base (140)..(140): a, c, t, g, unknown or other
  misc_feature (140)..(140): n is a, c, g, or t
  modified_base (353)..(353): a, c, t, g, unknown or other
  misc_feature (353)..(353): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttccnggtggcagcagcaacgaggtcgcccactctcaggttcagcgtggtgcagtctggagacgtgaggtaggaagaacggccgtggggcctacgagtgaaggtctcctgcgaagtcttcgtaggttatacgtttagctaatatacggtatacaacgtgggtcgacgacgacggtaccccgttaggaaccgtaacggaccaaggtgacggtaggtagngggtatggaactcgaggtccgtaacgtaactaaagtaaactaaccgaactaacgtaacttacgacgaacaacgtaagtaaaccggttcgaacggggtaacaaaggtaccgtaaccgtaaccccgtacgaacccgtaacaaacggtaaaccttaaccaacccggttaaccaaacgggaacaacccggaataacccgacccgtaaacgtagtaacgggacggtaacgaacgggtaacggaacgtcccgtaaggaacctaacgcgttaaacccgaacgggtaacccgtacccgggttaccgtttaacggttttaacgtccggggtaacggtaaccgggttaaaggtaaacccggttaaacgaaacgtttaaagggtttaaacgtttaacgggttaaacgttaaccgggttaaccggttaaccgggtaacccggggacccggttaaaaccccggggg

SEQ ID NO: 68222 - DNA, 750 bp, Homo sapiens
  misc_feature: GYAE6OF02IWM0Z.37.37.D04.1.454.CMB.1.raw
  modified_base (315)..(315): a, c, t, g, unknown or other
  misc_feature (315)..(315): n is a, c, g, or t
  modified_base (556)..(556): a, c, t, g, unknown or other
  misc_feature (556)..(556): n is a, c, g, or t
  modified_base (650)..(650): a, c, t, g, unknown or other
  misc_feature (650)..(650): n is a, c, g, or t
tcagtagtgtagatcacgaccggtgctcgatttagtagcatactgttgggtttggggacccaaaaaccacacccctccttgggagaatcccctagatcacagactcctcaccatggactggacctggagcattccttttcgtggtggcagcagcaacgaggtcgcccactctcgaggttcagctggtgcagtcgtggagcgtaggaggtagaagaacgtccgtaggggccttcgaggtgaacggtcctcgtgacgaaggtcttcgttaggttacttaacctttagactaattagtggtactactaagttgggtanaccggaacgtaccggtaccccgtaggaacctaacggacctagtaggtaggtcggtaggtacgggaagtcggacgtacgacggtactacgttaaactaaactaactaaaccaacaacgtaactctacgaactaacgtaagtaacggtaccgacggacacgtacgtaccctaaccgtacgaacgaaccgtacgtaactaaccactacccggaacgacgacctaaacgtacgaccgttaaacgnggttaacgacggtacgtacggaaacggtccgtaacgtagtacgtacctacggaccgtaacgtacccggtaacggtttccgttaagtttacccgnggtacgtaaccggtaaggtaacctaacggtaagttaaccgtttaggttagtaacggttcggaacccgggtttacggttaaccgggaccggttaacccggg

SEQ ID NO: 68223 - DNA, 741 bp, Homo sapiens
  misc_feature: GYAE6OF02GMAAV.37.37.D04.1.454.CMB.1.raw
  modified_base (156)..(156): a, c, t, g, unknown or other
  misc_feature (156)..(156): n is a, c, g, or t
  modified_base (213)..(213): a, c, t, g, unknown or other
  misc_feature (213)..(213): n is a, c, g, or t
  modified_base (320)..(320): a, c, t, g, unknown or other
  misc_feature (320)..(320): n is a, c, g, or t
  modified_base (351)..(351): a, c, t, g, unknown or other
  misc_feature (351)..(351): n is a, c, g, or t
tcagtagtgtagatcacgaccggtgctcgatttagtagcatactgttgggtttgggggaggaactgctcagttaggacccagacggaaccatggaagcccagcgcagcttctcttcctctgctactctggctccagataccactggagaaatagtnatagacgctagtcctacacgcctaccctgtctggtctacgtccgaaggggggtaaancgaccgtacccttctccgtggccggagggtccctaaggtcaagagttacgttagacacgacgttaactagtccgtaggtaccagacgtacaaacgtcggctacgtcnccgtagcctacgtacactctagtcggtacgntaccaccgtaacgggaccggacctacggtacggttaacctcccgacggtaaccgtagtttaaccggaggttacggaacgtgggtttcgggggaccttagggggaaccttaaggtacgttaccgaaacttttccggaacctaacgtagtacggacacgttacggaccgctaggtactaggttacgtaacgttgtttacgttacggtagttttattccgttacgtactacggacgtttaaactagtttaacgttccgtacggttaaccgttccggtaaccgttacggtaccggtacggtaaccgtacgggaacggtaaacgggttacgaaaccgttaacgaacggttaacttacgggtacgtaagttcccgaagtaccttagttccggtacg

SEQ ID NO: 68224 - DNA, 643 bp, Homo sapiens
  misc_feature: GYAE6OF02GQYXS.37.37.D04.1.454.CMB.1.raw
  modified_base (296)..(296): a, c, t, g, unknown or other
  misc_feature (296)..(296): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcgaggttcagctggtgcagtctaggagctgaggtgaagaagccgtgggcctgagtgacggtctctgacaggcttcgtggttactacctttagctaattagtaggtatcgtaacggtgggtcgccgacncggacccctggacaaacggccagtgaggtggagtgggatggatacgagcgtacttaacgaattaacgtaacacgaactaacgttatagacaacgtaacggtaacgttaccgagggacaggtaccgtaccgacccgtacgacccaacgtacgactaacacgtacccgaagacgtacaaccgaactacctaacgagtacggactacgtagggacggtaccgacgtaggaacgtctaccgtacggaacgtaccggaccggttctttcgtttagcgtagacggtaagaacgtacgtaagtaactttagtacgttagtaccggtaacgtacgggtcgggaccgtaaccgggg

SEQ ID NO: 68225 - DNA, 719 bp, Homo sapiens
  misc_feature: GYAE6OF02GUKZW.37.37.D04.1.454.CMB.1.raw
  modified_base (611)..(611): a, c, t, g, unknown or other
  misc_feature (611)..(611): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtagaagtaagccgtgggggcctcaggtgaagtcctctgacaaggtcttctggttatacctttagactaatttagtggtattcgtaaacgtggggtacgcggtaccgaccgggcccctgggaacgtaaacgggccaagtaggtagtgggacgtggggaacttggatcgagcggtcttaacgaataactaacgacacgaactatggacaacgtagtaaacggttcgaagggtacacggtagtcccaaccgtacgtacccaatacggaactaccgtaccgaacctacggaacgaccaacgacggacccttacgaacgttacgggacgtcgtaaggtacgggaacgtccgtagggaactacgttaccgtagggaaaccgtacccgggtacggttacggtttacggtttttaccgngggtttaccgacgggtaacggtaaccgttacgtaaaggtaaacgtttacggttaaggtaaccgtttaacggtacccgtacgggttacccgggaccgttaacccggggg

SEQ ID NO: 68226 - DNA, 722 bp, Homo sapiens
  misc_feature: GYAE6OF02F9D4R.37.37.D04.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagataccactggagaaatagtgatgacgcagtctccagcccaccctgtctgtcgtctccgagggggaaangcccaccctntcctgcgagggccagtcagagtgtagcagctaacttgccgtggtaccagcagaaacctggccaggctcccgaggcctcctcatctatggtcgcactccgacgtacgggccacgtggtactcccgagccgtaggttccaggtcggacgtaggttacgggtctacggggacaaggtacgttacgacctcgttaccaaccgtatcgaacggtccaaggtcccgtagtaccgtaagtaccgtaggtaaacgtttacgttttagaccgttaggtttttactttcgtacgttactaaggttaccgtaagttaaactttaacgtttaaccgttccggtacccgttaaccggttaacggtttacgggtaaccggtttacccggggaccggtaaacgggggtaacccgttaaaacggggttaacgggttaaaaccttaacgggtaaaaccggaacggtttacggttacgggaccctttaacgggacccctaaccttaacggtttccgttacgg

SEQ ID NO: 68227 - DNA, 712 bp, Homo sapiens
  misc_feature: GYAE6OF02IK44Z.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctggaggtgaagagcgtgggcctcagtgaaggtctctgcgaaggcttcgtggttataccttagactaattacgtggtactacaacgttgggtgcgtacgcggccccgtggaaccgaaggccctaagtcggtaggtggtaggtcgggtagtggagtcaggtccgtacttaaacgaaataaacgtaaactaaccgaactaacgtaatcgacaaactaacggtaaacgttccgaagggctaaacggacgtaccacccgtacgaaccgtaacgagaacgtaactacgtaccagtacgacacgtacgactaacgtagtacggatccgaggtacggaacgtcgtaacggagtacgaccggtaaggacccggtaaccggtacggtccgtttttaacggtttaaccgcgggtaaccggtaccgggaaagttaaaccggaacgtaaacggttttaaagtacggtttaacgttaaacggtccgggttaaaccggttacgggttaccggggtaaccggtaaacccggggg

SEQ ID NO: 68228 - DNA, 823 bp, Homo sapiens
  misc_feature: GYAE6OF02H6XAQ.37.37.D04.1.454.CMB.1.raw
  modified_base (340)..(340): a, c, t, g, unknown or other
  misc_feature (340)..(340): n is a, c, g, or t
  modified_base (612)..(612): a, c, t, g, unknown or other
  misc_feature (612)..(612): n is a, c, g, or t
tcagtagtgtagatcacgaccggtgctcgatttagtagcatactgttgggtttgggggagaactgctcagttaggacccagaccggaacatggaagccccagcgcagcttctcttctctgctactctggcctccagactaccactggaagaaatagtgatgacgcagtcctaccagcccacctgtcgtgtcgtctcggagggaaagcgcccgtaccctctccgtgacgacgggcctaggtcaggtagtagtacgacacgactaacttagcctaggtaaccagtcgaacgtaaccgtggaccacggacctcccgagctacgaatctagtcttagtcggacnctacgtcccgaacgtacgggacctaagttacgggtaaccttcccgaaggttccccttaacgtttcggggtacgtacgggtacggttcgggttaccggttacgggggaaacttcgggtaactttccgtaaccgttacccgtactacccgtacgttacgaccgttaaccggaaccgggttccctaacggggcttttaaacggtcggtttaaagtaaaggggttttactttttaccgggaaaccgtttttaacgttttaaacgtacccggttttnttaaaacccgggtaaacttaacggtttaaaacgttaaccggtcccggtttacgtaacccgggttcctttttcccgtaacgggttaccggttcggggtaaccccgggaaggttaacccgtaagggttcggaaaccgtaaccgttaaggtaaacccgttccggttagggtcccgtactaccggttaaccgctttaccgggttcctttaaccgg

SEQ ID NO: 68229 - DNA, 951 bp, Homo sapiens
  misc_feature: GYAE6OF02G7H9B.37.37.D04.1.454.CMB.1.raw
  modified_base (862)..(862): a, c, t, g, unknown or other
  misc_feature (862)..(862): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctgggagctggaggtagaaggaacgccgtggggcctcgaggtaggaacggttcctcctggacgtaacgggtctttacgttaggtttaacttaacccgttttaggacctaaagtttagttagggttaacttaccgtaaaccggttgggggttacgaccggtaaccggtaacccgggtaccccccggttaggggaaaccgtaaaccgggggacccctaaggttacgggtaacggggtttacggggtaacggttagggggtaacgttaacggggtaacgttaccggtaacgggtaccggttacccgtttaaaaccgtaaaaacgtttaaaacgttaaaccccaaaacctaaaccgtaaaccgtttaaacgttccggaaaccgttaaaacccgtaaaacgggttaaaaccggttttaacccggggaaaccgggggtaaccgttaaacgggtaaacccggttaccccgtaaacccccgttacgggaaaccccctaaacggtaaacggtaaacttaaccccgtaaccaaccccggtaaaaccggaaccgacgtaaaccccgaaccggtacccgttaaaacgacgggtaacgggtacgaaccggttaggaaccgggaacggtccttaagggacgtacgtcgtaaccggaacgtccgtaaccgggtcgtttaacgtttaccgnggtaacgaccggtaagaacgttaacgtaaggtaacgttaggttacgtaaacgggtctaacggttaccgggtagggtaccgtaaccgggg

SEQ ID NO: 68230 - DNA, 763 bp, Homo sapiens
  misc_feature: GYAE6OF02FY6L5.37.37.D04.1.454.CMB.1.raw
  modified_base (625)..(625): a, c, t, g, unknown or other
  misc_feature (625)..(625): n is a, c, g, or t
tcagtagtgtagatcacgaccggtgctcgatttagtagcatactggttgggtttgggggacccaaaaaccacgacccctccgttgggaggaactcccctagatcacagctcctcaccatggactcggaccgtggagtcatccttttcctggtggcaggcagcaacgaggtgcccatcgtacaggttcagctggtgcagtctggagtctgaggtgaaggacgccgtggggcctacgacgtgaaggtcctcctgcaaggcttcgtaggttaactaccgtttaagctaacgttataggttattacgtaacgtgggtagaccggaccgtacgggtccccctagggtaactaacgggacccgagtacggtaaggtggtaagttacgggtagtagggtaactacgacggttaccgtacgttaaactaacttaaaacgttaacggaaccgtaaccgaacgtttaacgtacggtactaaacgtaaacggtaacggttaccggaacgggggtaactaacggggtacccgttaccgaaccccgtacggaacccgtaccaacggtaacttaacccgacttacccggaaccggtaccgaaccgtaacgaccgtaaccgttaacgacgttacgggacncgttaacggaggtacgcggtagtacgacgtacgtggaacgcgtaccggtcgttacgttacgtggtgacggtacgtacggtaactaaggtaacttagttacgtaacgtcgggtacgtacggtcgggtaccgtaaccggg

SEQ ID NO: 68231 - DNA, 765 bp, Homo sapiens
  misc_feature: GYAE6OF02ITKPL.37.37.D04.1.454.CMB.1.raw
  modified_base (170)..(170): a, c, t, g, unknown or other
  misc_feature (170)..(170): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctccagataccactggagaaatagtgatgacgcagtcnccagccaccctgtctgtgtcctccgaaggggaaaagcgcccaccccttctccgtgcgagggccaagtcagagtgttagacagactaacttgccgtggtaccagacaagaaacctggaccaaggcctccaggcctaccgtacattctagtggtcgacactacccaccgaggacctacgtaggtactccccgaggccgtaaggtttcgaaggtcggtaccgtagggttacggggtacgttacggggacgtaaacgggtaacgtttccgaaccgttcctaccgaaccctagttaccgacgtacgacgacccgtacggacgaggttactacgggaaagtttagtttacgtaccgttaagtttttactttacgtaccgtacgtagtaactaacggtttaacttaaacgtttaccgttaccggtcccgtttaccccggttaacgggttacgggttaaacccggtttaccgggggtaaacccggaaccgggtaaaccggttaacgggttaacgggaaaaccggttaaccgaaaaacggttaacgggtacggttacggtacccgttacggtaacccgttaaaccgtacttacccggtttaacg

SEQ ID NO: 68232 - DNA, 762 bp, Homo sapiens
  misc_feature: GYAE6OF02IM716.37.37.D04.1.454.CMB.1.raw
  modified_base (136)..(136): a, c, t, g, unknown or other
  misc_feature (136)..(136): n is a, c, g, or t
  modified_base (188)..(188): a, c, t, g, unknown or other
  misc_feature (188)..(188): n is a, c, g, or t
  modified_base (506)..(506): a, c, t, g, unknown or other
  misc_feature (506)..(506): n is a, c, g, or t
  modified_base (519)..(519): a, c, t, g, unknown or other
  misc_feature (519)..(519): n is a, c, g, or t
tcagtagtgtagatcacgaccggtgctcgatttagtagcatactgttgggtttggggacccaaaaaccacaccctccttgggagaatcccctagatcacagctcctcacatggactggacctgagcatcctttccnggtgcagcagcaacaggtgcccatctcaggttcacgctggtgcagtctgganctgacggtgaagaagcctggggcctcgagtggaaggtctccgtgacgaaggtccttactagggttacttaccgtttagactaatttagtggttactacgaacgttgggtacgccgtaaccacgggccccgttgggacctaacgggtcccaagtcggaggtgggaagttcgggagtggacttcgaacgtcgtacttaacaacgttaaataaccagtaaccaacttagtccgacaacgaacgtaacgtttccgaacgggcaacggtaggtcccaacccgtagaacctacgaaagtactaaccgaactacccgaacggtanaccggtaaacccnccggtacctaagtacgtaagggacctacggacgggaacggcggtacccgtaggtaaccgggtacttcgggtaaccgaaacccgggttaccggtaaacgggttcccgggtttttaacgttttacggtacgggttacggtaccgggtaaggtaaccggttaaaccgaggtttaaacggtttaggtttaacgtaacggttacgggtaaaccgttacgggggacggggttacccggaaaccccgggg

SEQ ID NO: 68233 - DNA, 679 bp, Homo sapiens
  misc_feature: GYAE6OF02JYE5Q.37.37.D04.1.454.CMB.1.raw
  modified_base (230)..(230): a, c, t, g, unknown or other
  misc_feature (230)..(230): n is a, c, g, or t
  modified_base (441)..(441): a, c, t, g, unknown or other
  misc_feature (441)..(441): n is a, c, g, or t
  modified_base (588)..(588): a, c, t, g, unknown or other
  misc_feature (588)..(588): n is a, c, g, or t
tcagtagtgtagatcacgaccggtgctcgatttagtagcatactgttgggtttggggacccaaaaaccacacccctccttggagaatcccctagatcacagctcctcaccatggactggacctggagcatccttttcctggtggcagcagcaacaggtcgcccactctcaggttcagctggtgcagtctggacgctggaggtagaagaagccgtgggcctcagtgagtcncctgacagcttcgtgttatacttagcaattgtggtaatcgacgtgggtcgacgacgtacggccctaggacaacggtcagtgaaggtggagtacgggtatgggatacgaggtacctacgttaaccaaagtaaactaaccgaaactaaccgtaataacgtacgacgaacgtaacgtaacgttaccggaagggtacgaaagtaccggtaacccnccgtaacggacccaaagacgtaaccgttaacacttaaccacgggaacctacgaactacgacttacgataggaccgatacgggacgacgttcgtaccggagtagtaccgtaggaaccctacgggtaccggttccgtttagggttaacnccgggttaagcggtaaaggtacgtacgtaagttaacgttacgtttaggtacggtaaccgtagttacccggggaggtacccggtaacccggg

SEQ ID NO: 68234 - DNA, 712 bp, Homo sapiens
  misc_feature: GYAE6OF02J1N3N.37.37.D04.1.454.CMB.1.raw
  modified_base (213)..(213): a, c, t, g, unknown or other
  misc_feature (213)..(213): n is a, c, g, or t
  modified_base (256)..(256): a, c, t, g, unknown or other
  misc_feature (256)..(256): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagataccactggagaaatcgtgatgacgtcagtcctccacgcctaccctgtctgtcgtctccgaaggggtaaacngccctaccctctacctgcgacgggcctaggtccgagtaggttnttacggactaggacctaacgttagtcccgtggtaacccagtacgaacgtaacctgggacccaagggcccttaccgacggccttacctcgtaactccgttagtcggtcgactccgtccaccggtacgcctaacgtcgtactcccagaccgtacgttacgngtcgcgtacggtggtcgacggtacgngacggtttcacctttactccgaacctagtaccgacggcctacgtaccgtcggactacgttacgtagttaacgttcttacggttacgtttaaacgttttcgttacgtgtaccgtagtcttaaaggtacgtttaaacttcggtaccgttaccgttaccggttacgtacggttcccgtaaggtcccgaacggtaacggtacggtaacggaaacttaccggtaaaccggtacgtacgggtacctaccggtactaccgtacctcgttagttacccg

SEQ ID NO: 68235 - DNA, 816 bp, Homo sapiens
  misc_feature: GYAE6OF02HHWDA.37.37.D04.1.454.CMB.1.raw
  modified_base (713)..(713): a, c, t, g, unknown or other
  misc_feature (713)..(713): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgaggtgaacgaagccgtggggcctcgagtggaagttcctccgtgcgtaaggcttcgttggttaacttaccgtttagactaaagtttatggtaacttaccgaagttcggggttcgccggtaacgaccgggtaccccccgtagggaaccgaaacggtcccgtaagtaggagggtttggaaaggttgggaattacgggaaacgttccggaagtccggtaacttaaaccgtaaaaagttaaactaaactaaaccgtaactaacgtttaacgtacgaaccgtaacgtaaacggtaaccggtttacccggaaggggtacaacgggtaaccgtccgtaacccgttaggaacccgtaaacgtacgtaaacgttaacccgtacgaccccgaagaccggaaccacgaacccgtaccgtaaacgtacggttaaggaaccgagttacgggaccggtaaccgttccgaggtaacgtaccgtacggttaaccgaagggtcccgtaacgggtttacccgttaggtttaacggngttaccggaacggttaaacggaccgttaaagaattaaccggtttagttaacggttaacggtcgtaacccggttacgggtaccgggttaaccggtaacccgggg

SEQ ID NO: 68236 - DNA, 937 bp, Homo sapiens
  misc_feature: GYAE6OF02IBH23.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtcgcccactctacaggttcagcgtggtgctagtctggagctggaggtagaagaagccgtggggacctcgtaggtaggtaacggtccttacccgtaggtaccgaaacgggtcctttacgttacggtttaacttacccgttttaaggaaccttaagtttaagttacggttaacttaacccggtaaacggttagggggttacgaccgggtaaccggtaacccgggtaccccccgttaggggaaaacccgtaacgggaccccgtaaggttaccgggtaaggggttacgggtaaggtagggggtacgttaacggggacctaccgggtaacggtaccgttaacgttaaaccgtaaaagttaaacctaaaccggtaaacctaccgttaacgtaacgtacgtaaccgtaaaacggtaacggttaaaccggttcccgggaaacggtaacgtacggtaaccgtacccgtaaccccgtaacgaaccaaacgtacgtaaactaccgaacgtaccggaaaccgtacgaacccacgtaaccgtaccctaagtaggttacggaccgtacggtacggacgggtaccgttaccgtaaggtacttacggtaccgaaacccgggtaccggtacccggttaaccgggttccgttttaacgggtttacggtaccgggtaccgggtaacggtaacggttaacggtaaccggttaaacgttaaggtttacggtttaaacggtacggtttaaaccggggttacccgtaacggggtttacccggggcccgggttaaacccgggg

SEQ ID NO: 68237 - DNA, 761 bp, Homo sapiens
  misc_feature: GYAE6OF02GTR8V.37.37.D04.1.454.CMB.1.raw
  modified_base (340)..(340): a, c, t, g, unknown or other
  misc_feature (340)..(340): n is a, c, g, or t
tcagtagtgtagatcacgaccggtgctcgatttagtagcatactgttgggtttgggggaggaactgctcagttaggacccagacggaaccatggaacgccccagcgcagcttctcttcctcctgctactctggctcccagataccactggagaaatagtgatgacgcagtctacagcccaccctgtctgtgtcctaccggaagggaaagcgcccaccctctccgtgcgaggccagtcagagtgtagcagactacgttacgcctacggtaccagacaacgtaaaccgtcggaccaacggtcctacccgagggtcctccctactactaccgttgtcggtacnccgacctacccgaccggtacgggacctacggacgttacctacccgacggtaccggtaggttccgaggtacgtacggtagggttcgggtacggtacgggtacgtaacgttacgttaccctacccgttacccgtaccgaaccgtaaccgttaccgaacggttccgtaaacccgttcccgtacggtacggttacgtacggttaacggtaacgttttacgttttacgttaacgtttagtttttacctttacgtcgtttacgtagttacgtatttaaacgttactttacgtacgtcccgttaccgttagggtcggttaaccggtacggtaccggaaccggtacggtaagggtaaccgtaagttaaaccggaacggttcggttacggtaccgtacggttccgaccttaacccgtcggtactttacgg

SEQ ID NO: 68238 - DNA, 915 bp, Homo sapiens
  misc_feature: GYAE6OF02G5T0D.37.37.D04.1.454.CMB.1.raw
tcagtagtgtagatcacgaccggtgctcgatttagtagcatactgttgggttgggggacccaaaaccacgacccctccttgggacgaagtccccttagatctacagtctctcaccagtgactggacctggagacatccttttccgtggtggtcgagcgagcctaacgtaggtttcgcccgtacgtctacgtaagggttcagtcgtggtgcgtagtcgtgggacgtcgtaggagggtagaaacggtaacgggcccggttgggggtccctaggacgggttcgggtaaccggttccgtaccgtacggaccgtaacgggttcttacggttacgggttaacctttacccggtttaaggaccttaaacggttttacgttacgggttaaaccttaccggtaaacgggttcggggtacctaccgggtaaccggtaccccggggttaccccccggagggtaaaaccgaaccggggttcccctaaaggggttacgggggtaacggttcggggtaagggttacgggggtaagttccgggtaagttaccgtaacgggttccggttaaaccgttaaagtaaaacgttaaccgtaaaccgaacccgtaactaacggtttaacgtcggaacctaaacggtaaacgttaccggtacggaacggggtaccaacgggtacccgtccctaacccgtagaaccgactaacggtactaccgactaccgacgaacaccgtaacacgtacctaagtagtacgacgtaccgagtacgggcgtacggacgtacggaccgttcggaaccggtccgtaaacgttccgggtttacttacgttaggtcgtaacggacggtaaggggtacgttaacggtaagttacgtttacgttacggttaaggtcccggttaaggtccgggtaccgggaccggttaacccggg

SEQ ID NO: 68239 - DNA, 767 bp, Homo sapiens
  misc_feature: GYAE6OF02IIJ0P.37.37.D04.1.454.CMB.1.raw
tcagtagtgtagatcacgaccggtgctcgatttagtagcatactgttgggtttggggacccaaaaaccacacccctccttgggagaatcccctagatcacagcctcctcaccatggactggacctggagcattccttttcctggtggcagcagcaacaggtgcccactctcaggttcagctggtgcgagtcgtgggagtcgtggaggtagaaggaacgtccgtggggcctacgaggtggtaaggtcctcctgacacggtcttacgtaggttactacctttaggactaagtttacgtaggtattacgaacggttgggacgacgtacgacggtaccccgtaggaacgaacggtcctaagttacgggaggttggggtaagttgggggaattcgggaacttccgggaagtccgttaaccgtttaaacgaaaacttaaacgaaacctaactaacgtaactaagtccgaacgtaaacgtaaggtaaccgttacgggaacgggtacctagggtaacctacccgtacccgtagaaacctacgaacgtaactacgaaccgtacccgaacgacgaaccgacgtaaccgtacctaaacggtacgtacggaaacgttcgtaggaacgggtcacgtaacggtcgtagtaccgtagaaccgaccggtaccggttccgtttaggtttacggtgttccgtaaggagggtaaccctagtaaacgttaagttacgttaaggtacgttacggtaaccggtacggttaccgggaccgttaacccggg

SEQ ID NO: 68240 - DNA, 872 bp, Homo sapiens
  misc_feature: GYAE6OF02F10IB.37.37.D04.1.454.CMB.1.raw
  modified_base (129)..(129): a, c, t, g, unknown or other
  misc_feature (129)..(129): n is a, c, g, or t
  modified_base (198)..(198): a, c, t, g, unknown or other
  misc_feature (198)..(198): n is a, c, g, or t
tcagtagtgtagatcacgaccggtgctcgatttagtagcatactggttgggtttggggacccaaaaaccacacccctccttgggagaatcccctagatcacagctcctcaccatggactggacctggancatccttttcctggtggcagcagacaacgaggtcgcccatctcaggttcagtctggtgctagtctgganctggaggtgaagaacgccgtggggcctcgaggtacgaacggttctccgttaggacgtaacgggtctttcgttaggtttaaccttaccgtttaggacttaagttagtacggttaactacgtaacggttgggttacgtccgtaccgtaccggtccccgtaggaaccgaacggtaccgtaagtaggagggttaggtacggtacgggtagtaggactacgacggtacgtacttaacgaaacttaacgaaaccaccgtaactacctacgttaccgaacgaacgttaaaccgtaacggttaccggacgggggtacctaacgggtaaccgttacccgtaacccgtaacggacccgtaaaccggtaacggtaacctaaccggtaaccctaccgtaaaccgggtaacgtaacccgaaaccgtaacccgtaccgttaacccggttacgtaaacgggtacgtaccgttagggaaccggttaaccggtaccgtcggtaaacgtacgttaacccggtaacggtacccgggtaaccggtacccggtttaccggttttaacggtttacggtaccgggtacggtaaccggtaaacggttagttaaacccggttaagttaaagtttacgggttaattaacgggtacggtttaaccggtaaccgggtttaccgggacccggttaaacccggg

SEQ ID NO: 68241 - DNA, 630 bp, Homo sapiens
  misc_feature: GYAE6OF02IFAL0.37.37.D04.1.454.CMB.1.raw
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (412)..(412): a, c, t, g, unknown or other
  misc_feature (412)..(412): n is a, c, g, or t
  modified_base (441)..(441): a, c, t, g, unknown or other
  misc_feature (441)..(441): n is a, c, g, or t
  modified_base (542)..(542): a, c, t, g, unknown or other
  misc_feature (542)..(542): n is a, c, g, or t
tcagtagtgtagatcacgaccggtgctcgatttagtagcatactgttgggtttggggacccaaaaaccacacccctccttgggagaatcccctagatcacagcctcctcaccatggactggacctggagcattccttttcctggtggcagcagcaacaggtgcccactctcaggttcagctggtgcagtctggagctgaggtgaagaagccgtgggcctgagtgaacggtctcctagcaaggtcttgtaggttatacctttagactaattatggttatcaacgtgggtcgcgacgacggcccctaggaaccaaggccagtggacgtggagtgggatggactcgancgtactaacaataanaacacactactatacgcaagagtaacgtcgaagctagacgtaccacccgtanaccaacgacgactacactaccgaacgganaccgactacgaccgttaacgaagtcggtacgtcgtaagggaaggtcgtacctaaggagtactacgtagaaccggtcgtaccggtacgttttacggtttacngggttacggacgtaacggtaatacgtaacgttaagttagtttaacgtaaggttacggtaaccgtaggttaccgggaccgtaacccggg

SEQ ID NO: 68242 - DNA, 752 bp, Homo sapiens
  misc_feature: GYAE6OF02GLS8V.37.37.D04.1.454.CMB.1.raw
  modified_base (195)..(195): a, c, t, g, unknown or other
  misc_feature (195)..(195): n is a, c, g, or t
  modified_base (239)..(239): a, c, t, g, unknown or other
  misc_feature (239)..(239): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctgggtcgcagtctggancgtgaggtgaagaagccgtggggcctcaggtgaaggtccttccngacgaaggtcttcgtaggttactaccgtttagctaaagtttagtgggtatacctaacgttggggtagccgacgacgggccccctagggaaccgaaggccctaaggtggtaacggtgggaacggtggggacgttagggaattcgaggtccgtacgttaaacaaacgttaaaacaacctaaccaactaacctaatcggaactaacgaagtaaccggttaccgacggggtacaggtaccggtaccctaaccccgtaggaacccgaacaacgtaactaacgaacctacccgaacggaccaccaaccgaaccgtcccgttaacaacgttacgggacgtacggtacggacgggaccgccggtagtacgtacgttacgacggaaacccggtacggtacccgggttacggtttacgttttaccggtaggacggtaccggtaaggtaaaccggtacgtaaaggttactttaagttaggtacgtaccggtaacggttaccggtacgggaccgttaacccgggg

SEQ ID NO: 68243 - DNA, 829 bp, Homo sapiens
  misc_feature: GYAE6OF02HKLVS.37.37.D04.1.454.CMB.1.raw
tcagtagtgtagatcacgaccggtgctcgatttagtagcatactgttgggtttggggacccaaaaccacacccctcttgggagaatcccctagatcacagctcctcaccatggactggacctggagcattccttttcctggtggcagcgagacaacgaggtcgcccactccgtacgtaggttcagcgtgggtcgactagtcgtaggacgtcgtagagggtagaaacggaacgtccggttcgggggaccctacgaggttaggtaacggttccgtaccgttaggaccgtaaaggtcctttacggttaggtttaacttaaccgtttaacgtacgtaaatttacgtggtaactacgtaacggttggggtacaccgaacgaccggtaccccgtaggaacgaggccagtaggtaggtacggtaggtagggtactgggacttacgacggtccgttaacttaaacgaaataaacgtaacaacctaagtaacctacgtacgacgaacgtacggttaaccggtacggaacggacaacgggtacccttaacgtaaccccggtacgaaaccaacgtaagtaaactttaaccgacccgttaaccggacgtaacgaccgaaaccgaccgtaccgttaacgacggtacggtaccgtaagtacggtacggacgttaccggtaaggaacgtacgtagtaaccggaacgtaccggtacggtttaaccggtttagttacgtcggtaaccgggagtaaacggttaggtaaacgtaaggttaaacgtttaggtaacgtttaacgggacgttttaaccgggacgggttaccgggaaccgggttaacccggg

SEQ ID NO: 68244 - DNA, 358 bp, Homo sapiens
  misc_feature: GYAE6OF02FU15N.37.37.D04.1.454.CMB.1.raw
  modified_base (260)..(261): a, c, t, g, unknown or other
  misc_feature (260)..(261): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (281)..(358): a, c, t, g, unknown or other
  misc_feature (281)..(358): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccctggcacccctcctccaagagcacctcgtggggggcacagccggccctgggctgccttggtcaacggactacttcccatctacactactgacgcgggtactggacagggcgcaagtagnntancagtcngctgatcatgnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68245 - DNA, 737 bp, Homo sapiens
  misc_feature: GYAE6OF02I2V00.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagcgtgaggtgaagaagccgtggggcctcgagtgaaggtctcctgcgaaggtcttcgtaggttactacctttagctaattatggtatactaagtgggtgacgaacgacggccccgtaggaacctaacgggcaacgtggaggtaggagtagggtatgggatacgagcgtacgttaacaataactaacacaacgtactacagacacgtaagtaacgttacgaagggactaacggacgtaccgtaccgtacgaacctacgtaacgaactaacgacctaccgaacgtaacgacccaaaccggatacccgtaactaggttacggaacgtacggtaacggaacgggtaacgccggttaacgggaacggtaacgttccggtaacggtaacccgaaccggttaccgggtaacgttttacggttttaaccgtgggttaccggtacgggtaaacgggaccggtttaaacgaaaggtttaaacgtttacgtttaacggttaaacggttaccgggtaacggtttaacgggtaccgggggtaacccggtaaacccgggg

SEQ ID NO: 68246 - DNA, 902 bp, Homo sapiens
  misc_feature: GYAE6OF02JXZKQ.37.37.D04.1.454.CMB.1.raw
  modified_base (128)..(128): a, c, t, g, unknown or other
  misc_feature (128)..(128): n is a, c, g, or t
  modified_base (143)..(143): a, c, t, g, unknown or other
  misc_feature (143)..(143): n is a, c, g, or t
  modified_base (700)..(700): a, c, t, g, unknown or other
  misc_feature (700)..(700): n is a, c, g, or t
  modified_base (723)..(723): a, c, t, g, unknown or other
  misc_feature (723)..(723): n is a, c, g, or t
  modified_base (734)..(734): a, c, t, g, unknown or other
  misc_feature (734)..(734): n is a, c, g, or t
tcagtagtgtagatcacgaccggtgctcgatttagtagcatactgttgggtttggggaacccaaaaaccacacccctccttgggagaatcccctagatcacagctcctcacatggactggacctggancacttcctttttccnggtggcaagcagaccaacaggtcgccctaccttctcgacggtttcacgtccgttgggttacgccgtaggttccgttagggagtcgttagggaaggttagggaaacggtaacggcccggttgggggtaccttcggaggttaggtaacggttccttaccgagacgtaacggttccttacgtttacgttaaccttacgtttaacgaacttaagttacgtggttaactacggtaacgttgggtaccggacggtaaccgtaccgggttaccccggagaaacggtaacgccgttaagtaaggtacgggtagtaacgggttgttaacggaggtaccctcgggtaacgtagtaaaccggtttaaagtaaaacctttaaaccgtaaaaccacttaacccgtaactacggttaagaccgtaaacgtaacggtttaaaccgtaccgggaagggtacccgaacgttaccgtaacccgaacccggtactaacccggaactagtaaacccgttagacccgaaacgttcaaacggacctaccggaacgtacgttacgacggtacggacgttnaaccggggtacggtcttaacggngtttaaccggnttaaccgggtacgtaccggcggttaaccggtttaccgttaacgtttacgggacgttccggtaaaagggtccggtaaactttacgggtaaattttacggggttaaacttaaggttttaccgggtacccgtaggggtttaacccggttaccggggaacccgtttaccggg

SEQ ID NO: 68247 - DNA, 831 bp, Homo sapiens
  misc_feature: GYAE6OF02IC2BU.37.37.D04.1.454.CMB.1.raw
tcagtagtgtagatcacgaccggtgctcgatttagtagcatactgttgggtttggggacccaaaaccacacccctccttgggagaatcccctagatcacagctcctcaccatggactggacctggagcattccttttcctggtggcagcagcaacgagggtcgccccactctcgtacggttcaggtccgttgggtgctacggtcgtgggacgtcgttggagggtacggaaaggaacggcccggttcgggggccctacgtaggttaggaacgggttcctaccgtaggacgaacgggtcctttcgttcgggtttaacttacccgtttagaactaagtttagttggtaacttacgaacggttggggtcacggtacgtccgggtaccccgtagggaaccgaacgggtccctaagttcggtaggttacgggagtagggtagtaggactacgacggtacgttacttaaacaaagtaaacctaaacgactactactagtacgactaaggaacgtacgtaccgagggtacacggtactacccacccgtagaacccgactaagactacgtacctcgaaacgacgtaaccaaccgaccgaccgtaacgtacggtacggtacgacggtaggaaccgggacgtaccgtacgtaggtaccttacggtaacgggaaccgttacgggtacccggttaccgggttttaccggttttcgacggggtttaaccggtacggtaaaggttaccccgttaagggtaaagtttaacggttaacggttttaaggttaacgggtacggttaaaccggttaccggggtaccggggtaacccgggtaaacccggggg

SEQ ID NO: 68248 - DNA, 342 bp, Homo sapiens
  misc_feature: GYAE6OF02IKZR5.37.37.D04.1.454.CMB.1.raw
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (275)..(276): a, c, t, g, unknown or other
  misc_feature (275)..(276): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (286)..(342): a, c, t, g, unknown or other
  misc_feature (286)..(342): n is a, c, g, or t
tcagtagtgtagatcacgaccggtgctcgatttagtagcatactgttggggtttgggtgcccaagctgctggagggcacggtcaccacgctgctgagggagtagagtcctgaggactgtaggacagcccatcggtcttcccccctggccacccctcctccaaagagccacctcgtggggggcacacggccggccctggggcctgcccgttggtcaaaggtacctaccttccatctacactactgaggcgggntaggcgaagggccncaatagnannagcngancgnnnnnnnnnnnnnnnnnnnnnnnnnnnnnnnnnnnnnnnnnnnnnnnnnnnnnnnnn

SEQ ID NO: 68249 - DNA, 811 bp, Homo sapiens
  misc_feature: GYAE6OF02IC47I.37.37.D04.1.454.CMB.1.raw
  modified_base (287)..(287): a, c, t, g, unknown or other
  misc_feature (287)..(287): n is a, c, g, or t
  modified_base (612)..(612): a, c, t, g, unknown or other
  misc_feature (612)..(612): n is a, c, g, or t
tcagtagtgtagatcacgaccggtgctcgatttagtagcatactgttgggtttggggacccaaaaccacacccctccttgggagaatcccctagatcacagctcctcaccatggactggacttggagcattccttttccgtggtggcagcagacaacgaggtcgcccactctgaggttcagcgtggtgctagtctgggagcgtggaggtagaaggacgtccggtgggcctgaacgtggtaacggtcctcgtaggacgtaaggtccttcgtaggttacttaccgttanactaatttagtaggttactacgtaacggttgggtacgacgacgtaccggtccccgtaggacgaacggacgagttacggaggtaggaggttagggagtcggtaacgttccggaacgggtctttaaccttaaacggtaaaacgtaaactaaaccaaccgtaaacttaacggttaactaccgaccgtaacgtaacggtaaaccggttacgggaacgggtaacgtaaccggtaccgtaaacccgtacccgtacccggaaccgtaaagacggtaacctaaccgtacccgaacgtaacgaacgtaccaccgtaacctaccagttaaccggngtaacgtacggtacgacgggatttcccggaagaccgtagtacccggtaacgggccgtaacccggttacggttccgtttaagtttccgagggtcgtacggtaaacggttaccgtaaacgtaatttaacgggttacgttaaggttaacccgggtagttacccggggttaacgggttaccgggacccggttaaaccccgggg

SEQ ID NO: 68250 - DNA, 639 bp, Homo sapiens
  misc_feature: GYAE6OF02I01PQ.37.37.D04.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (290)..(290): a, c, t, g, unknown or other
  misc_feature (290)..(290): n is a, c, g, or t
  modified_base (387)..(387): a, c, t, g, unknown or other
  misc_feature (387)..(387): n is a, c, g, or t
  modified_base (569)..(569): a, c, t, g, unknown or other
  misc_feature (569)..(569): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccatctcaggttcagctggtgcagtctgganctgaggtgaagagccgtggggcctnaggtgaaggtctccgtagcgaaggtcttcgtggttatacctttagctaattagtggtatcaacgtggggtacncgacgtacggccccgtaggacctaacggcccaagttggaggttaggagtggggatgggactacgagcgtacttaacgaataataacaacactagtancgacacgaagtacgtccgagggtacaaggtacgtaccctacccgtagaacccagacggtaactaaccacgtaccgaacgacggacctacgaccgtccttaacgagtacggataccgtaggacggtaacgtccgaaggagtacgtcgtaagaaccgtacggtaccgtcggtttatttaccggnggtacgacggtaacgacggtataagtattaggtacgaacgttacggacgtacgggtacggaccgtaacgg

SEQ ID NO: 68251 - DNA, 1155 bp, Homo sapiens
  misc_feature: GYAE6OF02F3RKO.37.37.D04.1.454.CMB.1.raw
  modified_base (128)..(128): a, c, t, g, unknown or other
  misc_feature (128)..(128): n is a, c, g, or t
  modified_base (154)..(154): a, c, t, g, unknown or other
  misc_feature (154)..(154): n is a, c, g, or t
tcagtagtgtagatcacgaccggtgctcgatttagtagcatactgttgggtttggggacccaaaaaccacacccctccttgggagaatcccctagatcacagctcctcaccatggactggacctggancatccttttctggtggcagcagcaanaggtgcccactctcaggttcagcttgggtgcaggttctggacgcgtggaggtagaaggaacggccgtggggtcctcgtaggtaggtaacggttctccgtgaccgaaggtcctttcgtacggttttaacgttaaccttttaggacttaaacgttagttaaggttacttaaccgtaacggttcggggttacggaccgtaaccggtaccggtacccccgttaagggtaaccgtaaccgggccgtaaggtacgggtaaggttaggggtaaggtacggggtaggttaaggaggtttaccgaagggttaccgtaacgtttaaaccgtaaacgttaaaaacttaaaccggaaaccttaaccgtaaacgttaacgttaacggaacgtaaacgtaaaaccggtttaaaccggtaaccgggaacgggggtaacgtaaaccggttaaccggtaaccccggtaaaccccccggttaacgtaaacccccgtaaacgtaaacccggtaaggtttaaaccccttaacccgtaaaccgggtaaccggaaccgggtaacccgtaaaaccgggtaacccgtttaacccgggttaaaaccgttaaaccggttccgggggaaaccgtaaacggggtttaccgggaaaccggggggttccggtttaaaaccccggtaagggggtaaacgggtttaaccccggtttacggtaaaacccccgggggtacccggttaaaccccgggtttaaacccgggggttttccccccggtttttaaaggggggttttttaaccccctggggggtttttaaaccgggaaccccgggggtttaaaccggggtaaaaccgggtttttaaacccgggtaaaaccgggttttaaaagggtttttaaccggtttttaaaaaccggggttttaacgggttttaaaaccccggggttaaccccgggggttttttaaaccgggggggttaaccccgggggttaaaaccccccggggttttaaaaacccccccggggggggg

SEQ ID NO: 68252 - DNA, 740 bp, Homo sapiens
  misc_feature: GYAE6OF02J0HS3.37.37.D04.1.454.CMB.1.raw
  modified_base (429)..(429): a, c, t, g, unknown or other
  misc_feature (429)..(429): n is a, c, g, or t
tcagtagtgtagatcacgaccggtgctcgatttagtagcatactgttgggtttggggaacccaaaaaccacgacccctccttgggagaatcccctagatcacacgctcctcacatggactggacctggagcatccttttccgtggtggcagcagcaacgaggtgcccgactctacgtacgggttctacgtcgtggttcgcaagtcgtggagctaggtaggtaggaagaaggtcggtacggggcctcggaggtagtacggtcctccgtgacgaggtccttgtaggttacttaccgttagcgtactagttacggtatcgtaagtcggtagtaccgtaagacgtcccgtaggacgtaacgctaggtgaggtgaacggtggggtactaggagtagcgtacggtacctaagaataacgtacaacacgtaactanacgactaacgaaacgtacgtacgacggataacggtacgtccgaccctacggtaaccacgtaaacgtactaacgtacctaccgaactacgaccgtaaaccggacctaaccggttcgaacgttacggtaaccggacgttacggaacgggtacgtaccgtttaaggagtaacccgttaggccgtaaaccgggccgttaaacgggtacccgtttaggttttaacgcgggttagaaacggttcggtaaccggttaataagttaagttaacgtacggttaagacggttaaacgtcggggtacgtacgtaaacccggg

SEQ ID NO: 68253 - DNA, 655 bp, Homo sapiens
  misc_feature: GYAE6OF02GZ3OQ.37.37.D04.1.454.CMB.1.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggctccagataccactggagaaatagtgatgacgcagtctccagcccaccctgtctgtgtctccgagggaaangccaccctctcctgcaggccagtcagagtgtagcagcaacgttgccgtggtaccngcaacgtaaccgtggaccaggtcctcccgaggtccctcctctacgtcctaggtggtcgctactcccgaccgagggcccacgttggtacctccccgagtccgtaggttccaggttcggacgtacgggttgggtccgtagggaaccgagtaacgttccgaacttccgacctaccctgtccgacgtcacggtccctagccgtagtcagttaacgttgtttacgcgtttagttttacgtcttagtctacgttacgttacgtttaattaaccgtcgttccggtacccttacggttacggtacgtacccggttaccggacggtaacgggaccggtaaagggtcgtaaaccgttacggaaaccgttacgtggtacggtacctcggacctaacgtgttacctcgg

SEQ ID NO: 68254 - DNA, 959 bp, Homo sapiens
  misc_feature: GYAE6OF02IKZXT.37.37.D04.1.454.CMB.1.raw
  modified_base (142)..(142): a, c, t, g, unknown or other
  misc_feature (142)..(142): n is a, c, g, or t
tcagtagtgtagatcacgaccggtgctcgatttagtagcatactgttgggtttgggacccaaaaaccacacccctccttgggagaactccctagatcacagctcctcaccatggactggacctggagctacttccttttccnggtggcagacagacaacgaggtcgaccctactctcgaggttcagcttgggtagcaggtcgtggacgtcgtaggagggtagaaagggaacgtcccggttacggggtcctacggtaggtacgtaacggttcgttccgtacgggacgtaaacggttcgttttacgttaggttttaacgttacccgtttaacgtaacgttaagtttaaggtacggtttaactaaccggtaacggttacgggggtacgtaccccggaaccggtacccgggttacccgtcgggaaaccgtaacccgggactaacggttacggaggggttaggtaggttggggtaaagtcgggttaactacggtaccggtacgttaaacttaaaactaaacgttaaaactaaccgtaacgaacccttattaggtaacccgagaaacgtaacgttaaccggtaaccgaaaggggctaaaccgggtaccttacccgaaccggtacgaaacccggctaaacggttaaactaccctaacgtaccggaaccgtacggaacccgtaaaccgacggtaacccacggttaaacgagggtcgtaccggtaaagggacccggttaacggtaccggttaggaaacccgttcgggtacccgtaacgggttaccggttacccgggaaaccggttttttaccccggttaagtttccccggttaagggtaccgggtaaccgtttaaccggtaaacctaaaggggtttaactaaagggttttaaacgtttaacgtaaccggggttttaacgtaccccggggtttaaacggtacgggggtaaccccggtttaacccggggg

SEQ ID NO: 68255 - DNA, 692 bp, Homo sapiens
  misc_feature: GYAE6OF02HX8NI.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaagcgcccaccctctccgtgcagggccagtcgagagtgtagcagcaacgttagcctaggtaccagacaacgaacctggccacggcctcccgaggcctcctacacttctagtggtgaccactcccgaccgtacgggccctacgtggtacctcccgaggtaccgtaggtttacgaggtcggacgtagggttcgggtacgtaggggaactaggtacgttccacgttccgtcgaccctagtccgacgaccgcgtccctaggaccgttagtaccgtaaggtaagtttacgttttcgtaccgttttaagtttttacgtttcctggtacctaagcttaagttaaacttacgtttaccgtcggtaccctttaacgtcgggttacggtaccggttacggaccggtaacgggtacgtaacgggttaacgaaaccgttaaccgaaaacggttacgtaggttacggtaaccgttacggacccgttaactcgttaccgttacg

SEQ ID NO: 68256 - DNA, 665 bp, Homo sapiens
  misc_feature: GYAE6OF02GHDG4.37.37.D04.1.454.CMB.1.raw
tcagtagtgtagatcacgaccggtgctcgatttagtagcatactgttgggtttggggaccaaaaaccacaccctcttgggagaatccctagatcacagctcctcaccatggactggacctggagcatccttttcctggtggcagcagcaacaggtcgccactctcaggttcagcgtggtgcagtcgtggagctggaggtgaagtacgcggtcggggcctcgaggtcgaaggttcctaccgtgaccgtaaggtccttacgtaggttaaccttaccgtttaggactaaatttcgtaggttatccgtaaacgtgggtacgacgtacgacggtccccgtaggaacgaacggacctagtacggagtggacgtagggtataggatcgagtccgtatacgaataactaacgacactacgagtcacgactaagtacgtcgagggtacagtacgtaccgacctcgacctaacgacgtaactacgacgtaccgaaacggtacaccgtacacgtactacgacgtcggacgtcgtacgacggtacgcgtagtaacgtacgtacggtaacgacgtaccgtacgggttcgtttaccgtgtacgtcggaacgtacggaacttacgtaaagttagtaacgttagtaacggtcgtacggtacggtacgggaccgtaaccggg

SEQ ID NO: 68257 - DNA, 607 bp, Homo sapiens
  misc_feature: GYAE6OF02F4IHK.37.37.D04.1.454.CMB.1.raw
  modified_base (335)..(335): a, c, t, g, unknown or other
  misc_feature (335)..(335): n is a, c, g, or t
  modified_base (425)..(425): a, c, t, g, unknown or other
  misc_feature (425)..(425): n is a, c, g, or t
  modified_base (535)..(535): a, c, t, g, unknown or other
  misc_feature (535)..(535): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcatccttttcctggtggcagcagcaacaggtgcccactctcaggttcagctggtgcagtctggagctgagtgaagaagcctggggcctcagtgaaggtctcctgcaaggcttctggttatacctttagcaattatggtatcaactgggtgcgacacggcccctggaccaaggccagtgagtaggagtgggatggatcagcgcttaanaataagtaacacacactatcgacacgaagtaacgttcaggggcaaggacgtaccacctaggacctaacgagaatacgaactcccgaaganaccaacgtacggacccttaagagttacgggaagccgttaggaaacgggagtccctagggtaagacgttacgacggtaaccgaccgtaacggttccgtttagttttaccgnggttacgacgtaggaacgtacaagtaactttagtagttaacgtagggtacctacggtcgggaccgtaacggg

SEQ ID NO: 68258 - DNA, 877 bp, Homo sapiens
  misc_feature: GYAE6OF02INMOV.37.37.D04.1.454.CMB.1.raw
  modified_base (127)..(127): a, c, t, g, unknown or other
  misc_feature (127)..(127): n is a, c, g, or t
  modified_base (140)..(140): a, c, t, g, unknown or other
  misc_feature (140)..(140): n is a, c, g, or t
  modified_base (164)..(164): a, c, t, g, unknown or other
  misc_feature (164)..(164): n is a, c, g, or t
tcagtagtgtagatcacgaccggtgctcgatttagtagcatactgttgggtttggggacccaaaaaccacacccctcttgggagaatcccctagatcacagctcctcaccatggactggacctggancacttccttttcnggtcggcagcagacaacgaggtcnccctactctcgaggttcagtcgtggtcacgtagtcgttggactcgtgggaacggttgaaacgacggtccggtggggtacctggaaggtcgaacggttcctccgtaggacgtaacggttctttcggttacggtttaacttaccgtttaagacttaaatttaggtaaggttactacgaacggttggccgtacgtaaccgtacccggtccgtaacgggaacgtaacgccgtaggttacgggacggtagggtacggttaacgggtacgttcggtaaactccgggtacggtaaccttaacgttaaaacgaaacgttaaaccgaaccgaaccgtactaacggtttagacgttaaaccaaggttacggttaaacgtcgggaacggtacgtaaccggtaccctaccgtacgtaaccgaaaccgacgttaaacgtacgtaaccgtaccgtaacgtaacggtacctaccgtaacgtaccgtaacgttacgtaacggtacggtaacgtacggtacgggaacgttacgtaccggtagtaccgtacgtaccgtaacgggacccgttaaccgggttaccgtttaaccgttacggtttaacggtacgggtaaccgtaaggggtaaacccgtttacgttaaacgtaacggtttaacgttaaagtttaccgggttacgttaacccgggttaccgggtaaccgggtttccgggtaaaccggttaacccggg

SEQ ID NO: 68259 - DNA, 641 bp, Homo sapiens
  misc_feature: GYAE6OF02JO9ZH.37.37.D04.1.454.CMB.1.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
tcagtagtgtagatcacgaccggtgctcgatttagtagcatactgttgggtttgggggaggaactgctcagttaggacccagacggaaccatggaagccccagcgcagcttctcttcctcctgctactctggcctcccagataccacgtggagaaatagtgatgacgcagtcctccagccacctgtctgtgtctccgaagggaacncgccacctctcctgcncgggccagtcagngtgtacgcagctaacgttagcctggtacagcaacgaaaccgtgaccgagcccgtaccgaggtctcctctactctagtcggcactacnccgtaaccgcggacctaacgtcggtaaccnccgtagccgtacgtgtaggtcgnggtacggtcggtcggacggtagagtcgtaccncgtacctccgtaacctgttcgaacgcgtaccgtcgtcggtctacggtcgtacgtaaagttcgttacgttagtttacgttacttccggtatacggaccttagtaacgtttaacttacgttaccgcggttacccgtacggttagtaccggttcccgtaggaccggtaggtaaccgtaggaaacggttaacaaccgtaacgcggttcgtacgcgtagactaccggatttcggtaacc

SEQ ID NO: 68260 - DNA, 858 bp, Homo sapiens
  misc_feature: GYAE6OF02GOSJ7.37.37.D04.1.454.CMB.1.raw
tcagtagtgtagatcacgaccggtgctcgatttagtagcatactgttgggtttgggggaggaactgctcagttaggacccagacggaaccatggaagccccagcgcagcttctcttcctcctgctactctggctccagataccactggagaaatagtgatgacgcagtctccagcccaccctgtctgtcgtcctccgaggggaaacacgcccaccctctcctgcgacgggccacgtcagagtcgtagcagacaacgttacgcctacggtaccagacgaacgaaccgtggaccaggccctacccgaggtccctaccgtactacgttccgtaggtcggtacgacctacctaccccgaccggtaccgggacctacggttacgggtaacctaccccgaacggttacccgttaaccggtttacggtacgggtaccgtaggggtttcgggtaacggtacggggtaacctaggttaacgtttaccctaaacgttcccgtaaacccgaccctaagtaccgaacgtccgaaccgtccgtaacggacgttacggttacgttaaaggttacgtttacgttttaccggacgttttaaacggttttacttaaacggttaccggttaaaacctaaaaccggttaacggttaaacccttaaaggttacccgttaaaccggttcccggttacccttttacccgttaaccgttttacccggggttaacgggtaaaccggggtacgggttaaaccgggtaaggggtttaccggaaacgggttaaacgtaaaacccgggtaaaccggtaaccggttaggtaccggtacccgttaacggacccgttaacccgtttacgtacccggtttacgttacccg

SEQ ID NO: 68261 - DNA, 838 bp, Homo sapiens
  misc_feature: GYAE6OF02JS7WS.37.37.D04.1.454.CMB.1.raw
  modified_base (155)..(155): a, c, t, g, unknown or other
  misc_feature (155)..(155): n is a, c, g, or t
  modified_base (353)..(353): a, c, t, g, unknown or other
  misc_feature (353)..(353): n is a, c, g, or t
tcagtagtgtagatcacgaccggtgctcgatttagtagcatactgttggggtttgggggagaactgctcagttaggacccagacggaaccatggaacgccccagcgcagcttctcttcctctgctactctggcctcccagactaccacgtggaanaaatagtgatcggactcagtcctcacgccctacctgtcgtgtacgtctacggaagggaacaccgccctacccgttctccgtaggacgacggcctaagtacgagtagttcggtacgcacgtacctaacgttacgaccgtacggtaccgagacaaacggtaaccgtcggacccaggtccctacccgacgtcctaccgtanaccgttacgtacgtcggtaccaaccgttccaccccgaccgggtaccggtaccgttacgtacggtcccgtaccgtacgaccgttaggttcgacgggaggtaccgttaggggtcgggtaaccgggtagacgttaacgggtcttaccaaccggttaccgacctaacggttccgacgtaacggcccgtacgttcccgtaggacccttaggttaaacccttaaggttaaccgtttcgttttaccggttacgttttaaacgttttccgttgtaacccggtttacaacggttacgttaaaattaacggttttaacccgtcgttaccttacccggtaacgtttacggggtaacccgttaaccggtacggttaacccggtaagggttaaaccgttaacgggaaaaccggtttaccgttaaacgggaaaaccggttttcgtccggttaccggtacgttacccggttaaaccggtactttccggttaacttacccg

SEQ ID NO: 68262 - DNA, 871 bp, Homo sapiens
  misc_feature: GYAE6OF02H64ZE.37.37.D04.1.454.CMB.1.raw
  modified_base (383)..(383): a, c, t, g, unknown or other
  misc_feature (383)..(383): n is a, c, g, or t
tcagtagtgtagatcacgaccggtgctcgatttagtagcatactgttgggtttggggacccaaaaaccacacccctccttgggagaatcccctagatcacagctcctcaccatggactggacctggagcattccttttctggtggcagcagcaacaggtcgcccactctcaggttcagctggtgcaggtcgtggagcgtggaggtagaaaggaaggccgtggggccttcgaggtaggaaggttcctccgtgcgaaggtccttctggttacttaccgtttagactaagttataggtattaccaaggttcgggtgacggtaaccgaccggtccccgtagggaaccaacgggaccctagtggtacggtagggtaggtacgggtagnggtacgtcgacgccgttactaaacgtaaataactaaaaccgaccgtaaacctaacttacgacgtaccgtaaacgtaacgtaaaccggttacccggaaagggtacgaagggtacccgtaccggttaaacccccgtaccggaacccgtaaaccgtaagtaaccgttaaacggtaacctacccggtaaaccggtacgaaccgaacccgtaccgaacccgttacgtaaacgtacgggactacgggtaacgggaaccggtaccggtacccgttaacgggagtaaccgttaccggtaaccggaacccggttaccggtaacccggtttaccggttttaccggtttaaccggtcggttacgggtaaccgggttaaggaaaccggttaaccggtaaaggtttaaccgtttaaacggtttaacgtttaaacggggtaacccgggtttaaccgggttttaacccgggggcccggggttaaccccgggtaaaccccgggg

SEQ ID NO: 68263 - DNA, 840 bp, Homo sapiens
  misc_feature: GYAE6OF02JLYN7.37.37.D04.1.454.CMB.1.raw
  modified_base (761)..(761): a, c, t, g, unknown or other
  misc_feature (761)..(761): n is a, c, g, or t
tcagtagtgtagatcacgaccggtgctcgatttagtagcatactgttgggtttgggacccaaaaccacaccctccttgggagaactccctagatcacagctcctcaccatggactggacctggacgcacttccttttcctggtcggtcagcagcaacgacggtcgcccacgtcctcgtacggttcacgtcgtggtcgcgagtcgtggagcgtgtaggtagaagacgccggtacgggcctacgtagtacggtaacggtccgtccgtcgacgtaacgtcgttacgttaggtttaacttacgttttaacgacgttaatttaacgttacggtaacttacggtaacggttgggtcggtacggacgtaccgggtccccggtaggaccgtaacgggtaccgtaggtacggtaaggttacgggacggttgggaacgttacggtacgttacgacggtacgttaacgtaaacgttaaaacgtaaacgtaacctaacaaccgttacgtaacgtacggaaccgtaaacgtaacgttacgtacggtaacggggaacgaacggttaccgacccgttaaccgtacccggaacccgtaacgaaccgtaactacgtaaacccgtaaccggaaacgtaccgttaaccggaaaccgtaccgaaccgtaccggtaaggtaccgggtacgtaacgtacgggacggttaccgacggtagaccgtagaccggtaaccggtaaccgacgggttaccgttcggtttattaccgggagttaccgggngtaacgtacgtaaacgttagttaattccgggtaagttacggtaccgttaaccggttgggtacccggtaccggtaacggg

SEQ ID NO: 68264 - DNA, 807 bp, Homo sapiens
  misc_feature: GYAE6OF02FK6FY.37.37.D04.1.454.CMB.1.raw
  modified_base (128)..(128): a, c, t, g, unknown or other
  misc_feature (128)..(128): n is a, c, g, or t
  modified_base (140)..(140): a, c, t, g, unknown or other
  misc_feature (140)..(140): n is a, c, g, or t
  modified_base (374)..(374): a, c, t, g, unknown or other
  misc_feature (374)..(374): n is a, c, g, or t
  modified_base (517)..(517): a, c, t, g, unknown or other
  misc_feature (517)..(517): n is a, c, g, or t
tcagtagtgtagatcacgaccggtgctcgatttagtagcatactgttgggtttggggacccaaaaaccacacccctccttgggagaatcccctagatcacagctcctcaccatggactggacctggancatccttttccnggtggcagcagctaacgaggtcgcccctaacttccctacggttacgtacgacgtcgtaggccgacgtacgtggtaggactcggaggtaggtaggaacgtacgtccggggtcggtcctacggtaggtacggtaccgttcccgtacggacgtaacggtacgttccgtttacggttacggtttaccttaacggttacaaccttagttacggtatccgtaaccgtgggtgccgaaccnccggtcctcggtacgaagcctacgtggacgtaggagtcggtaagtgtacggtacacggccttaacgtaactaaaataacggtaaaccaccaacgtagtacttacggccgaaattagaaacgggttacccgagggacccgtaanaacccgttaccgtacccctaagaccgaactaaccgtaagacctaccaacgacccgtacgaccgaacgtaactcccgtaaaccggttacgtaaccgggtcgtaacgggtcgacgggtaaccggtactaccgggaataccggttaccgtaacggtaccgaaccgggttaccgttccggttacggtttacgttacgttcggacgtaaggtccggtaacgtaaggtaaagttacggttacggtaaggttaccggtacgttaacggtccgggttaacggaccgggtttaacccgg

SEQ ID NO: 68265 - DNA, 253 bp, Homo sapiens
  misc_feature: GYAE6OF02H5GPK.37.37.D04.1.454.CMB.1.raw
  modified_base (142)..(142): a, c, t, g, unknown or other
  misc_feature (142)..(142): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (245)..(253): a, c, t, g, unknown or other
  misc_feature (245)..(253): n is a, c, g, or t
tcagtagtgtagatcacgaccggtgctcgatttagtagcatactgttgggtttgggtgcccaagctgctggagggcacggtcaccacgctgctgagggagtagagtcctgaggactgtaggacagcccatcggtcttccccnggcgccctgctccaggagcacctccgagagcaacagcggccctgggctgcctggtacaaggcttacttccatctacactctgagcggcnggcaaggcgnatgnnnnnnnnn

SEQ ID NO: 68266 - DNA, 815 bp, Homo sapiens
  misc_feature: GYAE6OF02GEF59.37.37.D04.1.454.CMB.1.raw
  modified_base (188)..(188): a, c, t, g, unknown or other
  misc_feature (188)..(188): n is a, c, g, or t
  modified_base (550)..(550): a, c, t, g, unknown or other
  misc_feature (550)..(550): n is a, c, g, or t
tcagtagtgtagatcacgaccggtgctcgatttagtagcatactgttgggtttggggacccaaaaaccacacccctccttgggagaatccctagatcacagctcctcaccgatggactggacctggagcatccttttacctgggtggcacgcagctaacgaggtgcccactctcaggttcagctggtncagtctggagctggaggtgaagaagtccgtggggcctagtagtgaacggtcctcctggacctaaggtccttacgttgggttaacttacccttttaagggacctaaagtttacggttaggttaactaaccgtaacggttacggggtacgtaccggtaaccgtacggggtaccccccgttagggtaaaccaacggggttcccaaggttcggtaggtacggggtagtacggggtaatacgggattacggacggtcctaacgttaaactaaactaaacgtaaacctacaactaaccgtatccggacaacgtaacgtacggtaccgaaggtcaaggtacgtacccaccgtacgaaccacgacgtaanactacctacgaacgtacgtccgaacgtacgtacttacgtaggttaacgggacgttagtacggaacgggcgttacgggtaacggtaacgtaccggtacgtaccgggaaaccgtaccggttaccgggttaccggttttacgtttaccggggttgtaacggggtacccggtaacggtaaggttaacgtaaaacggtgttttaaacggttaggtacgggttaaccggtaaccggttaccggggtaaccgggtaccgggtaaacccgggg

SEQ ID NO: 68267 - DNA, 769 bp, Homo sapiens
  misc_feature: GYAE6OF02GMBE4.37.37.D04.1.454.CMB.1.raw
  modified_base (146)..(146): a, c, t, g, unknown or other
  misc_feature (146)..(146): n is a, c, g, or t
  modified_base (172)..(172): a, c, t, g, unknown or other
  misc_feature (172)..(172): n is a, c, g, or t
tcagtagtgtagatcacgaccggtgctcgatttagtagcatactgttggggtttgggggaggaactgctcagttaggaccccagacggaaccatggaagccccagcgcagcttctcttcctctgctactctggctcccagataccncgtaggaagaagtagtgatggacganacgtctccgagcccacctgtctagtcgtcctaccggaagggaaacacgccctacccgtcctaccgtggaccgaacgggtccaggtccgagtaaggttacgttagaccgtagtaccggtaaacttcggaccgttcggtaaccgacggtacctaacgaaccgtcggaccgaacgtcccgtaaccgacggacccttccgtacgtaaccttcgtacggttcggtacgactaaccgtacccgaacggtacgggtccgtaaactcggttaccacccgtaccgtacggtacggtccgttagggcgtaccggtacgggttcgggttcgggtaacgggtaacgtaacgtaccggtttagaccctgtacccaccgtagtaccgacgtcgaccgtcgacgtacgtgtacgtagtaccgtattcgttattacgtttcttagtcgtactacgacgttacgttaacgtagttaccgagggttcccttacgggccgttacggaccgttacggtaccgtacgggttaccgaagggttaaaccctaacggaaccgttaacggaaccgtgggtaacctacggtaccggtaacctacgttaccgttaacgtcccgg

SEQ ID NO: 68268 - DNA, 740 bp, Homo sapiens
  misc_feature: GYAE6OF02F5NMY.37.37.D04.1.454.CMB.1.raw
tcagtagtgtagatcacgaccggtgctcgatttagtagcatactgttgggtttggggacccaaaaaccacacccctccttgggagaatcccctagatcacagactcctcaccatggactggacctggagcatccttttcctggtggcagcagcaacaggtgcccactctcaggttcagctaggtgcagtctggagctgaggtgaagaagccgtaggggcctcaggtagaaggtctcctgcgagtacttctggtttactacctttagctaattagtggtactcaacgtgggtagcgtacgacgtcccgtaggaccaggaccagtgacggtaggagtaggggtatcggatacgagtcctacttaacgtaactaaactaaccaacactatactgacaagtacgtaacggttaccgagggactaaggtacgtaccccgtaaccgaccgtaacccgaacgtaacgtaactaaccgaacttaccccggaaccgtaacgacccgtaaacccgtaccggtacccttaaccgtagggttaacgggtacccgaacggtttacgggacggggttacccaaccggttacgggaccgtaaccgttacggtttaaccgacccgtaaccgggttaacccgggtcggtttttaccggtttacggaggttccggtaggaacgtaacggttaacgtaacgtaagtttacgtaggttacggtaacgtacggttacgggtcccggtaacgtaaccccggg

SEQ ID NO: 68269 - DNA, 916 bp, Homo sapiens
  misc_feature: GYAE6OF02HWG83.37.37.D04.1.454.CMB.1.raw
tcagtagtgtagatcacgaccggtgctcgatttagtagcatactgttgggtttggggacccaaaaaccacacccctccttgggagaatcccctagatcacagctcctcaccatgggactggacctggagcattccttttcgtggtggcagcagcaacgaggtcgcccactctacgtaggttcagcgttggtgcgtagtcgtggagcgtggaggtaggaagaacgccggtcggggtcctacgtaggtaggtaacgggttcccttaccgtacggtacgaacggttcctttcggtttacggtttaacgtttacccgttttaaggaccttaaagttttaacggttggttaaactaccgttaacgggttcggggtaccggaccggtaaccggacccgggtacccccggtagggaaccgtaaacgggtcccaaggttcgggtaaggacggggtagttacgggagttacggacgtacgacgtaccgtaacgtttaaacaaagtaaaccttaaaccaccgtaacgttactaccgtaggaccctaaggtaaacggttaaccggttacggacggtaaccgtacggtaacccgttacctaaccccggtacaaaccgtaccgtaagtaaccggaaacccttacgtacccgaaacgtacgtaaccccgtaacggacccgtaactaaccgggtaaacggtcgtaacggtacgggtaacgggaccggttacgaccggttaggtaaaccgttcgttaacgaaccgggtttaaccgacccggggttacggtttccgttttaacgggttaccgtaggggttaccggaacggtaaccggggtaaacttaaccggtaaagtttaaccggtaaggtttaaccggggtacgtaacccggttacgggtacgggttaaccccggggacgttaacccgggg

SEQ ID NO: 68270 - DNA, 1072 bp, Homo sapiens
  misc_feature: GYAE6OF02GGFW5.37.37.D04.1.454.CMB.1.raw
  modified_base (153)..(153): a, c, t, g, unknown or other
  misc_feature (153)..(153): n is a, c, g, or t
  modified_base (254)..(254): a, c, t, g, unknown or other
  misc_feature (254)..(254): n is a, c, g, or t
tcagtagtgtagatcacgaccggtgctcgatttagtagcatactgttgggtttgggggaggaactgctcagttaggacccagacggaaccatggaagccccagcgcagcttctcttcctctgctactctggcctccagatacccacgtggaanaaatagtgatggacgcgagtctccgagcccacctgtctgtgtcctccgaaggggaacacgcccaccgtctcgtgacggacggcagtcgaagtcgttggtancagtacctaagttacggccgttaggaccagaccaacggtaaccgtccgggtaccaacggtccgtaccccgagggttacccctccgtacgttacgttaccgttaagttcgggtacgacctaccggtaccccgaacggacccggtcccgtaaacggttccggtaacccgtacccggacggtccccggttaacggttccggaaggtcgggtacggtaggggtttaccggggtcggtaacgggaacgtaacggtttaacgtttcccgaacccgtttacccggtaacccaaacccgttcggtttaaaccgacggtacccgggttaaccgtccccggttacgggtaaccgtttacccgggtaaacgtttaacgggttaaaacggtttttcgttttaacggttaaaccggtttttttaccggtttttttacgtttaaccggggtaacccgggtttttggtaaaacccgtttttacgggtttaaaacgtttttaaaacccggtttttaccggttttttaaaaccccggggtttccggttttaaacccccggggtttaaccccgggttttaaaccgggggttaccccggggtttttaaacccggggttaaaccgggggaacccccgggtttaaaacgggttaaaccccggggggtttaaacggggtttaaaaaaccccgggttaaaaccgtaaaaacccgggggggtttaaaaacccccgttcgggggggttttacccgtttaaccggggtaaccccggtttaccccggtttaaaaaacccgttccccgggtttaccgggtttttaacccggttttaaacccccggg

SEQ ID NO: 68271 - DNA, 679 bp, Homo sapiens
  misc_feature: GYAE6OF02JRY09.37.37.D04.1.454.CMB.1.raw
  modified_base (193)..(193): a, c, t, g, unknown or other
  misc_feature (193)..(193): n is a, c, g, or t
  modified_base (605)..(605): a, c, t, g, unknown or other
  misc_feature (605)..(605): n is a, c, g, or t
tcagtagtgtagatcacgaccggtgctcgatttagtagcatactgttgggtttgggggacccaaaaaccgacacccctccttgggagaatcccctagagtcacgagctccctcacccatggactggacctggacgcatccgttttccctggtggcagcagacacagtgcccatctctaggtcaggctgggtcncgtagtcgtggacgcgtggaggtagaaggaacgccgtgggcctacgaggtgtaaggtctccgtggacgtacggtcttcgttaggttaccttacctttaggtactaagttatacggttatacgtaaccgtgggtgaccgtaacgccggtaccccgtaggaccgaacggtacagtcggtaggtacggtaggttaggacgtagggtacacgtacgtactacgtaagtaaactaacgtaaacactaacgtactagacgtacaactagacgtacggacggacgacgtacgtacccgacgtacgacctacgatacgtacacgtacacgagtacacgtactacgagtgacggcgtacgtgacggtacgtcgtaggaactcggacgacgtacccgtaacggtaccgtgtttacgttacgngtacggtacggtaagtaccgagtaacgtaagtgttacgttacggagtcggttaaccgggtcgtacggtaaccgg

SEQ ID NO: 68272 - DNA, 183 bp, Homo sapiens
  misc_feature: GYAE6OF01BFL88.33.54.E10.1.454.CMB.1.raw
  modified_base (183)..(183): a, c, t, g, unknown or other
  misc_feature (183)..(183): n is a, c, g, or t
tcagtacacacactcacgaccggtgctcgatttagatcgtagcagaacacacaaagggcagaactttgttacttaaacaccatcctgtttgcttctttcctcaggaactgtggctgcaccatctgtcttcatcttcccgccatctgaagtgtgtgtactgagcgggctggcaaggcgcatagn

SEQ ID NO: 68273 - DNA, 196 bp, Homo sapiens
  misc_feature: GYAE6OF01B5OWJ.33.54.E10.1.454.CMB.1.raw
  modified_base (184)..(196): a, c, t, g, unknown or other
  misc_feature (184)..(196): n is a, c, g, or t
tcagtacacacactcacgaccggtgctcgatttagatcgtagcagaacgacacaaagggcagaactttgttacttaaacaccatcctgtttgcttctttcctcaggaactgtggctgcaccatctgtcttcatcttcccgccatctgaagtgtgtgtactgagcgggctggcaaggcgcatagnnnnnnnnnnnnn

SEQ ID NO: 68274 - DNA, 185 bp, Homo sapiens
  misc_feature: GYAE6OF01DXJWK.33.54.E10.1.454.CMB.1.raw
  modified_base (182)..(185): a, c, t, g, unknown or other
  misc_feature (182)..(185): n is a, c, g, or t
tcagtacacacactcacgaccggtgctcgatttagatcgtagcagaacacacaaagggcagaactttgttacttaaacaccatcctgtttgcttctttcctcaggaactgtggctgcaccatctgtcttcatcttccgccatctgaagtgtgtgtactgagcgggctggcaaggcgcatagnnnn

SEQ ID NO: 68275 - DNA, 184 bp, Homo sapiens
  misc_feature: GYAE6OF01AI7YP.33.54.E10.1.454.CMB.1.raw
  modified_base (183)..(184): a, c, t, g, unknown or other
  misc_feature (183)..(184): n is a, c, g, or t
tcagtacacacactcacgaccggtgctcgatttagatcgtagcagaacacacaaagggcagaactttgttacttaaacaccatcctgtttgcttctttcctcaggaactgtggctgcaccatctgtcttcatcttcccgccatctgaagtgtgtgtactgagcgggctggcaaggcgcatagnn

SEQ ID NO: 68276 - DNA, 182 bp, Homo sapiens
  misc_feature: GYAE6OF02HVNTO.33.54.E10.1.454.CMB.1.raw
  modified_base (182)..(182): a, c, t, g, unknown or other
  misc_feature (182)..(182): n is a, c, g, or t
tcagtacacacactcacgaccggtgctcgatttagatcgtagcagaacacacaaagggcagaactttgttacttaaacaccatcctgtttgcttctttcctcaggaactgtggctgcaccatctgtcttcatcttcccgccatctgaagtgtgttactgagcgggctggcaaggcgcatagn

SEQ ID NO: 68277 - DNA, 733 bp, Homo sapiens
  misc_feature: GYAE6OF01A66IT.8.20.B09.1.454.CMB.1.raw
  modified_base (255)..(255): a, c, t, g, unknown or other
  misc_feature (255)..(255): n is a, c, g, or t
tcagctcgcgtgtccacgaccggtgctcgatttagtgtagtgtgaagggagcaccgtggagaagacagtggcccctacagaatgttcataggttctcatccctccaccccccaccacgggagactagagctgcaggatcccgaggggagggtctctcctcgctcactgcacagggtcctgggcccagtctgtgctgacgcagcccgcctcagtgtccgtcggggccccagggcaggacgggtccgcctatttccngcacgtgggacgagctaccaacagtcggggctagggttatgatcgtacgagtcggtaccgcaccctccgaaggacgaacgccccaaactcttcattcgtagggtaaaccaccgaacgtccggtcccctacggacgggggtcccctacggaacccggtacgttcccgtcgaacgggtccctaccgtaacggttcctcgggcctaccctccgacgtccccttcccggtcgggtccccgttccggtccggggtccctaccggacggtcgtaggtaaggacgtacgggaaggggtttctaagtttaaccgtttcgtcggtcccgttgttaccgtatacggaacctaacgcggttacctaaggtaattaacggtagggttcggggttacggttacccgggggacggggtaaaccgggtaacccctaaacgggttcccgtaacccggttccctaacgtaccggttccgaacccggtacccccgg

SEQ ID NO: 68278 - DNA, 670 bp, Homo sapiens
  misc_feature: GYAE6OF02JVZRU.8.20.B09.1.454.CMB.1.raw
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
  modified_base (475)..(475): a, c, t, g, unknown or other
  misc_feature (475)..(475): n is a, c, g, or t
tcagctcgcgtgtccacgaccggtgctcgatttagtgtagtgtgaagggagcaccgtggagaagacagtggccctacagaatgttcataggttctcatccctcacccccaccacgggagactagagctgcaggatcccgaggggagggtctctcctcgctcactgcacgagggtcctgggcccagtctgtgctgacgcagtcccgcctcagtgtcgtggggccccagggccaggcgggtcgccagttttccngccacgtgggaccgagcctaccgaacgacgtccggggcaggttactgatggtacncgtcggtaccggcacctccgaggacaacgccccaaactctcatcgtagggtacaccagtccggcctacgacggggtccncggaccgagtcctcgaggcctacgaatcgnggccactcacgccttccgnggtccgtcgtaccgggtctccggtaggtcgtaggacggtntaggggtacggttacgattttaacgttccgtagtcccggttcgttacccgttaaagttcggaaaacacccggtaacgccgttaaggtaacttacggtacggtttccgggggttaggtttacccggagggaaccgggtaaacccgttaactcgggtcccgtttaaccacggttacgttaccgaacccgttacccgg

SEQ ID NO: 68279 - DNA, 523 bp, Homo sapiens
  misc_feature: GYAE6OF01CTSR3.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatatcccagccaggttcagtggcagtggtctgggacagagttcactctcacatcagcagcctgcagtctgaagtattttgctaattttattactgttacagtactaagtataataactaggtccttaccgtactacgttttcggaccgtaggggaccaaggtccgtagggaacgtaatacgaaacgaacgttcgtaggtactcgtcacctacg

SEQ ID NO: 68280 - DNA, 480 bp, Homo sapiens
  misc_feature: GYAE6OF01BR3E6.51.76.G10.1.454.CMB.1.raw
  modified_base (195)..(195): a, c, t, g, unknown or other
  misc_feature (195)..(195): n is a, c, g, or t
  modified_base (473)..(473): a, c, t, g, unknown or other
  misc_feature (473)..(473): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcaccatcagcagcctgcagtctgaagattttgctaatttattactgtcagcagtataataactgcctcgtacactttggccagggaccaagctggagatacaaacgactgtggntgcacca

SEQ ID NO: 68281 - DNA, 485 bp, Homo sapiens
  misc_feature: GYAE6OF01CQMYG.51.76.G10.1.454.CMB.1.raw
  modified_base (195)..(195): a, c, t, g, unknown or other
  misc_feature (195)..(195): n is a, c, g, or t
  modified_base (477)..(477): a, c, t, g, unknown or other
  misc_feature (477)..(477): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtattttgctaatttattactgtcagcagtataataactggcctccgtacactttggccagggaccaagctggagatacaaacgactgtagntgcactac

SEQ ID NO: 68282 - DNA, 502 bp, Homo sapiens
  misc_feature: GYAE6OF01CRQVO.51.76.G10.1.454.CMB.1.raw
  modified_base (491)..(491): a, c, t, g, unknown or other
  misc_feature (491)..(491): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggcctcctcatctatgatgcatccacaagggccactgatatcccagccaggttcagtggcaggtggtctgggacagagttcactctcaccatcagcagcctgcagtctgaagtattttgactaatttattactgtcagtcagtataataactggccttccgtactacgtttggccgtaggggaccaaggtcgtaggaagatacaaacgaactggnggatgcaccta

SEQ ID NO: 68283 - DNA, 481 bp, Homo sapiens
  misc_feature: GYAE6OF01AZFCC.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcaccatcagcagcctgcagtctagagtatttgctaatttattactgtcagcagtataatactgctcgtactactttgcagggaccagctaggagactacaacgactgtaggactgcactacg

SEQ ID NO: 68284 - DNA, 482 bp, Homo sapiens
  misc_feature: GYAE6OF01A31MI.51.76.G10.1.454.CMB.1.raw
  modified_base (475)..(475): a, c, t, g, unknown or other
  misc_feature (475)..(475): n is a, c, g, or t
  modified_base (479)..(479): a, c, t, g, unknown or other
  misc_feature (479)..(479): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcaccatcagcagcctgcagtctgaagattttgctaatttattactgtcagcagtataataactgcctccgtacactttggcctagggaccaagctggagatacaaacgactgtggntgcncta

SEQ ID NO: 68285 - DNA, 487 bp, Homo sapiens
  misc_feature: GYAE6OF01BZ2X3.51.76.G10.1.454.CMB.1.raw
  modified_base (463)..(463): a, c, t, g, unknown or other
  misc_feature (463)..(463): n is a, c, g, or t
  modified_base (483)..(483): a, c, t, g, unknown or other
  misc_feature (483)..(483): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcaccatcagcagcctgcagtctgaagtattttgctaatttattactgtcagcagtataataactggcctccgtactactttggcctagggaccaagctaggagntacaacgaactgtggctgcnctac

SEQ ID NO: 68286 - DNA, 496 bp, Homo sapiens
  misc_feature: GYAE6OF01A1DFO.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggtcagtggcagtgggtctgggacagagttcactctcaccatcagcagcctgcagtctgaagtattttgctaatttattactgtcagcagtataataactgtcctcgtactactttggccaggggaccaaggcgtaggagtatacaaacgaactgtaggactgcaccgtacg

SEQ ID NO: 68287 - DNA, 503 bp, Homo sapiens
  misc_feature: GYAE6OF01DV1OD.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgtagcagcgacttagcctggtaccagcagaaacctggccaggctcccaggctcctcatctatgatgcatccacaagggccatgatatccagccaggttcagtggcaggtggtctgggacagagttcactctcacatcagcacgcctgcagtctagaagtatttgctaatttattactgtcagactagtataataactaggtcctcgtacgtactttggaccgtacgggaccaaggcgtaggacgatacgaaacgaactggtacggatcgcaccgtacg

SEQ ID NO: 68288 - DNA, 490 bp, Homo sapiens
  misc_feature: GYAE6OF01BG3LA.51.76.G10.1.454.CMB.1.raw
  modified_base (195)..(195): a, c, t, g, unknown or other
  misc_feature (195)..(195): n is a, c, g, or t
  modified_base (486)..(486): a, c, t, g, unknown or other
  misc_feature (486)..(486): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccatgatactcccagccaggttcagtggcaggtgggtctgggacagagttcactctcaccatcagcagcctgcagtctgaagtattttgactaatttattactgtcagtctagtataataactgccttcgtactactttggccgtagggaccagcgtaggagatacaacgactgtgctgcnctac

SEQ ID NO: 68289 - DNA, 571 bp, Homo sapiens
  misc_feature: GYAE6OF01DIPP8.51.76.G10.1.454.CMB.1.raw
  modified_base (196)..(196): a, c, t, g, unknown or other
  misc_feature (196)..(196): n is a, c, g, or t
  modified_base (328)..(328): a, c, t, g, unknown or other
  misc_feature (328)..(328): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanacgccaccctctcctgcagggccagtcagagtgtagcagcgtacttgcctggtaccagcagaaacctggaccaggcctcccgaggcctcctcatctatgatcgcactccaacgaacgggccaactgactacncccaagccctaggttcaggtcggctagggtgggtctaggggacaggtacgttcacgtcctacaccatcgacgcacgtcctgcagtcgtagtaagttattttgactttaatttactttacttgtactaagtcgtaagttaataacgttaacgtcggtacccttaccgttactacgttttcggaccgtaacgggacctagtcgtaggacgacgtaccaaacgtacgtggtacgactcgcacctac

SEQ ID NO: 68290 - DNA, 485 bp, Homo sapiens
  misc_feature: GYAE6OF01CJRIM.51.76.G10.1.454.CMB.1.raw
  modified_base (197)..(197): a, c, t, g, unknown or other
  misc_feature (197)..(197): n is a, c, g, or t
  modified_base (315)..(315): a, c, t, g, unknown or other
  misc_feature (315)..(315): n is a, c, g, or t
  modified_base (461)..(461): a, c, t, g, unknown or other
  misc_feature (461)..(461): n is a, c, g, or t
  modified_base (481)..(481): a, c, t, g, unknown or other
  misc_feature (481)..(481): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccacctctcctgcagggccagtcagagtgtagcagcgacttagcctggtaccagcagaaacctggccaggctcccaggctcctcatctatgatgcatccacaagggccactgatancccagccaggttcagtggcaggtggtctgggacagagttcactctcacatcagcagcctgcagtctgaagtatttgactatttatactgtcagcagtataatactggcttacgtactactttggccgagggacctaagctaggatntacaaagactagtgactgcnctag

SEQ ID NO: 68291 - DNA, 510 bp, Homo sapiens
  misc_feature: GYAE6OF01CCDG3.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtatttgactaatttattactgtcagctagtataatactggtccttccgtactacgtttcggaccgtacggggacctaaggtcgtagggagtactacgaaacgaacgtgtaggctcgcacctacg

SEQ ID NO: 68292 - DNA, 487 bp, Homo sapiens
  misc_feature: GYAE6OF01C2U5T.51.76.G10.1.454.CMB.1.raw
  modified_base (195)..(195): a, c, t, g, unknown or other
  misc_feature (195)..(195): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtattttgctaatttattactgtcagcagtataatactgcctcgtactactttggccagggaccaagcgtaggagatacgaaacgacgtgtagntgcnctac

SEQ ID NO: 68293 - DNA, 486 bp, Homo sapiens
  misc_feature: GYAE6OF01CLBUN.51.76.G10.1.454.CMB.1.raw
  modified_base (196)..(196): a, c, t, g, unknown or other
  misc_feature (196)..(196): n is a, c, g, or t
  modified_base (478)..(478): a, c, t, g, unknown or other
  misc_feature (478)..(478): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtattttgactaatttattactgtcagcagtataataactgcctccgtactactttggccagggaccaagctggagatcaaacgactgtggntgcaccta

SEQ ID NO: 68294 - DNA, 488 bp, Homo sapiens
  misc_feature: GYAE6OF01DXK2H.51.76.G10.1.454.CMB.1.raw
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgctaatttattactgtcagcagtataatactggcctccgtactactttggccagggaccaagcctaggagatacgaaacgaactgtgntgcnccta

SEQ ID NO: 68295 - DNA, 505 bp, Homo sapiens
  misc_feature: GYAE6OF01AVNBH.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatactcccagcctaggttcaggtggcaggtcgggtctgggacaggagttcactctacaccatcagcagcctgcagtctagaagtattttgactaatttattactgtcagtctagtataatactggtcctcgtactcgtttcggccgtagggaccagtcgtaggagatacgaacgactcgagactcgcgactac

SEQ ID NO: 68296 - DNA, 488 bp, Homo sapiens
  misc_feature: GYAE6OF01D9MDB.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcagtggtctggacagagttcactctcaccatcagcagcctgcagtctgaagtattttgctaatttattactgtcagcagtataatactgcctcgtactactttggccgagggaccagcgtaggagatacgaaacgacgtcgtaggctgcactacg

SEQ ID NO: 68297 - DNA, 490 bp, Homo sapiens
  misc_feature: GYAE6OF01DWSY9.51.76.G10.1.454.CMB.1.raw
  modified_base (196)..(196): a, c, t, g, unknown or other
  misc_feature (196)..(196): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtattttgctaatttattactgtcagcagtataatactgcctcgtactacgtttggccagggaccaaggctaggagatacaaacgaactgtacggntgcnctac

SEQ ID NO: 68298 - DNA, 498 bp, Homo sapiens
  misc_feature: GYAE6OF01ECPOE.51.76.G10.1.454.CMB.1.raw
  modified_base (196)..(196): a, c, t, g, unknown or other
  misc_feature (196)..(196): n is a, c, g, or t
  modified_base (494)..(494): a, c, t, g, unknown or other
  misc_feature (494)..(494): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcaccatcagcagcctgcagtctagaagtattttgctaatttattactgtccagcagtataataactggacctccgtactacttttggaccgtaggggaccaaggcgtaggagatacaaacgaactgtggctgcnctac

SEQ ID NO: 68299 - DNA, 514 bp, Homo sapiens
  misc_feature: GYAE6OF01DMP73.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtgcaggtggtctgggacagagttcactctacaccatcagcagcctgcagtctagaagtattttgactaatttattactgtcagtacagtaataataactggtccctaccgttactacgttttcggaccgaggggaccaaggcgtggagtactacgaaacgaacgtgtaggctgcgacctacg

SEQ ID NO: 68300 - DNA, 559 bp, Homo sapiens
  misc_feature: GYAE6OF01DLMS4.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatactcccagccaggttcagtggcaggtgggtctggggacagagttcactctcaccatcagcagcctgcagtctagaagtattttgactaaattttatttaacttgtactagctaagtaattaaattaactcggtaccttaccggttacctacgttttcgggacccgtacggggtaaccctaaggtccgtagggaacgtaacgtaccgaaaacgtaaccgttaggttacggcgtacgcctaccgtacg

SEQ ID NO: 68301 - DNA, 573 bp, Homo sapiens
  misc_feature: GYAE6OF01D3G6Q.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaaggccactgatatcccagccaggttcagtggcagtggtctgggacagagttcactctcacatcagcagcctgcagtctgtaagtattttgactaattttattacttgtcagtacaagttaataacttaacgttcgggtcccttaccggttacctaccgtttttacgggaccgtaacgggggtacccgtaaacggtccgttagggaaggtaacgttaaccgtaaaacggtaaaccgttagggttacgggaccgttacggccgtaacccgtacg

SEQ ID NO: 68302 - DNA, 495 bp, Homo sapiens
  misc_feature: GYAE6OF01D4OZ1.51.76.G10.1.454.CMB.1.raw
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcacatcagcagcctgcagtctagaagtattttgactaatttattacttgtcagctagtataataactgtcctcgtactactttggccgtagggaccaagctaggagatacaaacgactgtacggntgcnctacg

SEQ ID NO: 68303 - DNA, 489 bp, Homo sapiens
  misc_feature: GYAE6OF01DPHRY.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcagtgggtctgggacagagttcatctcaccatcagcagcctgcagtctagaagtattttgctaatttattactgtcagcagtataataatgtcctcgtactactttgcgagggaccaagctaggagatacaaacgaactggtggatcgcacctacg

SEQ ID NO: 68304 - DNA, 572 bp, Homo sapiens
  misc_feature: GYAE6OF01ECW8E.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcgagggccagtcagagtgttagcagcgacttagcctggtaccagcaagaacctggccaggcctcccgaggcctcctcatctatgatgcatccacgaacggccactgactactcccagcctaggttcaggtgcgaggtgggtcgtgggacaggtagttccactctacaaccatcagacacgtccgtgcagtcgtagtaagttattttacgacttaatttacttacgttgtactagtactaagttataactaacgttcgtacccttaccgtaccttacgtttcggaccgtacggggtacctaggtcgttaggacgtactaaccgaaacggtacgtacggtacggactcggcctaccgtacg

SEQ ID NO: 68305 - DNA, 530 bp, Homo sapiens
  misc_feature: GYAE6OF01DIQHH.51.76.G10.1.454.CMB.1.raw
  modified_base (197)..(197): a, c, t, g, unknown or other
  misc_feature (197)..(197): n is a, c, g, or t
  modified_base (397)..(397): a, c, t, g, unknown or other
  misc_feature (397)..(397): n is a, c, g, or t
  modified_base (524)..(524): a, c, t, g, unknown or other
  misc_feature (524)..(524): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaanagccaccctctcctgcaggggccagtcagagtgttagcagcgacttgcctggtaccagcagaaacctggccaggctcccaggctcctcatctatgatgcatccacaagggccactgatactcccagccaggttcagtggctaggtgggtctgggacaggacgttcactctcaccatcagcagcctgcagtctagtaagtnttttgactaatttattactgtctagctaagtataataactcggtaccttaccgtactacgtttcggccgtacggggaccaaggtcgtagggagtacgtacgaaacgtacgtcggtacggtactgccncgtacg

SEQ ID NO: 68306 - DNA, 486 bp, Homo sapiens
  misc_feature: GYAE6OF01BZ8LE.51.76.G10.1.454.CMB.1.raw
  modified_base (195)..(195): a, c, t, g, unknown or other
  misc_feature (195)..(195): n is a, c, g, or t
  modified_base (462)..(462): a, c, t, g, unknown or other
  misc_feature (462)..(462): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctggggacagagttcactctcaccatcagcagcctgcagtctgaagattttgctaatttattactgtcagcagtataataactgtcctcgtactacgtttgccgtagggaccagctaggantacaaacgacgtgagctgcactag

SEQ ID NO: 68307 - DNA, 546 bp, Homo sapiens
  misc_feature: GYAE6OF01A3TK3.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccatgatatcccagccagttcagtgcagtggtctgggacagattcactctcaccatcagcagcctgcagtctgagtatttgctaatttattactgtccagtctaagtataataactacggtaccttaccgtactaccgttttacggacccgtaacggggtaccctaacggtcgtagggacgtaacgtaaccgtaaaacggtaacgttacggtacgggtaccgtacgaccgtaccgtaacg

SEQ ID NO: 68308 - DNA, 496 bp, Homo sapiens
  misc_feature: GYAE6OF01ADOUV.51.76.G10.1.454.CMB.1.raw
  modified_base (492)..(492): a, c, t, g, unknown or other
  misc_feature (492)..(492): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctagaagtatttgctaatttattactgtcagcagttataattaactgtccttccgtactacttttggccgagggaccaagcgtggagatacgaaacgactgtaggactgcnctac

SEQ ID NO: 68309 - DNA, 578 bp, Homo sapiens
  misc_feature: GYAE6OF01D5S2Q.51.76.G10.1.454.CMB.1.raw
  modified_base (196)..(196): a, c, t, g, unknown or other
  misc_feature (196)..(196): n is a, c, g, or t
  modified_base (414)..(414): a, c, t, g, unknown or other
  misc_feature (414)..(414): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatccacgaacgggccaactgactactcccagccaggttccagtcggctaggtgggtctggggactaggtacgttcaaccttctacaccatcgacgcacgcctgctagtctagtaagtntttagcttaatttattacttgtacagtctaagttataacgtaacgttcggtcccttaccgttacctacgttttcggacccgtacggggaaccctaaggtccgttagggaacgtacgtaaccgtaaacgtacgttaggtacggtacctcgacctacccgttaacg

SEQ ID NO: 68310 - DNA, 543 bp, Homo sapiens
  misc_feature: GYAE6OF01CO6YY.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggctcccaggctcctcatctatgatcgcatccacgaacgggccactgactactcccagcctaggttcagtggcaggtgggtctgggacaggtacgttcactctacaccatcagcacgcctcgcagtctagtaagtagttttgactaatttattactgtactagtctaagtaataataacgttcggtaccttaccgtactacgtttcggaccgtacggggtaccaaggtcgtaggaacgtacgtacgaaacgacgtaggtacggactcgcactacg

SEQ ID NO: 68311 - DNA, 529 bp, Homo sapiens
  misc_feature: GYAE6OF01CAQMO.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcagaaacctggccaggctcccaggcctcctcatctatgatgcatccaacaagggccactgatactcccagccaggttcaggtggcaggtgggtctgggacagagttcactctcaccatcagcagcctgctagtctagaagtattttgactaatttattactgtacagtactaagtaataataactcggtaccttaccgtactacgttttcggaccgtacggggaccaaggtcgtaggagtactacgaaacgactaggtacgacgtcgccacgtacg

SEQ ID NO: 68312 - DNA, 488 bp, Homo sapiens
  misc_feature: GYAE6OF01AFYJH.51.76.G10.1.454.CMB.1.raw
  modified_base (484)..(484): a, c, t, g, unknown or other
  misc_feature (484)..(484): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatactcccagccaggttcagtggcagtggtctgggacagagttcactctcaccatcagcagcctgcagtctgaagtatttgctaatttattactgtcagctagtataatactgtcctccgtactactttggcctagggaccagcgtaggagactacaaacgacgtgtgctgcnctac

SEQ ID NO: 68313 - DNA, 564 bp, Homo sapiens
  misc_feature: GYAE6OF01DWDUY.51.76.G10.1.454.CMB.1.raw
  modified_base (196)..(196): a, c, t, g, unknown or other
  misc_feature (196)..(196): n is a, c, g, or t
  modified_base (320)..(320): a, c, t, g, unknown or other
  misc_feature (320)..(320): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggcccaggcctcccaggcctcctcatctatgatgcatccacaagggccactgatacncccagcctaggttcagtggcaggtgggtctgggacaggcgttcactctccaccatcacgcacgcctgcagtctagaagttattttcgacttaattttacttaacttgtcagtactaagttaattaataacgttcggtacccttaccggttacttaccgttttcgggacccgtacggggacctaaggtcgtaggagtaactaacgaaaccgaacgttcggtacggacttacggcctaaccgtacg

SEQ ID NO: 68314 - DNA, 521 bp, Homo sapiens
  misc_feature: GYAE6OF01DMHJU.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcagaacctggccaggcctcccaggcctcctcatctatgatgcatccacaagggccactgactactcccagccaggttcagtggctaggtggtctgggacagtagttcactctcaccatcagcagcctgcagtctagaatatttgactaatttattactgtacagctaagtataataactcggaccttacgtactacgtttcggaccgtacggggacctaaggtctagggacacgtacgaaacgtacgtggtgactcgccacgtacg

SEQ ID NO: 68315 - DNA, 497 bp, Homo sapiens
  misc_feature: GYAE6OF01ESQ7W.51.76.G10.1.454.CMB.1.raw
  modified_base (389)..(389): a, c, t, g, unknown or other
  misc_feature (389)..(389): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcaccatcagcagcctgcagtctagaagtnttttgctagtttacttactgtcagcagtccgtaactactggtctcgtcgtttcggcggagggaccgaaggtggagatacgaaacgactgcggtctgacactatcgtcg

SEQ ID NO: 68316 - DNA, 573 bp, Homo sapiens
  misc_feature: GYAE6OF01BK296.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcaagaaacctggccaggcctcccgaggctcctcatctatgatgcatccacgaagggccactagatactcccagccgtaggttcaggtcggcgaggtgggtctgggactaggacgttcactctacactatcagcacgtcctgctagtctagaatatttgacttaatttatactgactagactaagttaataactacgtcgtacctaccgttacgtaccgtttacgggaccgtaaggggtaacccaagggtccgttagggaacgtaacgtaaccgtaaaaccgtaacgttaggtacggtaccgtacgaccgtaccgtaacg

SEQ ID NO: 68317 - DNA, 485 bp, Homo sapiens
  misc_feature: GYAE6OF01CY6FR.51.76.G10.1.454.CMB.1.raw
  modified_base (195)..(195): a, c, t, g, unknown or other
  misc_feature (195)..(195): n is a, c, g, or t
  modified_base (478)..(478): a, c, t, g, unknown or other
  misc_feature (478)..(478): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcagaaacctggccaggctcccaggctcctcatctatgatgcatccacaagggccactgatatcccagccaggttcagtggcagtgggtctgggacagagttcactctcactatcagcagcctgcagtctgaagtattttgctaatttattactgtcagcagtataataactgcctaccgtactactttggccaggggaccaagctggagatacaaacgactgtagntgcacta

SEQ ID NO: 68318 - DNA, 532 bp, Homo sapiens
  misc_feature: GYAE6OF01AY2C5.51.76.G10.1.454.CMB.1.raw
  modified_base (527)..(527): a, c, t, g, unknown or other
  misc_feature (527)..(527): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagcccaccctctcctgcagggccagtcagagtgttagcagcgacttagcctggtaccagcagaaacctggccaggcctcccaggcctcctcatctatgatgcatccacagggccactgatatcccagccaggttcagtggcaggtgggtctggggacaggtagttcacgtctcaccatcagcagcctgcagtctagaagtattttgacttaatttattactgtacagctaagttaataacttaacgtgtacccttacgtacttacgtttcggaccgtacggggtaacctaaggtcgtaggagtacgtacaaacgacgtggtcggactgacnccgta

SEQ ID NO: 68319 - DNA, 525 bp, Homo sapiens
  misc_feature: GYAE6OF01BHJ2A.51.76.G10.1.454.CMB.1.raw
  modified_base (353)..(353): a, c, t, g, unknown or other
  misc_feature (353)..(353): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatactcccagccaggttcagtggcagtgggtctgggacagngttcactctcaccatcagcacgcctgcagtctagaagtattttgactaattttattacgtgtcagctaagttataataacttcggaccttccgtactacgtttcgggaccgtaggggaccaaggtcgtagggagactacgaaacgtacgtcggtaggacgtcgcgtcctacg

SEQ ID NO: 68320 - DNA, 497 bp, Homo sapiens
  misc_feature: GYAE6OF01B9MH9.51.76.G10.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (487)..(487): a, c, t, g, unknown or other
  misc_feature (487)..(487): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccanaagggccactgatatcccagccaggttcagtggcagtgggtctgggacagagttcactctcaccatcagcagcctgcagtctgaagtattttgctaatttattactgtcagtcagtataataactggccttccgtactactttcggaccgagggaccaaggtctaggagatacgaaacgactgtgntcgcacgtac

SEQ ID NO: 68321 - DNA, 517 bp, Homo sapiens
  misc_feature: GYAE6OF01BITHO.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcagtggtctgggacagagttcactctcaccatcagcagcctgcagtctagaagtattttgacttaatttattacttgtacagtctagtaataattactggtaccttcgtactacgtttcggaccgtaggggaaccctaggctaggacgtactaccgaaacgacgttggtagactcgcacctacg

SEQ ID NO: 68322 - DNA, 540 bp, Homo sapiens
  misc_feature: GYAE6OF01ARCII.51.76.G10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagagtgttagcagcgacttagcctggtaccagcagaacctggccaggctcccaggctcctcatctatgatgcatccacaagggccactgatatcccagccaggttcagtgcaggtgggtctgggacaggagttcactctcaccatcagcagcctgcagtctagaagtatttgactaatttattactgtacagtctaagttaataagtaacgtcggtacccttaccgtactacgttttcggaccgtacggggtacctaacggtccgtagggagtacgtacgaaacgtaacgttaggtacggtacgtcgccgtaccgtacg

SEQ ID NO: 68323 - DNA, 508 bp, Homo sapiens
  misc_feature: GYAE6OF01CJY22.51.76.G10.1.454.CMB.1.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
  modified_base (494)..(494): a, c, t, g, unknown or other
  misc_feature (494)..(494): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaaggtagtgatgacgcagtctccagccaccctgtctgtgtctccaggggaaanagccaccctctcctgcagggccagtcagagtgtagcagcgacttagcctggtaccagcagaacctggccaggctcccaggctcctcatctatgatgcatccanaagggccactgatactcccagccaggttcagtggcaggtcgggtctgggacagtagttcacttcncacatcagcagcctgcagtctgaagtatttgactaatttattactgtcagactagtataatactcgtactccgtactacgtttcgccgtagggaccaagtcgtaggagatacgaaacgacgtgtacggntacgctaccgtacg

SEQ ID NO: 68324 - DNA, 492 bp, Homo sapiens
  misc_feature: GYAE6OF01AFICL.51.76.G10.1.454.CMB.1.raw
  modified_base (196)..(196): a, c, t, g, unknown or other
  misc_feature (196)..(196): n is a, c, g, or t
  modified_base (486)..(486): a, c, t, g, unknown or other
  misc_feature (486)..(486): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcaccatcagcagcctgcagtctgaagtattttgctaatttattactgtcagcagtataatactgcctcgtactactttgccgtagggaccagtcgtaggagatacaaacgtacgtgtcggactgcncgtacg

SEQ ID NO: 68325 - DNA, 483 bp, Homo sapiens
  misc_feature: GYAE6OF01AWNLE.51.76.G10.1.454.CMB.1.raw
  modified_base (196)..(196): a, c, t, g, unknown or other
  misc_feature (196)..(196): n is a, c, g, or t
  modified_base (474)..(474): a, c, t, g, unknown or other
  misc_feature (474)..(474): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtatttgctaatttattactgtcagcagtataatactgctcgtactctttgccgtagggaccagcgtggagatacaaacgactgtagntcgcactac

SEQ ID NO: 68326 - DNA, 597 bp, Homo sapiens
  misc_feature: GYAE6OF01EHED3.51.76.G10.1.454.CMB.1.raw
  modified_base (203)..(203): a, c, t, g, unknown or other
  misc_feature (203)..(203): n is a, c, g, or t
  modified_base (344)..(344): a, c, t, g, unknown or other
  misc_feature (344)..(344): n is a, c, g, or t
  modified_base (440)..(440): a, c, t, g, unknown or other
  misc_feature (440)..(440): n is a, c, g, or t
tcagcgatcgtatacacgaccggtgctcgatttagtcactcatacgagggggaggaactgctcagttacggacccagacggaaccatggaacgccccagcgcagtcttctcttcctcctgctactctggctcccagactaccactggaagaagtagtgatgacgcagtctccagcccacctgtctgtgtctccgaaggggaanacgcccaccctctcctgcgacgggccagtcagagtgttagcagcgtacttacgccgtggtaccagcaacgaaaccgtcggccaggcctcccgaggctccctcatctatgatgcactccaacgaacgggccactgacttacncccagcctaggttcaggtcgactagggtcgggtcgtggggacaggtacgttcacttctacacctatcacgcacgtcctgactagtctagtaagttntttgactttaatttatacttgtacagtataagttataacgttaacgtccggtaccttccgttaaccttcgtttcggaccggtacgggaacgtaacggtcgtagggacgtacgtaaccgaaacggttacgtcggtacgacctacgcctaaccgttacg

SEQ ID NO: 68327 - DNA, 583 bp, Homo sapiens
  misc_feature: GYAE6OF01EAZSM.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggcctccgaggcctcctcatctatgatcgcactccaacgaacgggccacgtgactactcccgagccgtaggttcaggtcggcgtaggtcgggtcgtagggacaggtacgttcacttctaccacctatcgagcacgcctgctagtcgtagtaagttagttttacgactttaattttacttacgttcgtactagtactaagttaactaagttaaccgttcggtacccttaccgttaccttcgtttacggaccggtaacgggaacctaggtcgtagggactacgtaacgaaacgtacgtggtacgactcgacctcgtac

SEQ ID NO: 68328 - DNA, 521 bp, Homo sapiens
  misc_feature: GYAE6OF01B34QO.51.76.G10.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgagggggaaanagcccaccctctcctgcagggccagtcagagtgttagcagcgacttagcctggtaccagcagaaacctggccaggctccaggctcctnatctatgatgcactccaacgaacgggccaactgaactactccccagccaggttcaggtggctaggtgggtctggggacaggtagttcactctcaccatcagcagcctgcagtctagaagtattttagactaatttatactgtacagtcaagttataataactcggtcctacgtactacgtttcggaccgtacggggaccaggctaggagactacgaaacgtactggtgatgcacta

SEQ ID NO: 68329 - DNA, 761 bp, Homo sapiens
  misc_feature: GYAE6OF01CZZYC.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaagacgcccaccctctcctgcagggccagtcagagtgttagcagcgacttagcctggaccagcaagaacctggaccaggcctcccgaggcctcctcatctatgatgacactaccaacgaaacgggccaactgtaactactcccgaagtccctaagggtttccaagggttcgggacgtaggggtttcggggtaccgtagggggaacctaagggtacgttttccgaaaccgttcccgttaccgaacccgaacttacccgaacgggaccgaaccggtaccccgttgggacctaagggtttacccgttaagggtaaaacgtttagtttttttacggaaccttttaaaagttttttaacttttaaccgtttaggttacccgaagtaccgttaaaggttaaatttaaaacgttaaacgttaccgggtaccctttacccggttaactttaccggtttttacgggacccgtaaacggggggaaccctaaagggtccggtaagggtaacgtaacgtaaaccgtaaaaaccgtaacgttcgggtacggtaaccttcggaaaccctaccgttaaccg

SEQ ID NO: 68330 - DNA, 492 bp, Homo sapiens
  misc_feature: GYAE6OF01A711A.51.76.G10.1.454.CMB.1.raw
  modified_base (197)..(197): a, c, t, g, unknown or other
  misc_feature (197)..(197): n is a, c, g, or t
  modified_base (482)..(482): a, c, t, g, unknown or other
  misc_feature (482)..(482): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagngccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctagaagtattttgctaatttattactgtcagcagtataataactgtcctccgtactactttggccgagggaccaagcgtaggagtatacaacgaactggngctgcactac

SEQ ID NO: 68331 - DNA, 522 bp, Homo sapiens
  misc_feature: GYAE6OF01CUER7.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgagggggaaagagccaccctctcctgcagggccagtcagagtgttagcagcgacttagcctggtaccagcagaaacctggccaggctcccaggctcctcatctatgatgcatccacaagggccactgatactcccagcctaggttcagtggctaggtgggtctggggacaggtagttcactctcaccatcagcagcctgcagtctgaagtatttagactaatttattacttgtactagtactaagtataataactggtacctaccgtactacgtttcggaccgtacgggaccaagtcgtaggagtatacgaaacgactacggtagatgcaccta

SEQ ID NO: 68332 - DNA, 538 bp, Homo sapiens
  misc_feature: GYAE6OF01EDSR4.51.76.G10.1.454.CMB.1.raw
  modified_base (196)..(196): a, c, t, g, unknown or other
  misc_feature (196)..(196): n is a, c, g, or t
  modified_base (350)..(350): a, c, t, g, unknown or other
  misc_feature (350)..(350): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggcctcctcatctatgatgcatccacagggccactgatactcccagccaggttcagtggcagtggtctgggacagngttcactctcacatcagcagcctgctagtctagaagtatttgacttaatttattactgtacagtctaagtataagtaacgtcggtaccttaccgtacttacgtttcggaccgtacggggaacctaaggtcgttaggaacgtacgtacgaaaacgtacgttaggtacggacttcggacctaaccgtacg

SEQ ID NO: 68333 - DNA, 491 bp, Homo sapiens
  misc_feature: GYAE6OF01EINI2.51.76.G10.1.454.CMB.1.raw
  modified_base (487)..(487): a, c, t, g, unknown or other
  misc_feature (487)..(487): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcttgcagggccagtcagagtgttagcagcgacttagcctggtaccagcagaaacctggccaggctcccaggctcctcatctatgatgcatccacaagggccactgatatcccagccaggttcagtgcagtgggtctgggacagagttcactctcaccatcagcagcctgcagtctgaagtattttgctaattttatacttgtcagtctagtataataactggtcctcgtactactttggccagggaccaaggcgtaggagatcgaaacgactggtgatgcncgta

SEQ ID NO: 68334 - DNA, 526 bp, Homo sapiens
  misc_feature: GYAE6OF01AXE34.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggcctcccaggcctcctcatctatgatgcatccacaagggccactgatactcccagccaggttcagtggcaggtggtctggggacagcgttcactctacaccatcagcacgcctgacagtctagtaagtatttgacttaatttattactgtacagtctagtataattactcggtaccttaccgtactacgtttcggaccgtacgggaccaagcgtaggagtactaccgaaacgtacgtgtacggtactcgtcacgtacg

SEQ ID NO: 68335 - DNA, 539 bp, Homo sapiens
  misc_feature: GYAE6OF01DAXI1.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaacctggccaggctccaggctcctcatctatgatgcatccacgagggccatgatactcccagccaggttcagtgcagtgggtctgggacagtagttcactctcacatcacgcacgcctgctagtctagtaagtatttgtactaatttattactgtacagtacaagttataataactacggtccttaccgtactacgttttcggaccgtacggggaccgaacggtacgtaggaagtacgtaaccgaaacgaacgttaggtacggactacgcgtaaccgtacg

SEQ ID NO: 68336 - DNA, 505 bp, Homo sapiens
  misc_feature: GYAE6OF01AJNLC.51.76.G10.1.454.CMB.1.raw
  modified_base (196)..(196): a, c, t, g, unknown or other
  misc_feature (196)..(196): n is a, c, g, or t
  modified_base (490)..(490): a, c, t, g, unknown or other
  misc_feature (490)..(490): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtatttgactaatttattactgtcagtcagtataataactggtcctaccgtactacgtttcggccgtacggggaccaagcgtaggagactacaaacgaactggnggactcgcaccgtac

SEQ ID NO: 68337 - DNA, 590 bp, Homo sapiens
  misc_feature: GYAE6OF01AQ3OW.51.76.G10.1.454.CMB.1.raw
  modified_base (207)..(207): a, c, t, g, unknown or other
  misc_feature (207)..(207): n is a, c, g, or t
  modified_base (443)..(443): a, c, t, g, unknown or other
  misc_feature (443)..(443): n is a, c, g, or t
tcagcgatcgtatacacgaccggtgctcgatttagtcactcatacgtaggggggaggaactgctccagttaggacccagacggaccatggaagccccagcgccagcttctcttcctcctgctactctggctcccagataccactggagaagtagtgatgacgcaaggtctcccagcccacccgtgtactgtgtctccagggggtaanagccaccgtctcctggccagggccagtcagacgtgtacgcagcgacttagccttggtaccagcagaaaccttggccagggctcccgaggcctcctcatcgtactgatggcagtccacaacgggccacgtacgatactcccgagccaaggttcagtggcagtggtctgggacagagttcactctcgaccatcagcagcctagacacgtctagaagtatttgactaatttacttactntacgagctaagtataactaacgtcgtccttaccgtactacgtttcggaccgtacggggtaccctaacggtcgttagggaacgtaacgttaccgtaaaccggttaacgttacggttacggtaccgtttcggtcctaaccggttaccgg

SEQ ID NO: 68338 - DNA, 543 bp, Homo sapiens
  misc_feature: GYAE6OF01DNUN0.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcagaaacctggccaggctcccaggctcctcatctatgatgcatccacgaagggccactgatactcccagccaggttcagtggcaggtgggtctgggacagagttcactctacacatcagcagcctgcagtctagaagtattttgtactaattttattactgttacagtactaagttaataataacgttacggtacccttacccgttactacgttttcggacccgtacggggtaccaacggtcgtagggagactacgaaacgaacgtggtacgtcgtacgcgtaccgtacg

SEQ ID NO: 68339 - DNA, 582 bp, Homo sapiens
  misc_feature: GYAE6OF01CW9YY.51.76.G10.1.454.CMB.1.raw
  modified_base (211)..(211): a, c, t, g, unknown or other
  misc_feature (211)..(211): n is a, c, g, or t
  modified_base (449)..(449): a, c, t, g, unknown or other
  misc_feature (449)..(449): n is a, c, g, or t
tcagcgatcgtatacacgaccggtgctcgatttagtcactcatacgagggagggaactgctcagttaggacccagacggaacccagtggaacgaccccgagtccgctaggcttctcttcctcctgctactctggctcccagataccactggagtaaggtagtgatgacggtcagtctccagtccaccgtgtctgtgtctccgaggggaaanagccaccgtcgtccgtgggcgagggtccagtcgagtaggtcgttagcagcgacttagcctggtaccagcaggaaacctggcctaggctcccaggtctcctcaatcgtatcgatcgccagtccgacgaagggccacgtgaactactcccgaagccaaggttcaaggtggcgaaggtagggtctaggggacaggacgtttcacgtctacgaccatccagctagcctgacaagtcagaatntttgactaatttatacgtgtacaggactaagtactaaagtaacgtcggacctaccgtactacttttggacctaaggggaccaaggcgtaggagactacgaaaacgaacgtggtaggacctggacctacgtacg

SEQ ID NO: 68340 - DNA, 519 bp, Homo sapiens
  misc_feature: GYAE6OF01A3PRK.51.76.G10.1.454.CMB.1.raw
  modified_base (196)..(196): a, c, t, g, unknown or other
  misc_feature (196)..(196): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcccgtacagcagaaacctaggccaggctcccaggctcctcatctatgatgcatccacaagggccactgatactcccagccaggttcagtgggcagtgggtcgtgggacagagttcactctcaccatcagcagcctgcagtctgaagtattttgactaatttattactgtnagnagtataataacgtcgtcctccgtactacttttcggaccgtaggggaccaagcgtggaagactacgaaaacgaacttggtacggactagcctaccgtgttaccg

SEQ ID NO: 68341 - DNA, 627 bp, Homo sapiens
  misc_feature: GYAE6OF01DYKJH.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgcgtcagttaggacccagacggaaccatggaagccccagcgcagcttctcttcctcctgctactctggctcccagataccactggagaagtagtgatgacgcagtctccagccaccctgtctgtgtctccaggggtaanagccaccctctcctgcacgggccgacgtcacgagtgttagtcagcgacttagccgtaggtaccgagcaacgaaacctacggtccgacggctcccacggctccctccatctactaggactagcatcctacgaagggaccgactagataactcccgacgccgtacggttgacgtggcgtagtgggttcgtcgggacagtagttacactctcgaccatacagacacgccgtgcacgtacgtgtaagtagttttcgacgtaatttttaactttacgttacgttctagtacgtacgttaattaaattaacgttcggtacccttaccgtttacttacggttttacggaccggacgggggtaaccctaacgtcgtagggtaggtaacttaaccggaaacgtaaaccgttcggtacggtacctcggtccaccgtaacg

SEQ ID NO: 68342 - DNA, 511 bp, Homo sapiens
  misc_feature: GYAE6OF01ESPP3.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccatgttcagtggcagtgggtctgggacagagttcactctcacatcagcagcctgcagtctgtaagtattttgactaagtttattactgtcagctagtataataactggcctacgtactacgtttcggaccgagggtaccacgtcgtagggacgtataccgaaacgtacgttagtaggtcgtgcctaaccg

SEQ ID NO: 68343 - DNA, 508 bp, Homo sapiens
  misc_feature: GYAE6OF01DFN68.51.76.G10.1.454.CMB.1.raw
  modified_base (196)..(196): a, c, t, g, unknown or other
  misc_feature (196)..(196): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (497)..(497): a, c, t, g, unknown or other
  misc_feature (497)..(497): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatactcccagccaggttcagtggcagtgggtcngggacngagttcactctcaccatcagcagcctgcagtctagaagtattttgactaattttattactgtcagcagtataatactggtccttaccgtactacgtttggcctaggggaccaaggtcgtaggaggtatacgaaacgacgtgtacggntagcctactac

SEQ ID NO: 68344 - DNA, 492 bp, Homo sapiens
  misc_feature: GYAE6OF01A01KT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcagtgggtctgggacagagttcactctcaccatcagcagcctgcagtctgaagtatttgctaatttattactgtcagcagtataataactggcctccgtactacgtttggcctacgggaccaaggctaggagatacaaacgactgtaggctgcacgtac

SEQ ID NO: 68345 - DNA, 511 bp, Homo sapiens
  misc_feature: GYAE6OF01AI7BD.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggctcccaggctcctcatctatgatgcatccacaacgggccactgatactcccagccaggttcaggtggctaggtgggtctgggacaggtagttcactctcaccatcagcagcctgcagtctagaagtatttgactaatttattactgtcagctaagtataataactcgtccttcgtactacgtttcggccgtagggaccaagtcgtaggagatacgaaacgacgtcgtagactcgcacgtac

SEQ ID NO: 68346 - DNA, 548 bp, Homo sapiens
  misc_feature: GYAE6OF01BO4PF.51.76.G10.1.454.CMB.1.raw
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcaagaacctggccaggcctcccgaggcctcctnatctatgatgcatccaacgaacgggcccacgtgatactcccgagcctaggttcaggtcggcgtaggtgggtcgtagggacaggtacgtttcactctacacatcagcacgcctgctagtctagtagtatttcgacttaatttattactgtacagactagtaactaatacgtacggtaccttaccgtactacgtttacggccgtagggtaaccaggtcgtaggacgtagtaccgaaacgtacgtggtacgagtcgcgtactacg

SEQ ID NO: 68347 - DNA, 546 bp, Homo sapiens
  misc_feature: GYAE6OF01CBSEP.51.76.G10.1.454.CMB.1.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaanagccaccctctcctgcagggccagtcagagtgttagcagcgacttagcctggtaccagcagaaacctggccaggctcccaggctcctcatctatgatgcatccanaacgggccactgatactcccagccaggttcagtggcaggtgggtctgggacagacgttcactctcaccatcagcacgcctgcagtctgaagttattttgacttaatttattacttgtactagactaagttacttaaataacttcggaccttccgtactacgttttcggaccgtacggggtaccaaggtcgtagggaacgtactaacgtaaacgacgttacggttacggacttcgccaccgtacg

SEQ ID NO: 68348 - DNA, 543 bp, Homo sapiens
  misc_feature: GYAE6OF01CV8F1.51.76.G10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
tcagcgatcgtatacacgaccggtgctcgatttagtcactcatacaggggaggaactgctcagttaggactcagacggaaccatggaagccccagcgcagcttctcttcctcctgctactctggctcccagataccactggagaagtagtgatgacgcagtctccagccaccctgtctgtgtctccaggggaaanagccaccctntccngcagggccagtcagagtgtagcagcgacttagcctggtaccagcagaaacctggccaggctccaggctcctcatctatgatgcatccaacaacgggccactgatactccagccaggttcagtggcaggtgggtctggggacagagttcactctcacatcagcacgctgcagtctagtaagtatttgacttaatttattactgtactagactagttaataataacgtggtaccttaccgtaacttacgttttacggaccgtaacggggaccgtaacggtacgtagggagtaacgtaacgaaaacgtaacgttacggtaggtcgtaggcctaaccg

SEQ ID NO: 68349 - DNA, 497 bp, Homo sapiens
  misc_feature: GYAE6OF01EHOVE.51.76.G10.1.454.CMB.1.raw
  modified_base (196)..(196): a, c, t, g, unknown or other
  misc_feature (196)..(196): n is a, c, g, or t
  modified_base (492)..(492): a, c, t, g, unknown or other
  misc_feature (492)..(492): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctagaagtattttgctaattttattactgtcagctagtataataactgcctccgtactactttggccgagggaccaacgctggagatacgaaacgaacgtggtagactgcnctacg

SEQ ID NO: 68350 - DNA, 505 bp, Homo sapiens
  misc_feature: GYAE6OF01DR4R1.51.76.G10.1.454.CMB.1.raw
  modified_base (196)..(196): a, c, t, g, unknown or other
  misc_feature (196)..(196): n is a, c, g, or t
  modified_base (501)..(501): a, c, t, g, unknown or other
  misc_feature (501)..(501): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcaggtgggtctgggacagagttcactctcaccatcagcagcctgcagtctagaagtatttgactaatttattactgtcagtctaagtataataacgtgtccttaccgtactacgtttcggccgtagggaccaagcgtaggagatacaaacgaacgtgtagctcgcnctac

SEQ ID NO: 68351 - DNA, 564 bp, Homo sapiens
  misc_feature: GYAE6OF01C31P0.51.76.G10.1.454.CMB.1.raw
  modified_base (370)..(370): a, c, t, g, unknown or other
  misc_feature (370)..(370): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaagacgcccaccctctcctgcagggccagtcagagtgtagcagcgacttagcctggtaccagcagaacctggccaggctcccaggcctcctcatctatgatgcatccaacgaacgggccactgatactcccagccaggttcaggtggcaggtggtctgggacagagttcactcncacatcagcagcctgctagtcgtagaagtattttgactaattttattacttgtacagtactaagttataaactacgtacggtaccttaccgtacgttaccgttttcggaccgtaacggggtaacccaaggtccgtagggaactacgtaaaccgaaacggtaacgttacggtacggacctcggacctaccgtacg

SEQ ID NO: 68352 - DNA, 508 bp, Homo sapiens
  misc_feature: GYAE6OF01E2XTL.51.76.G10.1.454.CMB.1.raw
  modified_base (394)..(394): a, c, t, g, unknown or other
  misc_feature (394)..(394): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggctcccaggctcctcatctatgatgcatccacaacgggccactgactactcccagccaggttcagtggcaggtgggtctgggacagagttcactctcaccatcagcagcctgcagtctgaagtnttttgactaatttattactgtcagctagtaatataactcggtccttcgtactacgtttggaccgaggggaccaggcgtaggagtacacgaaacgtacgtgtaggctcgcactcg

SEQ ID NO: 68353 - DNA, 483 bp, Homo sapiens
  misc_feature: GYAE6OF01A7DPD.51.76.G10.1.454.CMB.1.raw
  modified_base (196)..(196): a, c, t, g, unknown or other
  misc_feature (196)..(196): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcacatcagcagcctgcagtctgagtattttgctaatttattactgtcagctagtataatactgcctaccgtactactttgccgtacgggaccagctaggagntacaagacgtgtgntcgcncta

SEQ ID NO: 68354 - DNA, 531 bp, Homo sapiens
  misc_feature: GYAE6OF01D82TM.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatactcccagccaggttcagtggcaggtgggtctgggacagagttcactctcaccactcacgcagcctgcagtctagaagttattttgacttaagtttacttacttgtcagtctaagttataagtactcggtaccctaccgtacttacgtttcggaccgagggtaccaggcgtaggagtactaccgaaacgaacgttggtacggactcggcctaccgtac

SEQ ID NO: 68355 - DNA, 564 bp, Homo sapiens
  misc_feature: GYAE6OF01CDFY4.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtcctccgaggggaaanacgcccaccctctcctgcagggccagtcagagtgtagcagcgacttagcctggtaccagcagaacctggccaggcctcccgaggcctcctcatctatgatcgcatcccaacgaacgggccacgtgaactactcccagtcctaggttcaggtggctaggtcgggtctggggactagtacgttcacgtcacaccatcagcacgcctgcagtctagtaagttagtttgtacttaatttattactgtactagtactaagttataatacgtacgtaccttaccgtactacgtttcggaccgtaacgggtaccaggtcgtaggaacgtactaaccgaaacgtacgtaggtacggtactacgtccgacgtacg

SEQ ID NO: 68356 - DNA, 493 bp, Homo sapiens
  misc_feature: GYAE6OF01ATXJ9.51.76.G10.1.454.CMB.1.raw
  modified_base (195)..(195): a, c, t, g, unknown or other
  misc_feature (195)..(195): n is a, c, g, or t
  modified_base (315)..(315): a, c, t, g, unknown or other
  misc_feature (315)..(315): n is a, c, g, or t
  modified_base (465)..(465): a, c, t, g, unknown or other
  misc_feature (465)..(465): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaacctggccaggctcccaggctcctcatctatgatgcatccacgaagggccactgatancccagccaggttcagtggcagtgggtctgggacagagttcactctcaccatcagcagcctgctagtctgaagtattttgactaatttatactgtcagtcagtataatacgtgtacctcgtactcgtttgccagggacagtcgtagacgtntacgaaacgacgtgtagctgctacgtac

SEQ ID NO: 68357 - DNA, 629 bp, Homo sapiens
  misc_feature: GYAE6OF01A7I1G.51.76.G10.1.454.CMB.1.raw
  modified_base (293)..(293): a, c, t, g, unknown or other
  misc_feature (293)..(293): n is a, c, g, or t
tcagcgatcgtatacacgaccggtgctcgatttagtcactcatacagggggtagggaactgctcagttaggacccagacggaaccatggaagccccagcgcagcttctcttcctcctgctacgtctggctcccagataccactggagaagtagtgatgacgcagtctccagccaccctgtctgtcgtctccgaggggaaacagcccaccctctccctgcacgggccagtcagagtgttagcagcgacttagcctaggtaccagcaagaaacctggccaggctccgaggctccncatcctatcgatcgcctataccaagtaacggggcccaacgtaggactacgtaccccagcctaaggttcaaggtggcctaggtgggtctgggacaggtacgttcactcgtaccaccatacagcacgaccgtggacgacgtctaggaacgttgttttcggactttaaattttacgttacgttgtacctagacctaagttaacttaaacgtaaccgttcgggtacccttaccggttaccgtttaccgtttacgggacccgtaaggggtaaccctagggtcgtaggaagtacgtaaaccgtaaacgtaacgttggtacgtaccgtacgacctaccgtacg

SEQ ID NO: 68358 - DNA, 509 bp, Homo sapiens
  misc_feature: GYAE6OF01BYLMN.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggctcccaggctcctcatctatgatgcatccacaagggccactgatatccagccaggttcagtggcagtgggtctgggacagagttcactctcaccatcagcagcctgcagtctagaagtattttgactaatttattacttgtacagctagtataataactgaccttccgtactactttggccgtacgggacctaaggctaggagtacgtacaaacgaacgtagtacggatcgctacgtacg

SEQ ID NO: 68359 - DNA, 486 bp, Homo sapiens
  misc_feature: GYAE6OF01E1GKC.51.76.G10.1.454.CMB.1.raw
  modified_base (196)..(196): a, c, t, g, unknown or other
  misc_feature (196)..(196): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagtattttgctaatttattactgtcagcagtataataactggcctaccgtactactttggccagggaccaagctaggagatacaaagactgngctgcnctac

SEQ ID NO: 68360 - DNA, 498 bp, Homo sapiens
  misc_feature: GYAE6OF01CBQK6.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtggtctgggacagagttcactctcacatcagcagctgcagtctagagtattttgactaatttattactgtcagcagtataatactgcctacgtactacgtttcggccgtagggaccaaggtctaggacgatacaaacgacgtcgtaggctgctacgtacg

SEQ ID NO: 68361 - DNA, 540 bp, Homo sapiens
  misc_feature: GYAE6OF01BW33A.51.76.G10.1.454.CMB.1.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgacttagcctggtaccagcagaacctggccaggctcccgaggcctcctcatctatgatgcatccaanaaggccatgatacnccagccaggtcaggtgcaggtggctgggacagagttcactctacaccatcagcacgcctgactagtactagtaagtattttagacctttaatttattacttgtacagtactaagttaataatacgtcgtcccttaccgttactacgttttcggaccgacgggtaaccaggtcgtaggagtacgtacgaaacgtaacgtcggtacgactacggacctaccgtacg

SEQ ID NO: 68362 - DNA, 539 bp, Homo sapiens
  misc_feature: GYAE6OF01D1WA2.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcaggggccagtcagagtgttagcagcgacttagcctggtaccagcagaacctggccaggctcccaggctcctcatctatgatgcatccacaagggccactgatactcccagccaggttcagtggcaggtgggtctggggacagagttcactctacacatcagcagcctgcagtctagaagtattttgacttaattttattactgtcagactaagttaataataacgttcggtcccttaccgttactaccgttttcggaccgtaggggacccaaggtccgtagggagaacgtaacgaaaccgtaacgtggtacggctcgccaccgtaacg

SEQ ID NO: 68363 - DNA, 553 bp, Homo sapiens
  misc_feature: GYAE6OF01C9CH8.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctccaggctcctcatctatgatgcatccaacaacgggccactgatactcccagccaggttcagtggcaggtgggtctgggacaggtacgttcactctcacatcagcagctgcagtctagaagtattttgactaattttagttacttcgtacgtagtactaagttaattaaagttaacgtacggtacccttaccgttactacgttttacggaccgtacggggtaccaacggtcgtagggaagtaactacgtaaacggaactggtacggactagcgacccgtacg

SEQ ID NO: 68364 - DNA, 488 bp, Homo sapiens
  misc_feature: GYAE6OF01EJY21.51.76.G10.1.454.CMB.1.raw
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatancccagccaggttcagtggcagtgggtctgggacagagttcactctcaccatcagcagcctgcagtctgaagtattttgctaatttattactgtcagcagtataataactgcctcgtactactttggccagggaccaagtctaggagtatacaaacgactgtaggctgcacta

SEQ ID NO: 68365 - DNA, 521 bp, Homo sapiens
  misc_feature: GYAE6OF01BE6BL.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggcccactgatactcccagccaggttcagtggcaggtgggtctgggacaggagttcactctcaccatcagcagcctgcagtctgaagtatttgactaatttattactgtcagcagttataataacttggtaccttaccgtacctacgtttcggacccgtaggggacccaaggcgtaggagtactacgaaacgacgtggtacggctcgcgtacctacg

SEQ ID NO: 68366 - DNA, 537 bp, Homo sapiens
  misc_feature: GYAE6OF01BZW6M.51.76.G10.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgacttagcctggtaccagcagaacctggccaggctcccaggcctcctnatctatgatgcatccacaagggccactgatactcccagccaggttcagtggcagtgggtctgggacagagttcactctcaccatcagcacgctgctagtctagtaagtatttagactaatttattactgtactagtactaagttataataactcgtaccttaccgtactacgttttcggaccgtacgggtaccaaggtcgtaggacgtacgtaccgaaacgtaacgtaggtacggacgtcgccgtaccgtacg

SEQ ID NO: 68367 - DNA, 554 bp, Homo sapiens
  misc_feature: GYAE6OF01D7SO9.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgtaacgtattttgactaattttacttacttcgtacagtacaagttaataacttaactcggtacccttaccgtactacgttttcggaccgtaggggaccctaaggcgttagggaacgtacgtaaccgaaaacggtaaacgttcggtaacggtcgtacgccgtacccgtaacg

SEQ ID NO: 68368 - DNA, 515 bp, Homo sapiens
  misc_feature: GYAE6OF01CF4C4.51.76.G10.1.454.CMB.1.raw
  modified_base (197)..(197): a, c, t, g, unknown or other
  misc_feature (197)..(197): n is a, c, g, or t
  modified_base (509)..(509): a, c, t, g, unknown or other
  misc_feature (509)..(509): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaangccaccctctcctgcagggccagtcagagtgttagcagcgacttagcctggtaccagcagaaacctggccaggctcccaggctcctcatctatgatgcatccacaagggccactgatactcccagccaggttcagtggcaggtgggtctgggacagagttcactctcaccatcagcagcctgcagtctagaagtattttgactaattttattacttgtacagtctaagtataattacgtcggtcccttaccgtactacgtttcggaccgtaggggaccaggcgtaggagatacgaaacgtactgtgactgcncgtacg

SEQ ID NO: 68369 - DNA, 579 bp, Homo sapiens
  misc_feature: GYAE6OF01EC1ZJ.51.76.G10.1.454.CMB.1.raw
  modified_base (421)..(421): a, c, t, g, unknown or other
  misc_feature (421)..(421): n is a, c, g, or t
tcagcgatcgtatacacgaccggtgctcgatttagtcactcatacagggggaggaactgctcagttaggacccagacggaaccatggaacgccccagcgcagcttctcttcctcctgctactctggctcccagataccactggagaagtagtgatgacgcagtctccagcccaccctgtctgtgtctccgaggggaaagacgcccaccctctcctgcagggccagtcagagtgttagcagcgacttagcctggtaccagcaagaaacctggccaggcctcccgaggcctcctcatctatgatgcactccacgaacggccatgatactcccagccgtaggttcaggtcggcgtaggtgggtctgggaacaggtagttcacgtcctacgacctatcacgcacgtcctagcagtctagaagttntttcgatttaattttacttacgtcgtacgacgtactaagttaataagttaaccgttcggtacccttaccgtacttacgtttcggaaccgtagggaacctaaggtcgtagggacgtaactaaccgaaacgaacgtggtacggtctacggccaacgtacg

SEQ ID NO: 68370 - DNA, 529 bp, Homo sapiens
  misc_feature: GYAE6OF01EYMET.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagagtgttagcagcgacttagcctggtaccagcagaacctggccaggctcccaggcctcctcatctatgatgcatccacgaaggccatgatactcccagccaggttcagtgcagtggtctgggacagagttcactctcaccatcagcagcctgccagtctagaagtattttgacttaatttattacgtgtacagtctaagttataataacgtcggtaccttaccgtactacgtttggaccgtaggggaacctaaggtcgtagggacgtatacgtaaacgaacgtcggtacgactcgaccgtactacg

SEQ ID NO: 68371 - DNA, 773 bp, Homo sapiens
  misc_feature: GYAE6OF01AB99M.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgtagcagcgacttagcctggtaccagcaagaacctggccaggctcccgaggcctcctcatctatgatcgcactcccgaacgaacgggcccagtgactacgtcccgagccgtaaggtttcaggtggcgtagggtgggtctggggaacaggtacgtttccaccttcctacaccacgtcgacgccgtacgcccgtcgacgtacggttacgtaaggtaacgtttaacgtttttacggtaactttaaacttttaacgtttaaccgttacgttaaccgtaacggttaaccgtaaaggtttaaactttaaaccgtttaaaccggttaccgggttaacccccgtttaacccggtttaaccccgtttaacccgggttttttacccgggggaaccccgggttaaaccggggggtaaacccgtaaaccggggttacccggttaaacgggggtaaacggttaaaccggttaaacccggtaaaaacccgggttaaaccggtttacggggttaccgggttaccgttaaccgggtaaccccgtaaacccgtttaaacccggg

SEQ ID NO: 68372 - DNA, 574 bp, Homo sapiens
  misc_feature: GYAE6OF01BINSW.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggcctcctcatctatgatgcatccacaagggccatgatactcccagccaggttcagtggcaggtgggtctgggacagagttcactctcaccatcagcagcctgcagtctagaagtattttgacttaatttattacttgtacagtactaagttaattaactaacgtcggtacccttaccggttacctaaccgttttcggacccgtaacgggggtaaccctaaggtccgttagggaacgtaacgtaaccgtaaaaccggtaaccgttacggtacgggtacctacggtacccgtaaccgtacg

SEQ ID NO: 68373 - DNA, 580 bp, Homo sapiens
  misc_feature: GYAE6OF01DTSIS.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcagaaacctggccaggctccaggctcctcatctatgatgcactccacgaacgggccactgatactcccagccaggttcagtggcaggtgggtctgggacagtagttcacgtctcacatcacgcacgcctgctagtcctagaagttattttgacttaattttattacttgtacagtaccgtaagttaattaaacgttaacgtcggtcccttaccgttaccgttacgttttcgggacccgtaacggggtacccaagggtccgtagggacgtaacgttaccgaaaacgtacgttacggttacgggaccgttacgccgtaacgttaccg

SEQ ID NO: 68374 - DNA, 541 bp, Homo sapiens
  misc_feature: GYAE6OF01DHRXS.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcagaaacctggccaggctcccaggctcctcatctatgatgcatccacagggccactgatatcccagccaggttcagtggcagtggtctgggacagagtcactctcacatcagcagcctgcagtctgaagtattttgctaattttattactgtcagactagttaataattaactggtcccttaccgttactacgttttcggaccgtaacggggacctaaggtccgttagggaacgtaacttaccgaaaacggtaacgtacggttacggactacggcctacccgtacg

SEQ ID NO: 68375 - DNA, 545 bp, Homo sapiens
  misc_feature: GYAE6OF01C1IN0.51.76.G10.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (426)..(426): a, c, t, g, unknown or other
  misc_feature (426)..(426): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagngtgttagcagcgacttagcctggtaccagcagaaacctggccaggctcccaggctcctcatctatgatgcatccacaagggccacgtgactatccccagccaggttcagtggctagtgggtctgggacagtacgttcacgttctacaccatcagcacgcctgcagtctagaagtattttgactaattttattactgtcagtntaagtattaataactcggtccttacccgtacttacgttttcggaccgacggggtaaccaaggtcgtaggaagtaactaccgaaaaccgacgttaggtacggtactacggcacccttacg

SEQ ID NO: 68376 - DNA, 524 bp, Homo sapiens
  misc_feature: GYAE6OF01A6TVC.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatccacaagggccactgatatcccagccaggttcagtggctaggtgggtctgggacaggagttcactctacaccatcagcagcctgctagtctagtaagtattttgacttaatttattacgtgtactagtctaagtataataacgtggtacctacgtactacgtttcggccgtacggggaccaaggcgtaggagtactacgaaacgacgtggtacggactcgcacgtac

SEQ ID NO: 68377 - DNA, 530 bp, Homo sapiens
  misc_feature: GYAE6OF01BEQCJ.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacgaagggccactgatactcccagccaggttcagtggcagtgggtctgggacagagttcactctcaccatcagcacgcctgcacgtctagaagtattttgacttaatttacttacttgtcagtctagttaataacttaactcggtaccttaccgtacttacgtttcggaccgtacggggaccaaggtcgtagggagacgtacaaacgtacgtggtacggactcgcacgtacg

SEQ ID NO: 68378 - DNA, 551 bp, Homo sapiens
  misc_feature: GYAE6OF01CLOS6.51.76.G10.1.454.CMB.1.raw
  modified_base (198)..(198): a, c, t, g, unknown or other
  misc_feature (198)..(198): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaagggggaaanagcccaccctctcctgcagggccagtcagagtgtagcagcgacttagcctggaccagcagaacctggcaggctccaggctccncatctatgatgcatccaacgaacgggccactgatactcccagccaggttcaggtggcaggtggtctgggacagacgttcactctcacatcagcacgcctgcagtctagaagtatttgtactaatttattactgtacagtactaagtaataactaactcggtaccctaccgttaacctacgttttcgggaccgtaacgggggaacctaaggccgtagggaacgtaacgtacgaaaacgtacgttaggtacggacttacgccgtaacctacg

SEQ ID NO: 68379 - DNA, 559 bp, Homo sapiens
  misc_feature: GYAE6OF01DC0ZI.51.76.G10.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (546)..(546): a, c, t, g, unknown or other
  misc_feature (546)..(546): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagcccaccctgtctgtgtctccgaggggaaancgcccaccctctcctgcagggccagtcagngttgtagcagcgacttagcctggtaccagcagaaacctggccaggcctcccaggctcctcatctatgatgcatccacaagggccactgactactcccagcctaggttccaggtggctaggtcgggtcgtggggactaggtagttcgacttctcaccattcacgcacgcctgctacgtcgtagtaagttattttcgacttaattttactttactgtctagtactaagttaataagtaactcggtcccttaccgtactacgtttcggccgacggggtaccaggtcgtaggacgtagtacgaaacgtacgtcggacggtntcgcctacgtacg

SEQ ID NO: 68380 - DNA, 561 bp, Homo sapiens
  misc_feature: GYAE6OF01A9ATT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccgaggctcctcatctatgatgcatccacaacgggccatgatactcccagccaggttcaggtggcaggtgggtctgggacaggagttcactctcaccatcacgcacgcctgcacgtctagaagtattttgacttaatttattactgtacagtctaagttaataaacgttaactcggtacccttaccgtaccttacgtttacgggaccgtacggggtaacctaaggtcgtagggagtaacgtaaccgtaaacggtaacgtaggtacgggacctcggacctaaccgtacg

SEQ ID NO: 68381 - DNA, 714 bp, Homo sapiens
  misc_feature: GYAE6OF01CE07V.51.76.G10.1.454.CMB.1.raw
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgcagggccagtcagngtgtagcagcgacttagcctggtaccagcaacgaacctggaccaggcctacccgaggtcctcctctacttcctatgatcgacactaccgacgaacgggccaacgtgaactactacccagtacccgtaggtttaccgaggttcggacgtagggttcgggtacgtacggggaactaggtacgttacgtaccttccacctaacctacgtaccgaagacccgacgtcccttaggaccgtaacggtaccgttaggttaaacgttagtttttacgaacctttaaattttacgttacttacggttaacctacggtacccgtaagggtacgttacgtaccgttaacgtttccggtaccccttacccgtaccggtaccttaccccgttaacccggttaccggaacccggtaaacgggtaacccaaccgggtaacgtaacgggtaaaaggtaaaccttaaacgggaaccttgggtaacggtccgtacggtaaccc

SEQ ID NO: 68382 - DNA, 712 bp, Homo sapiens
  misc_feature: GYAE6OF01COX7C.51.76.G10.1.454.CMB.1.raw
  modified_base (703)..(703): a, c, t, g, unknown or other
  misc_feature (703)..(703): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagatccactggagaaagtagttgatgaacgctacgtctccacgtccaccctggtctcgttcgtacggtaccgaaggggaaacgccgacccctacccttccttccgtcgaccggacgggacctaggtaccggaagtacgtaggttacgacgagacgttacgttacgccgttacggaaccagacacgtaaacgcggaccgtacggctccaggcctcctataactctagtaggactcgtccaacggtccaacgtaacggggacctaccgtaggacctaaggttccccaaggtcccgaagggtttcgagtcgggactaggtcgggtcagggtacacgtaacgttcacgtcgtccaacgaccttacgacggaccgtacgtccgtaaggtcccgttaagttaccgttaggttaacgtttacgttttcggtaacctaagtttacttaacgttagttaccaacgtactaaggttacttaacgtacggttacggtacccgtaccggttacgtaccgtttacgggaccgaaccggggtaacaacggtacgtaggacgactacgaacgtactaggtcgacttcncgtactacg

SEQ ID NO: 68383 - DNA, 499 bp, Homo sapiens
  misc_feature: GYAE6OF01D4XCQ.51.76.G10.1.454.CMB.1.raw
  modified_base (196)..(196): a, c, t, g, unknown or other
  misc_feature (196)..(196): n is a, c, g, or t
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
  modified_base (489)..(489): a, c, t, g, unknown or other
  misc_feature (489)..(489): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggcctcctcatctatgatgcatccacaaggccactgactatcccagccaggttcagtggctaggtggtcgtgggacagtagttcactctcacatcacgcagcctgcagtctgaagtntttgactatttatactgtcanctaatataatactgtcctacgtactcgtttgccagggaccaagcgtaggacagtacaaacgtacgtgtacggtacngtccactacg

SEQ ID NO: 68384 - DNA, 582 bp, Homo sapiens
  misc_feature: GYAE6OF01AXRX9.51.76.G10.1.454.CMB.1.raw
  modified_base (285)..(285): a, c, t, g, unknown or other
  misc_feature (285)..(285): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcaagaaacctggccaggctcccaggctcctnatctatgatgcatccacaagggccatgactactcccagccaggttcagtggcaggtgggtctgggacaggacgttcactctcacatcagcacgcctgcagtctagaagtatttacgacttaattttacttacgtagtctagtctaagtaattaaacttaacgttcggtacccttacccgttaactaccgttttcgggaccgtaacggggtaacccgtaaacggtccgttaggggaacgtaacgtaaccgtaaaacggtaacgttacggtacgggtactacggtaccgtaaccgtacg

SEQ ID NO: 68385 - DNA, 521 bp, Homo sapiens
  misc_feature: GYAE6OF01CPSTT.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggctcccaggctcctcatctatgatgcatccacgaacgggccacgtgatactcccagccaggttcagtggcaggtgggtctgggacagagttcactctcacatcagcacgcctgcagtctagaagtatttgactaatttacttactgtacagtactaagtataatactcgtacctaccgtactacgtttcggaccgtacgggaccaacgcgtaggagtacgtacgaaacgtacgtaggtagactcgcacgtacg

SEQ ID NO: 68386 - DNA, 570 bp, Homo sapiens
  misc_feature: GYAE6OF01CS0AY.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcacgaaacctggccaggctcccaggctcctcatctatgatgcatccacaacgggcctaactgactactcccagccctaggtttccaaggttgggactagggttggggtacctggggaactaggtaggtttaccacgttcctaccaacccgtataccaggacctaggccctggctaaggtcctaggtaagtattttgactaattttattaactgtacagactaagtaataatactggtaccttacgtactacgtttcggacgagggaccaaggctagggatactacgaaacgtactggtacggctcgacgactacg

SEQ ID NO: 68387 - DNA, 571 bp, Homo sapiens
  misc_feature: GYAE6OF01BKRZ9.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacgaacgggccactgactactcccagccaggttcagtggcaggtgggtctgggacaggagttcactctcaccatcagcacgcctgcagtctagtaagtattttgacttaattttacttacttgtactagtacgtaagttaataacttaacgttcggtacccttaccgttacttaccgttttcggaccgtacggggaacccgtaaggtccgtaggaacggtaacgtaaccgtaaacgtaaccgttggtacggtaccgtacggccgtaccgtacg

SEQ ID NO: 68388 - DNA, 504 bp, Homo sapiens
  misc_feature: GYAE6OF01BM12L.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatactcccagccaggttcagtggcagtgggtctgggacagagttcactctcacatcagcagcctgcagtctgaagtattttgacttaatttattactgtcagactaagtataataactcggtcctccgtactacgtttggaccgtagggaccaagcgtaggagatacgaaagacgtggtacgactgcgctacg

SEQ ID NO: 68389 - DNA, 619 bp, Homo sapiens
  misc_feature: GYAE6OF01DCQ6H.51.76.G10.1.454.CMB.1.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagcccaccctctcctgcagggccagtcagagtgtagcagcgacttagcctaggtaccagacacgaaccgtggccaggcctcccaggcctccncatctangatgcatccacgaacggccagtgactactcccagcctaggtcaggtcggcgtaggtcgggtctgggaactaggtacgttccgaccttcgtaccaacctactacacggaccacgtcctagactaggttaccttaggtaagttcgttttaacgacctttaaagtttttacttaacgttcgttactaagtacttaagttaacttaaacgttaaccgtcggtacccctttacgtaccgtttacggtttccggaccggtagggtaccaacggtcgtaggacgtaagttaccgaaagtacggttcgtacggtctacaccgtacgtacg

SEQ ID NO: 68390 - DNA, 542 bp, Homo sapiens
  misc_feature: GYAE6OF01DCAMI.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggcctcctcatctatgatgcatccaacaagggcccacgtgactatcccagccaggttcagtggcaggtggtctgggactagacgtttcactctacaccatcagcacgcctgcagtctagtaagtatttgactaatttattacttgtcagtctaagtataagtaacgtacgtccttaccgtacgtacgttttcggaccgtacggggaacctaacggtcgtaggaacgtacgtacgaaacgtaacgtaggtacggactcgacacctacg

SEQ ID NO: 68391 - DNA, 487 bp, Homo sapiens
  misc_feature: GYAE6OF01BAOS5.51.76.G10.1.454.CMB.1.raw
  modified_base (196)..(196): a, c, t, g, unknown or other
  misc_feature (196)..(196): n is a, c, g, or t
  modified_base (478)..(478): a, c, t, g, unknown or other
  misc_feature (478)..(478): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtattttgctaatttattactgtcagcagtataataactgcctcgtactactttgccgtagggaccaagctggagatacgaaacgactgtagntgcactacg

SEQ ID NO: 68392 - DNA, 523 bp, Homo sapiens
  misc_feature: GYAE6OF01C1SS6.51.76.G10.1.454.CMB.1.raw
  modified_base (197)..(197): a, c, t, g, unknown or other
  misc_feature (197)..(197): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgtagcagcgacttagcctggtaccagcagaacctggccaggctcccaggctcctcatctatgatgcatccacaagggccactgatactcccagccaggttcagtggcagtgggtctgggacagtagttcactcncaccatcagcagcctgcagtctgtaagtagtttgtactaatttattacttgtcagtactagttaataatactcgtccttaccgtactacgtttcggaccgtagggacctaacggtcgtaggagtacgtacgtaaacgacgtcggtacgcgtcgcactacg

SEQ ID NO: 68393 - DNA, 501 bp, Homo sapiens
  misc_feature: GYAE6OF01BV3WK.51.76.G10.1.454.CMB.1.raw
  modified_base (197)..(197): a, c, t, g, unknown or other
  misc_feature (197)..(197): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggctcccaggctcctcatctatgatgcatccacaagggccaactgatactcccagccaggttcagtggcaggtgggtctgggacngagttcactctcaccatcagcagcctgcagtctgagtatttgctaatttattacgtgtcagcagtataataactggtcctcgtactacttttggacctaggggaccaaggcgtaggagtatacaaacgaactcgtgactgcctactac

SEQ ID NO: 68394 - DNA, 493 bp, Homo sapiens
  misc_feature: GYAE6OF01BN3WI.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatactcccagccaggttcagtggcagtggtctgggacagagttcactctcacatcagcagcctgcagtctagaagtatttgactaatttattacttgtcagcagttataataactgtcctacgtactactttggacctagggaccaagcgtaggagtatacaaacgactggtagctgcactac

SEQ ID NO: 68395 - DNA, 568 bp, Homo sapiens
  misc_feature: GYAE6OF01DCMVG.51.76.G10.1.454.CMB.1.raw
  modified_base (196)..(196): a, c, t, g, unknown or other
  misc_feature (196)..(196): n is a, c, g, or t
  modified_base (401)..(401): a, c, t, g, unknown or other
  misc_feature (401)..(401): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctcctgcagggccagtcagagtgttagcagcgacttagcctggtaccagcagaacctggccaggctcccaggctcctcatctatgatgcatccagaaggccatgactactcccagcctaggttcaggtgcgtaggtgggtcgtgggacaggtacgttcacgtctaccactatcagcacgcctgcagtctgtaagtnttttgacttaattttacttacgtcgttacagtactaagttaattaacgttaaccgtcggtacccttaccgttacgttaccgttttacggaccgtacggggaccctaaggtcgtagggagtaacgtacgaaacgtaacgttggtacggacctacgtccgtaccgtacg

SEQ ID NO: 68396 - DNA, 707 bp, Homo sapiens
  misc_feature: GYAE6OF01DTAMT.51.76.G10.1.454.CMB.1.raw
  modified_base (104)..(104): a, c, t, g, unknown or other
  misc_feature (104)..(104): n is a, c, g, or t
  modified_base (143)..(143): a, c, t, g, unknown or other
  misc_feature (143)..(143): n is a, c, g, or t
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
tcagcgatcgtatacacgaccggtgctcgatttagtcactcatacaggggagaactgctcagttaggacccagacggaaccatggaagccccagcgcagcttcncttcctcctgctactctggctcccagactaccactgganagtagtgatgacgcagtctcagccacctgtctgtgtctcgaggggaaangccacctntcctgcagggccagtcagagtgtacgcagcgacttagcctggtaccagcagaacctggaccaggcctcccgaggcctcctcagtctaatgatcgcatccgacaggtccagtgactacgtcccgagtccgaggttccaggttcggacctaagggttcgggttccgtagggtacctaggtaccgttcaccgttccgtaccgacctacgtcgacgtaccgtaacggtcccttggtacctacggttccgtacggtaacgttacgttttaccggaccttaaacgttttacgttaccgttacggttacgtaacggtacccgttaaggttaaccgttaaacgttacccgttacgggttacccttaccggttaacctttaccgggttttaccgggacccgttaaacgggggtaccctaaacggtccggtaacgggttaacgtaacccggttaaccgtaaaccggttaaccgtcgggttaccggtaccgttaccggtacccgtaccggttaaccgg

SEQ ID NO: 68397 - DNA, 589 bp, Homo sapiens
  misc_feature: GYAE6OF01DKDRS.51.76.G10.1.454.CMB.1.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgcccaccctctcctgcagggccagtcagagtgttagcagcgacttagcctggtaccagcaagaacctggccaggcctcccgaggcctcctcatctangatgcatccaacgaagggcccactgactactcccagcccgtaggttcaggtggactagggtcgggtcgtggggaacagtacgttccaacttcctacacctactacacgcgacgtcctcgactacgtcgtagtaagttatttagtacttaatttacttacgttagtactagtactaagttaataacttaacgtcgtaccttaccgttactacgtttcggaccggtacgggaccgaacggtcgtaggacgtacgtaacgaaacgtaacgtaggtacggtacgtcgtaccgtacgtacg

SEQ ID NO: 68398 - DNA, 615 bp, Homo sapiens
  misc_feature: GYAE6OF01B312P.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctacagttacggacccaggacggaaccatggaagccccagcgcagcttcctcttcctcctgctactctggccttcccagataccactggagaagtagtgatgacgcagtctccagccacctgtctgtgtctcgagggaangccacctctcctgcaggccagtcagagtgttagcagtcgacttagcctggtaccagtcaacgaaacctggaccaggtcctcccgaggcctcctcattctatgatgccagtccaagaacgggcccaacgtgtaactactaccccgaagccgtaggtttacaaggttcggacgtagggtcgggtcgtagggaacaggtacgttcaccgtctccaactatcagtcagcctgctagtctagtagttatttgacttaatttacttacgttgtactagtacgtaagttaataacgttaaccgtacggttacccttaccgtacttacgtttcggaccgtacgggtaacctaacggtcgtagggaacgtacgtaaccggtaaacgtacggttcggtacggtaccgtacgacccgtaacgtaccg

SEQ ID NO: 68399 - DNA, 554 bp, Homo sapiens
  misc_feature: GYAE6OF01DRNUC.51.76.G10.1.454.CMB.1.raw
  modified_base (514)..(514): a, c, t, g, unknown or other
  misc_feature (514)..(514): n is a, c, g, or t
  modified_base (550)..(550): a, c, t, g, unknown or other
  misc_feature (550)..(550): n is a, c, g, or t
tcagcgatcgtatacacgaccggtgctcgatttagtcactcatacagggggaggaactgctcagttaggacccagacggaaccatggaagccccagcgcaacttctcttcctcctgctactctggctcccagataccactggagaagtagtgatgacgcagtctccagccaccctgtctgtgtctccgaggggaaagacgccaccctctcctgcagggccagtcagagtgttagcagcgacttagcctggtaccagcagaacctggccaggctccagctcctcatctatgatgcatccaacgaacggccatgatactccagccaggttcaggtggcaggtcgggtcgtgggacaggtacgttcactctacacctatcacgcacgtcctcgactagtctaggtaagttattttacgtacttaaattttacttacttgtactagactaagttaataagtaacgtcggtaccttaccgttaacttacgtttcggaccgtagggaccaagcgtagganactacgaaacgtacgtcgtacggtctagacaccgtntacg

SEQ ID NO: 68400 - DNA, 535 bp, Homo sapiens
  misc_feature: GYAE6OF01C1I3S.51.76.G10.1.454.CMB.1.raw
  modified_base (280)..(280): a, c, t, g, unknown or other
  misc_feature (280)..(280): n is a, c, g, or t
  modified_base (529)..(529): a, c, t, g, unknown or other
  misc_feature (529)..(529): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagcccacctctcctgcagggccagtcagagtgttagcagcgacttagcctggtaccagcagaactggccaggctccaggctcctnatctatgatgcatccaacgagggccactgatactcccagccaggttcagtggcaggtcgggtctgggacaggtagttccacttccgtacaccatcagcacgcctgctagtctagaagttatttgactattttattactgtcagtctaagtaattaataacgtcgtaccttaccgttactaccgtttcggaccgtaacgggaccaagtcgtaggaagtactacgaaacgtacgtacggtagactcgaccncgtacg

SEQ ID NO: 68401 - DNA, 577 bp, Homo sapiens
  misc_feature: GYAE6OF01DAB8U.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctcncctgcagggccagtcagagtgtagcagcgacttagcctggtaccagcagaaacctggccaggcctcccaggctcctcatctatgatgcatccanaacgggccatgatacncccagccaggttcaggtgcaggtgggtctgggacagtacgttccactcgtaccaccatcagacacgcctgctagtctagtaagtatttgacttaatttattactgtacgagtactagttaataacgttaacgtcggtacccttaccgttacgttacgttttaccgggaccggtacggggtaccaacggtccgttagggaacgtaacgttaaccgtaaaacggtaacgttacgggtacggtccgtacgaccgtaccgtaacg

SEQ ID NO: 68402 - DNA, 701 bp, Homo sapiens
  misc_feature: GYAE6OF01CRA2M.51.76.G10.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (365)..(365): a, c, t, g, unknown or other
  misc_feature (365)..(365): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtcctgtcgtccacggaagggaagcncccacctctcngcgacggcagcgagagttgtagcgagacgtacgttacgccgtaggaccagacgaacgtaaccgcggaccgacggtcccaccgacggtcctcctactacttactagtagtagtcgactacgtaccgaacggtaacggacccagtagaactaccncccgaaggtaccgtacgggttacgaagggtcggacgttaggggtcggttagacgggaactaggttacttaccactccaaccgtacactacgacgacaccgtctagacgtacgttacgtaaggtaacgtttgtttactaactttaattttatacgttcgtacgaacgtattaaagttaacttaaacgttacgtaccggtaccctttaaccgttacgtttaccggtttccggaaccgggtaaacggggtaacctaacgggtaccggttaaggaaacgttaaccgtaaaaccgaaacggttacggtcgggttacgaccgttacgacccgttaacgtacg

SEQ ID NO: 68403 - DNA, 540 bp, Homo sapiens
  misc_feature: GYAE6OF01BC6OB.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgacttagcctggtaccagcagaacctggccaggctcccaggcctcctcatctatgatgcatccacgaacgggccactgatactcccagccaggttcaggtcggctaggtgggtctgggacagtagttcactctcaccatcagcagcctgcacgtctagaagtatttagacttaatttattactgtactagtctaagttataacttacgtcgtaccttaccgtacttacgtttcggaccgtacgggtacctaaggtcgtaggacgtactacgaaacgtacgtggtacggactcgccgtaccgtacg

SEQ ID NO: 68404 - DNA, 561 bp, Homo sapiens
  misc_feature: GYAE6OF01BLXP6.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtagcagcgacttagcctggtaccagcagaaacctggccaggcctcccaggcctcctcatctatgatgcatccacgaacgggccactgatactcccagccaggttcagtggcaggtcgggtctgggacaggtagttccactctacaccatcacgcacgcctgctagtctagaagtattttgacttaatttattacttgtacagtctaagttaataacgttaacgtcggtacccttaccgttaccttaccgttttcgggaccgtacggggtaccgtaacggtcgtaggacgtactaacgtaaacgtacgtaggtacggtacgtcgtcctacgtacg

SEQ ID NO: 68405 - DNA, 514 bp, Homo sapiens
  misc_feature: GYAE6OF01BL01L.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcagaacctggccaggctcccaggctcctcatctatgatgcatccacaagggccactgatactcccagccaggttcagtggcaggtgggtctgggacagtagttcactctcaccatcagcacgctgcgagtctagaagtatttagactaatttattactgtctagactagtataatactggtaccttacgtactacgtttggaccgtaggggacctagcgtaggagtacgtacaaacggtactgacggactcgcaccgtacg

SEQ ID NO: 68406 - DNA, 496 bp, Homo sapiens
  misc_feature: GYAE6OF01BFU5J.51.76.G10.1.454.CMB.1.raw
  modified_base (196)..(196): a, c, t, g, unknown or other
  misc_feature (196)..(196): n is a, c, g, or t
  modified_base (346)..(346): a, c, t, g, unknown or other
  misc_feature (346)..(346): n is a, c, g, or t
  modified_base (384)..(384): a, c, t, g, unknown or other
  misc_feature (384)..(384): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggctctcatctatgatgcatccacaagggccatgatactcccagccaggttcagtggcagtggtctgggacngagttcactctcacatcagcagcctgcagtctgaagtntttagcttaatttacttactgtcagctagtataatacgtgtcctcgtactacgtttcggaccgagggtaccagctaggagactacgaaacgactggtacgatcgcctcgtac

SEQ ID NO: 68407 - DNA, 539 bp, Homo sapiens
  misc_feature: GYAE6OF01C00TY.51.76.G10.1.454.CMB.1.raw
  modified_base (198)..(198): a, c, t, g, unknown or other
  misc_feature (198)..(198): n is a, c, g, or t
  modified_base (319)..(319): a, c, t, g, unknown or other
  misc_feature (319)..(319): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggggaaanacgccaccctctcctgcagggccagtcagagtgtagcagcgacttagcctggtaccagcagaacctggccaggcctccgaggcctcctcatctatgatgcatccacaagggccatgatacncccagccaggttcagtggcaggtgggtctgggacagtagttcactctacacatcagcagcctgctagtctaggtaagtatttgtactaatttattactgtacagtactaagttaataaagtacgttcggtacccttaccgttactacgtttcggaccgtacggggtaccaacggtcgtaggagtaactacgaaacgacgtacggtcggatcgcacgtacg

SEQ ID NO: 68408 - DNA, 688 bp, Homo sapiens
  misc_feature: GYAE6OF01BU0PM.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagttgatgacgcagtctccagccaccctgtctgtcgtcgtccgaggggaacacgcccacccttctcctgcgacgggccagtcgagtagtgtacgcagtcgtacttacgccgtaggtaaccaggacaacgtaaccgtcggcgtacgctcccaggcctcctcatctagtagactcgaccacgtccaacgtacgggcctacgtagactacgtcccgaggtccgtaggttcgaggtcggacgtaggtcgggtactacggactagtacgttccacgtcgtacaacctacgtacgacgctaacgtccgtagaccgtacgttacgtacgttaacgttacgtttttcgacctttaagtttacgtttaacgttcgttactaagtacttaacgttaacttaacgtaacgttcggttacccgttaccggtaccgttaaccgtttacgggtacccgtaaggggtaaccctaacgggtaccgttaagggaacggttacgtaaccggtaaaccgacggttcggtacggttaccgtacgtaccgtaccgttaccg

SEQ ID NO: 68409 - DNA, 509 bp, Homo sapiens
  misc_feature: GYAE6OF01BFB6L.51.76.G10.1.454.CMB.1.raw
  modified_base (195)..(195): a, c, t, g, unknown or other
  misc_feature (195)..(195): n is a, c, g, or t
  modified_base (478)..(478): a, c, t, g, unknown or other
  misc_feature (478)..(478): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggcctcccaggctcctcatctatgatgcatccacaagggccactgatatcccagccaggttcagtggcagtggtctgggacagagttcactctcaccatcagcagcctgcagtctaggaagtattttgactaatttatttactgtactagctagtataattacgtgtcctccgtacttacgtttggaccgtaggggaccaggtctaggagntacgaaacgtactggtacgactcgcacgtac

SEQ ID NO: 68410 - DNA, 552 bp, Homo sapiens
  misc_feature: GYAE6OF01EFJ0Y.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctcccaggctcctcatctaggatgcatccacaagggccactgatactccagccaggttcagtggcaggtgggtctgggacagtagttcactctcaccatcagcagcctgcagtctagaagtatttgacttaatttatactgtcagtctagtaataataacgtcggtaccttccgtactacgtttcggaccgtacggggtaccaaggtcgtacgggtaagtacgtaaccgaaaacggtaacgtagggtacggtacctacgggactaacccgtacgttaccg

SEQ ID NO: 68411 - DNA, 602 bp, Homo sapiens
  misc_feature: GYAE6OF01BSDDT.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagtagtgtagcagcgacttagcctggtaccagcaagaaccgtggaccaggcctcccgaggtcctcctcatctatgatcgactatacccaacgaacgggccaacgtgactactcccgagccgtaggttcaggtcggctagggtcgggtctaggggactaggtacgttccacttcctaccacctatccgagtccacgtcctgaccgtaggtcctaggtaagttgttttacgactttaaattttacgttaacttcgtacctaaggttactaagttaacttaacgttaccgtacggtcccttacgtacttacgtttcggaccggaagggtaccaggtcgtaggactacgtacgaaacgtacgtggtcgactcgacctcgtacg

SEQ ID NO: 68412 - DNA, 523 bp, Homo sapiens
  misc_feature: GYAE6OF01DFBRK.51.76.G10.1.454.CMB.1.raw
  modified_base (197)..(197): a, c, t, g, unknown or other
  misc_feature (197)..(197): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggctcccaggctcctcatctatgatgcatccacaacgggccactgatactcccagccaggttcagtggcagtgggtctgggacngtagtcactctcaccatcagcacgcctgcagtctgagtatttgctaatttattactgtcagctagtataatactggtaccttcgttactacgtttcggaccgtaggggaccaacggtcgtagggaagtacgtaccgaaacgtacgtaggtacggtctacgctaccgtacg

SEQ ID NO: 68413 - DNA, 504 bp, Homo sapiens
  misc_feature: GYAE6OF01A31LJ.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatactcccagccaggttcagtgcaggtgggtctgggacagacgttcactctcaccatcagcagcctgcagtctgaagtatttgactaatttattactgtcagctagtataataactcgtccttaccgttactacgtttcggccgacgggaccaagtcgtggagatacgaaacgactggtcgactcgcactacg

SEQ ID NO: 68414 - DNA, 516 bp, Homo sapiens
  misc_feature: GYAE6OF01AO9V1.51.76.G10.1.454.CMB.1.raw
  modified_base (197)..(197): a, c, t, g, unknown or other
  misc_feature (197)..(197): n is a, c, g, or t
  modified_base (356)..(356): a, c, t, g, unknown or other
  misc_feature (356)..(356): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgacttagcctggtaccagcagaacctggccaggctcccaggctcctcatctatgatgcatcccacgaacgggccactgatactcccagccaggttcaggtggcaggtgggtctgggacagngttcactctcaccatcagcacgcctgcagtctagaagtatttgactaatttacttactgtacagtctaagttataataacgtgtcctaccgtactacgtttcggccgtagggaccaggtcgtaggagactacgaaacgacgtcggtacggctcgcactac

SEQ ID NO: 68415 - DNA, 492 bp, Homo sapiens
  misc_feature: GYAE6OF01DYS6U.51.76.G10.1.454.CMB.1.raw
  modified_base (195)..(195): a, c, t, g, unknown or other
  misc_feature (195)..(195): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctagagtattttgctaatttattactgtcagtcagtataataactggccttacgtactacgtttggacctagggaccaagctaggagatacaaacgactgnggntgcactac

SEQ ID NO: 68416 - DNA, 532 bp, Homo sapiens
  misc_feature: GYAE6OF01EUVO2.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctagaagtattttagctaatttattactgtcagctaagtataagttaactggtaccttccgttactacgtttcggaccgtaaggggaaccctaaggtcgttagggaagtacgtaccaaaacgtaacttcggtaggtactcgccaccgtacg

SEQ ID NO: 68417 - DNA, 587 bp, Homo sapiens
  misc_feature: GYAE6OF01A9B2D.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgttagcagcgacttagcctggtaccagcagaacctggccaggcctcccaggcctcctcatctatgatgcatccacgagggccactgatactcccagccaggttcaggtggctaggtgggtctggggactaggtagtttcacttcctacacctatcacgcacgtcctgcagtcgtagaagtagtttagacttaatttacttactgtactagtcgtaagttaataagtaaccgtcggtaccctaccgttacttacgttttcgggaccgtacggggtaaccctaacggtcgttagggaacgtacgtaaccgtaaaacggtaacgttacggttacgggacgttacgtacccgtaaccgtacg

SEQ ID NO: 68418 - DNA, 556 bp, Homo sapiens
  misc_feature: GYAE6OF01BDB09.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgccaccctctcctgcagggccagtcagagtgttagcagcgacttagcctggtaccagcagaacctggccaggctcccgaggcctcctcatctatgatgcatccacgaacgggccacgtgactactcccgagccaggttcagtggcaggtgggtctgggacagtacgttcactctcaccatcagcagcctgcagtctagtagttatttgactaattttattactcgtctagtactaagtaataaacgtaacgtcggtcccttaccgttactacgttttcggaccggacggggtaccaaggtcgtaggacgtaactaccgaaaacgtacgttacggtaggtacctcgtaccgacctacg

SEQ ID NO: 68419 - DNA, 574 bp, Homo sapiens
  misc_feature: GYAE6OF01A21UH.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgcccaccctctcctgcagggccagtcagagtgttagcagcgacttagcctggtaccagcaagaaacctggccaggctcccgaggcctcctcatctatgatgcactccacaacgggccactgactactcccagccgaggttcaggtggctaggtgggtctggggactaggagttccacttcctaccacctatcacgcacgcctgcagtctagtaagttatttagacttaatttacttacttgtactagtactaagttaataacgtaacgtcggtacccttaccgtacttacgtttcggaccgtacgggaccgtaaggtcgtaggaacgtacgtaaccgaaacggtacgtaggtacggtacgtcgaccgtacgtacg

SEQ ID NO: 68420 - DNA, 508 bp, Homo sapiens
  misc_feature: GYAE6OF01DQQ7L.51.76.G10.1.454.CMB.1.raw
  modified_base (197)..(197): a, c, t, g, unknown or other
  misc_feature (197)..(197): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggctccagctcctcatctatgatgcatccacaagggccactgactactcccagccaggttcaggtcggcaggtggtctgggacngtagttcactctacacatcagcagctgcagtctgagtatttgtactatttattactgtcagactagtaataatactcgtccttacgtactacgtttcgaccgtacgggacaacgcgtaggagtactacgaaacgaacgtcgtagactcgcactac

SEQ ID NO: 68421 - DNA, 598 bp, Homo sapiens
  misc_feature: GYAE6OF01BXNBS.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgtacttagcctggtaccagcaagaaacctggccaggcctcccaggctcctcatctatgatgcactccaacgaaacgggccactagactactccccagccctaaggttcaggtcggctagtttcggggtctaggggacaggtacgtttcaacttctacaccatcagcacgcctgcagtcgtgtaagtattttgacttaagtttacttactgttacacgtactaagttaacttaacgtaacgttcggtacccttaccgttactaccgttttacggacccggtaacgggaaccgtaaacggtcgtaaggaacgtaacgtaacgaaaaccgtacgttacggtacggaccgtcgaccgtacgtaacg

SEQ ID NO: 68422 - DNA, 516 bp, Homo sapiens
  misc_feature: GYAE6OF01D3DW3.51.76.G10.1.454.CMB.1.raw
  modified_base (195)..(195): a, c, t, g, unknown or other
  misc_feature (195)..(195): n is a, c, g, or t
  modified_base (314)..(314): a, c, t, g, unknown or other
  misc_feature (314)..(314): n is a, c, g, or t
  modified_base (389)..(389): a, c, t, g, unknown or other
  misc_feature (389)..(389): n is a, c, g, or t
  modified_base (512)..(512): a, c, t, g, unknown or other
  misc_feature (512)..(512): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaaggccactgatancccagccaggttcagtggcaggtggtctgggacagagttcacgtctacacatcagcagcctgcagtctagaagtnttttagctaattttatacttgtccagctagttaataattaactggtccttaccgtacttacgtttcggaccgaggggacctaaggtcgtaggagtatacaaacgaacgtgtacggctcggccnctac

SEQ ID NO: 68423 - DNA, 542 bp, Homo sapiens
  misc_feature: GYAE6OF01AVQ5N.51.76.G10.1.454.CMB.1.raw
  modified_base (197)..(197): a, c, t, g, unknown or other
  misc_feature (197)..(197): n is a, c, g, or t
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggctcccaggcctcctcatctatgatgcatccacaacgggccactgatactcccacgccaggttccaggtcggcgtaggtggggtctggggacagtaggttcacttctcacctatcagcacgcctgctagtctagaagtattttgactaatttatactgtctagctaagtataagtaactcgtacctccgtactacttcggaccgtaaacgggacacggtacgtaggaacgtaacgttaaacggacttcggtacgtcgtanactacctnttccg

SEQ ID NO: 68424 - DNA, 550 bp, Homo sapiens
  misc_feature: GYAE6OF01AI63A.51.76.G10.1.454.CMB.1.raw
  modified_base (197)..(197): a, c, t, g, unknown or other
  misc_feature (197)..(197): n is a, c, g, or t
  modified_base (541)..(541): a, c, t, g, unknown or other
  misc_feature (541)..(541): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccagcaagaacctggccaggcctcccgaggctcctcatctatgatcgcactccacgaacgggccagtgatactcccagcctaggttcaggtcggcgtaggtcgggtctggggactaggtacgtttccacgtctaccacctatcgacgcgacgcctgcgtagtacgtagtaagttagtttacgtacttaatttacttactgtacagtactagtaactaatacgtcgtaccttacgtactacgtttcgcgtacggactagtcgtaggagtacgtacgaacgacgtcgtgancgctctacg

SEQ ID NO: 68425 - DNA, 499 bp, Homo sapiens
  misc_feature: GYAE6OF01ESBJN.51.76.G10.1.454.CMB.1.raw
  modified_base (351)..(351): a, c, t, g, unknown or other
  misc_feature (351)..(351): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagngttcactctcaccatcagcagcctgcagtctgaagtattttgacttaatttattacttgtcagcagtataataactggtcctcgtactcgtttggccgtaggggacctaaggcgtaggagatacaaacgactggtacgctgcactacg

SEQ ID NO: 68426 - DNA, 692 bp, Homo sapiens
  misc_feature: GYAE6OF01CTFQX.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagccacctctcctgcagggccagtcagagtgtagcagcgacttagcctggtaccagcagaaactggaccaggcctcccgaggcctcctcatctatgatcgacactccaacgaacgggccactagactactaccccgagccctaaggttcaaggttcggacgtagggttcgggtacgtaggggaacctaggtacggtttccaactttcctaccaaccctattaccgaacggccgtaagtcccgtaggacctaaggttccgtaggtaaacgtttgttttagaccttaaatttttaacttaccgttagtaccaagtacctaaggttaacttaaagttaaccgttagggttacccctttaaccggttacctttaaccggttttaccgggaacccggtaacgggggtaaaccctaaggtaccggttaagggaacgtaacgttaaacccggaaaacggttacgttagggtacgggtacttacggtaccaaccgtttaccg

SEQ ID NO: 68427 - DNA, 537 bp, Homo sapiens
  misc_feature: GYAE6OF01BJA9L.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggctcccaggctcctcatctatgatgcatccacaagggccatgatactcccagccaggttcagtgcaggtgggtctgggacagtagttcactctcaccatcagcacgcctgcagtctagaagtatttgacttaatttattacttgtctagctagttaataattaacgtcggtaccttaccgtactacgttttcggaccgtacggggaaccaacggtcgtaggagtacgtaaccgtaaacgtaactaggtaggactcgcctaccgtacg

SEQ ID NO: 68428 - DNA, 544 bp, Homo sapiens
  misc_feature: GYAE6OF01CFKLR.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcagaaacctggccaggcctcccaggcctcctcatctatgatgcatccacaagggccactgatatcccagccaggttcagtggcaggtgggtctgggacagtagttcactctacaccatcagccagcctgcagtctagaagtattttgacttaattttattactgtacagctaagttataataacgtcggtacccttccgtactacgtttcgggaccgtaggggtaccaaggtcgtagggacgtacgtaaccgtaaacggtaacgttggtacggactacgcgtacccgtacg

SEQ ID NO: 68429 - DNA, 523 bp, Homo sapiens
  misc_feature: GYAE6OF01AGH7I.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgtagcagcgacttagcctggtaccagcaagaaacctggccaggcctcccaggcctcctcatctatggtgcatccacagggccacgtggcactccccagcctaggttcaggtggcaggtgggtctgggacagaccttcgctctcacatcagcacgcctagacgcctagaagtatttgactagtttatattgtcagcagacgaaacacgtggtaccttccgttggtacgttcggaccgaagggaccaagggtagaaagtcgaaacgtacgtggtacggctcgacacatctgtctaccg

SEQ ID NO: 68430 - DNA, 646 bp, Homo sapiens
  misc_feature: GYAE6OF01ANUED.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcaggggccagtcagagtgttagcagcgacttagcctggtaccagcagaacctggccaggctcccaggctcctcactctatgatgcactccaacgaacgggccacgtgaactactcccgagtccaggttcaggttcggctacggtgggtcctagggacgaggtagtttccaacgttcctaccgacctactccgagtccgacgcccttagacctacggtcttaggaacgttattttcggaactttaagttttatttacttacgttactacgtactaacggttaattaaacgttaaccggttcgtaccccgttaccggttaaccgttaaccggttttccgggaccggtaacggggtaacccaaggtaccgtagggtaacgtaccgtaaccgtaaaaccggtacgttcggtacggtacgtacgaccgtacccttacg

SEQ ID NO: 68431 - DNA, 534 bp, Homo sapiens
  misc_feature: GYAE6OF01BSSPQ.51.76.G10.1.454.CMB.1.raw
  modified_base (196)..(196): a, c, t, g, unknown or other
  misc_feature (196)..(196): n is a, c, g, or t
  modified_base (529)..(529): a, c, t, g, unknown or other
  misc_feature (529)..(529): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcagaacctggccaggctcccaggcctcctcatctatgatgcatccaacgaagggccactgatactcccagccaggttcagtggcaggtgggtctgggacaggtagttccacttctcaccatcagcacgcctgcagtctagtaagtattttcgacttaatttattactgtactagctaagtaataatacgtcggtcccttaccgtactacgtttcggaccgtacggggaccaaggtcgtaggagtactacgaaacgacgtggtacggactcgccncgtac

SEQ ID NO: 68432 - DNA, 607 bp, Homo sapiens
  misc_feature: GYAE6OF01C5DBU.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaanacgcccaccctctcctgcagggccagtcagagtgttagcagcgacttagcctggtaccagcagaacctggccaggctcccgaggcctcctcatctatcgatgcatccaacgaacgggccaactgactacgtcccagcctaaggttcaggtggctaggtcgggtctggggaacaggtacgttccactccgtacacctacgtacacgccgacgtccgtagacgtacgtcgtagtaagttagttttacgactttaattttacttacgttagttacctagtaactaagttaactaaacgttacgtacggtacccttaccgttaccttacgttttcggaccgtaacgggtaccaaggtcgtaggacgtacgtaaccgaaacgtacgtacgtacggacgtcgaccgtacgtacg

SEQ ID NO: 68433 - DNA, 514 bp, Homo sapiens
  misc_feature: GYAE6OF01AV4R5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctctcatctatgatgcatccaacgaagggccactgatactcccagccaggttcagttggcaggtgggtctggggacaggagttcactctcaccatcagcagcctgcagtctgacgtatttcgataatttattactgtctagctaagtataataacgtgtacccttcgtactcgtttggaccgtacgggaccagtcgtaggagtacaccgaaagacgtgtacggctgcctcgtacg

SEQ ID NO: 68434 - DNA, 660 bp, Homo sapiens
  misc_feature: GYAE6OF01DE93W.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaagggggaaanacgcccaccctctcctgcagggccagtcagagtgtagcagcgacttagcctggtaccagcaagaacctggccaggctcccgaggcctcctcatctatgatgcatccaacgaacgggccaacgtgaactactaccccaggccgtaaggtttccgaaggtcggaccgtagggttggggtccgtaggggaacgtaggtacgttacaccgtttaccaccgaaccctataccgacgtaccgaacggtccgttcgaccgtacggttacgtaacggtaaacgtttatttttcggaacttttaaagttttaacttacgttagtactaggtactaagttaaagtaaccgttaacgtcggtacccttaccgttaccgtaccggttttacggacccggaacggggtaaccgtaacggtcgtagggaacgtacgtaaccgaaacgtacgtgtacggtacttcgctacgttacg

SEQ ID NO: 68435 - DNA, 571 bp, Homo sapiens
  misc_feature: GYAE6OF01EECM4.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacgaacgggccactgacttactccccagccaggttcaggtggcaggtgggtctgggacagagtttcacgttctcaccatcagccacgcctgcagtctagtaagtattttgcttaatttattacttgttacagtactagttaacttaagttaacgttcggtacccttacccggttacttaccgttttacggaccgtacgggggaacctaaggtccgtagggacgtaacgtaacgtaaaacgaacgttaggtacggtactcggaccgtaccgtacg

SEQ ID NO: 68436 - DNA, 508 bp, Homo sapiens
  misc_feature: GYAE6OF01CPDCX.51.76.G10.1.454.CMB.1.raw
  modified_base (197)..(197): a, c, t, g, unknown or other
  misc_feature (197)..(197): n is a, c, g, or t
  modified_base (362)..(362): a, c, t, g, unknown or other
  misc_feature (362)..(362): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgacttagcctggtaccagcagaacctggccaggctcccaggctcctcatctatgatgcatccacaagggccactgatactcccagccaggttcaggtggcagtgggtctgggacagagttcactcncacatcagcagcctgcagtctgaagtattttgactaatttattactgtcagtctaagtataatactcgtacctccgtactacgtttcggccgagggaccaaggtcgtaggagtatacgaaacgacgtcgtaggatcgctacgtacg

SEQ ID NO: 68437 - DNA, 584 bp, Homo sapiens
  misc_feature: GYAE6OF01B1JPM.51.76.G10.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
tcagcgatcgtatacacgaccggtgctcgatttagtcactcatacagggggaggtaactgctcagttaggacccagaccggaaccataggaagccccagcgcagcttcttcttcctcctgctactctggctcccagagtaccactggagaagtagtgatgacgcaggtcctccagccaccctgtctgtcgtctccaggggaaanacgccaccctntcctgcagggccagtcagtagtgttagcagcgacttagcctggtaccagccgaagaacctggccaggctcccgaggctcctcatctatgatgcatccanacggccatcgatacnccagccaggttcagttggctaggtggtctgggaactagactttcaccttctactaccactcacgcgacgcccgtcgaccgacgtccttagtaacgttagttttacgacttaatttacgttactagtacagtactaagttaacttaagtaacttcgtaccttaccgttactacgtttcggaccgtacgggtaccaacgtcgtaggacgtacgtacgtaaaccgacgtacggtacggacctcgtccgtaccgtaccg

SEQ ID NO: 68438 - DNA, 574 bp, Homo sapiens
  misc_feature: GYAE6OF01ARP26.51.76.G10.1.454.CMB.1.raw
  modified_base (196)..(196): a, c, t, g, unknown or other
  misc_feature (196)..(196): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacacgggccatgatatcccagccaggttcagtggctagtgggtctgggacagtagttcactcctacacanacgacgacncgcncgacgtacgtatagtagttagttagtactttaatttacttactcgtacgacgtagtaagttaacgtaacgttacgtaccgttacccgttacccgttacgttaccgtttaccggacccggtaacgggtaccgtaggtcggtagaacgtactaaccgaaacgttacgtggtacggtacgtacgaccctcgttacg

SEQ ID NO: 68439 - DNA, 551 bp, Homo sapiens
  misc_feature: GYAE6OF01A74WF.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcaagaaacctggccaggcctcccaggcctcctcatctatgatgccatccaacgaacgggccactagactactcccagccgtaggttcaggtggcgtaggtgggtctgggacagagttcactctcactatcagcacgcctgcagtctagaagtatttgactaatttattactgtacagactaagttataataacgtcggtaccttccgtaaccttacgtttcggaccgtaacggggaccctaacggtcgtaggagtaactaacgaaaacgtacgtggacggtactacgccgtaccgtacg

SEQ ID NO: 68440 - DNA, 575 bp, Homo sapiens
  misc_feature: GYAE6OF01C880N.51.76.G10.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (412)..(412): a, c, t, g, unknown or other
  misc_feature (412)..(412): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccacctctcctgcagggccagtcagngtgtagcagcgacttagcctggtaccagcagaaacctggccaggctcccaggcctcctcatctatcgatgcatccaacgaacgggccacgtgactactcccagcctaggttcaggtgggctagggtcgggtcgtgggacagtagttcactccgtacaccatcagacagcctgctagtctagaagtnttttagacttaattttacttacttgtactagtactaagttataaattacgtcgggtaccttaccgtacgttacgtttcggaccggtaacggggtacccaaggtcgtagggaagtacgtaaccgtaaaacgtacgtaggtacggacttacggcctaaccgtacg

SEQ ID NO: 68441 - DNA, 544 bp, Homo sapiens
  misc_feature: GYAE6OF01E3PDV.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctccaggctcctcatctatgatgcatccacaagggccactgatactcccagccaggttcagtggctaggtgggtctgggactaggtagttcactctacaccatcagcagcctgcagtctagaagtatttgactaattttacttactgtacagtctaagtaattaataactcggtaccttaccgtactacgtttcggaccgtacggggaaccctaaggtccgtagggaacgtacgtaacgaaacgtaacgtacggtacggactcgcctaccgtacg

SEQ ID NO: 68442 - DNA, 643 bp, Homo sapiens
  misc_feature: GYAE6OF01AD7G4.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcagaacctggccaggcctcccgaggcctcctcatctatgatgcactccaacgaacgggcccactgactactcccagccaggttcaggtggcgtaggtgggtcgtgggacagtacgttcacgtctccaaccactcacgcacgtccgtgcgtacgtcgtagtaagttagttttagtaccttaattttactttacgttgttacgtagtaccgttaagttaacttaaacgttaccgtacggttaccccgttaccggtttaaccgttaaccggtttttaccgggacccggtaaccgggggtaaaccctaacgggttccgtagggtaacggtaacgtaaccgtaaaacggtaaccggttacggttacggtaccgtcggtaccctaaccgtaccg

SEQ ID NO: 68443 - DNA, 551 bp, Homo sapiens
  misc_feature: GYAE6OF01DBSNI.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcaggtgggtctggggacagtagttcactcgtacaccatcagcagcctgctagtctagaagtatttgacttaatttattactgtcagtctagttaataattaacgtcggtacccttaccgtacttacggttttcggaccgtaacgggggtaccaaggtccgtagggaacgtacgtaaccgaaaacgtacgtcggtacggctacggcctaaccttacg

SEQ ID NO: 68444 - DNA, 578 bp, Homo sapiens
  misc_feature: GYAE6OF01A47QX.51.76.G10.1.454.CMB.1.raw
  modified_base (197)..(197): a, c, t, g, unknown or other
  misc_feature (197)..(197): n is a, c, g, or t
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcagggccagtcagagtgttagcagcgacttagcctggtaccagcaagaaacctggccaggctcccaggcctcctcatctatgatgcatccacgaagggccatgatacncccagccaggttcagtgcaggtgggtntagggacagacgttcactctcaccatcacgcacgcctgcagtctagaagtattttgacttaaagttttattacgtgtacgagtactaagttaagtaaacttaacgtcggtaccttaccggttaacttacgtttcggaccgtaacggggtaaccgaacgtcggtaggaacgtaacgtaaaccgaaaaccgtaacgttacggtacggtacctacgtacccaaccgttaacg

SEQ ID NO: 68445 - DNA, 694 bp, Homo sapiens
  misc_feature: GYAE6OF01CN94D.51.76.G10.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (280)..(280): a, c, t, g, unknown or other
  misc_feature (280)..(280): n is a, c, g, or t
tcagcgatcgtatacacgaccggtgctcgatttagtcactcatacagggggaggaacctgctcagttaggacccagacggaaccatggaagccccagcgcagcttctcttcctcctgctactctggctcccagataccactggagaagtagtgatgacgcagtctccagccacctgtctgtcgtctccgaggggaaancgccacctntcctgcagggccagtcagagtgtagcagcgacttgcctggtaccagcagaacctggccaggctccagctcctnatcatgatgcatccagaacggccacgtgactactcccagtccgaggttcaggtcggactaggtcggtactggggacaggtacgttcgacgttctaccgacctagtccgaacgtccgtacgtcccgttagccgttacggttacgtaggtaacggttactttttacggaactttaacgtttttacgtttaccgttcggttaaccgtaaggttaccgttaacggttaacgtttaaaccgttaaccggtttaccggggtacccctttacccggttaacgtttaacccgggttttccgggaaccgtaaaccgggggttaacctaaacgggtccgttaaggggttaacgtaacgttaaacccggtaaacggttaaccgttcgggttacggtaacccgttcgaccgttaacccgttaaccg

SEQ ID NO: 68446 - DNA, 533 bp, Homo sapiens
  misc_feature: GYAE6OF01BHPFU.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctctcctgcagggccagtcagagtgttagcagcgacttagcctggtaccagcagaacctggccaggctcccgaggctcctcatctatgatgcatccagaagggccatgatactcccagccaggttcagtggcaggtgggtctgggacagagttcactctacaccatcagcacgcctgctagtctagaagtatttgacttaatttattacttgtcagctaagttaataacttaacgtcggtaccttaccgtactacgtttcggaccgtacggggtaacctaaggcgtaggacgtacgtacgaaacgtacgtggtacgactcgctacgtacg

SEQ ID NO: 68447 - DNA, 554 bp, Homo sapiens
  misc_feature: GYAE6OF01B4DJH.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccagggggaaanagccaccctctcctgcagggccagtcagagtgtagcagcgacttagcctggtaccagcagaaacctggccaggcctcccaggcctcctcatctatgatgcatccagaagggccactgactactcccagcctaggttcagtggctaggtgggtctgggacagtagttcacttctcaccatcagcacgcctgctagtctagtaagtattttgacttaatttattacttgtacagtctagttaataagttaacgtcggtacccttaccgttacttacgtttcggaccggtacgggtaaccgtaaggtcgtagggaacgtacgtaacgaaacgtaacgtggtacggtactcgtccacgtacg

SEQ ID NO: 68448 - DNA, 667 bp, Homo sapiens
  misc_feature: GYAE6OF01B2M8P.51.76.G10.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaanagccacctctcctgcagggccagtcagagtgtagcagcgacttagcctggtaccagcagaacctggcacggctcccgaggctcctnatctatgatgcactccaacgaacgggccactgtaactactcccgaagtccgtaggtttccaagggttcggaccgtagggttcggggtaccgtaggggaactaggtacgttacctaacgtctaccaacctataccgagccgtaacgtcccgttggacctaggttaccgttaaggtaaagttacgtttttacgaactttaaatttttactacgtttacggtactacggtacttaaggttaacttaaacgttaaccgttaccggtaccctttaccggtacttaaccggttttcgggaccgtaacggggacctaaagggtcgttaacgggaacgtaacgtaaccgtaaaccggtacgttacgggtacgaccttacggacctacgttacg

SEQ ID NO: 68449 - DNA, 510 bp, Homo sapiens
  misc_feature: GYAE6OF01CGPM5.51.76.G10.1.454.CMB.1.raw
  modified_base (195)..(195): a, c, t, g, unknown or other
  misc_feature (195)..(195): n is a, c, g, or t
  modified_base (319)..(319): a, c, t, g, unknown or other
  misc_feature (319)..(319): n is a, c, g, or t
  modified_base (503)..(503): a, c, t, g, unknown or other
  misc_feature (503)..(503): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgtagcagcgacttagcctggtaccagacaagaaacctggccaggcctacccgaggcctcctcatctatgatgcatccagaaggccatgatacncccagccaggttcagtggctaggtgggtctgggacagtacgtcaactctacacatcagcacgcctgcagtactgtaatattttcgacttaatttattactgtacagtctaagtataatactcgtcctacgtactactttgaccgagggactagcgtaggatactacgaaacgacgtgagctacnctctacg

SEQ ID NO: 68450 - DNA, 659 bp, Homo sapiens
  misc_feature: GYAE6OF01CYYQ0.51.76.G10.1.454.CMB.1.raw
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaanacgccacctctcctgcagggccagtcagagtgtagcagcgacttagcctaggtaccagcaagaaacctggaccaggctcccaggctcctnatctaangatgcactccaacgaacgggccactgaactactcccagacctaggttccaagggtcggcgtagggtcgggtcgtaggggactagtacggttacaccttcgtaccaactactacagtaccgacgtcccgtgactacgtctaaggtaattgttttacgtacttaattttacttacgttagtcctaagttaccaaggtttaaactaacgttaaacgtccggttacccgttaccgttaaccgttacggttttacgggaaccccggtaaggggtaaccgaacggtaccggtaaggtacggtaaacgttaaccgaaaaaccgggtaacgtttcgggtaacggtaccgttacggtacccgaaccgtttaaccg

SEQ ID NO: 68451 - DNA, 582 bp, Homo sapiens
  misc_feature: GYAE6OF01D29YT.51.76.G10.1.454.CMB.1.raw
  modified_base (198)..(198): a, c, t, g, unknown or other
  misc_feature (198)..(198): n is a, c, g, or t
  modified_base (321)..(321): a, c, t, g, unknown or other
  misc_feature (321)..(321): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgttagcagcgacttagcctggtaccagcagaacctggccaggctcccgaggcctcctcatctatgatcgcactccagacgggccaatgatacncccagccaggttcagtggcaggtgggtctgggactagtacgttcactctcacatcagcngcctgcgtagtcgtagtaagttatttagacttaagttttattacgttatacgtagtactaagttaataacgtaacgttcggtacccttaccgttaccttacgttttaccggaccgtacggggtaaccgtaacggtaccgttaggtaacgtacgtaaccgaaacggtaacgtacggtacggtactacggtcctaaccgttacg

SEQ ID NO: 68452 - DNA, 546 bp, Homo sapiens
  misc_feature: GYAE6OF01D4MIX.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcaggtgggtctgggacagagttcactctcaccatcagcagcctgcagtctagaagtattttgacttaatttatttacttgtacagactagttaataattaaccttggtacccttaccgttacttacgttttcggacccgtaggggaccctaagtcgtagggagtacgtaaccgaaacgtaacgttggtacggaccttcgccgtacctacg

SEQ ID NO: 68453 - DNA, 602 bp, Homo sapiens
  misc_feature: GYAE6OF01ALOZ4.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagagcccaccctctcctgcagggccagtcagagtgtagcagcgacttagcctggtaccagcaagaacctggccaggcctcccgaggcctcctcatctatgatgcatcccaacgaacgggccactgactactcccagtccgtaggttcaggtgggcgtagggtcgggtcgtggggacaggtacgttccacctctaccacctactcacgcgacgtcctgactagtctagtaagtattttagtacttaatttattacttgtacgagtactaagttaataacgttacgtacggtacccgttaccgttacgttaccgtttcgggaccggtaacggggaaccgtaacggtcgtagggtacgtaacgtaaccgtaaacgtacgtacggtacggtacgtcgtccgtaccgtacg

SEQ ID NO: 68454 - DNA, 635 bp, Homo sapiens
  misc_feature: GYAE6OF01AUIWX.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctccaggcctcctcatctatgactcgactactaccgaacggaccgggacctacgtacgtaacttacctacccgaccgtaccgttacggttacgagggtcggacgtaggggtcgggttcggtacgggacgtaggtacgttacctacttccaccaactacgtacgacgtcgacgtcgtcgacgtacgtacgtaagtaagtttacgtttacgtaactttaatttacttacgttacgtacgacgtacgtaagttaacttaacgttacgtccgttaccttaccgttacttacggttcggacggtacggtaaccgacgtcggtaggacgtaccgaacgtaacgtacgtacggtcgtacgtccgactacgtacg

SEQ ID NO: 68455 - DNA, 513 bp, Homo sapiens
  misc_feature: GYAE6OF01BLLYK.51.76.G10.1.454.CMB.1.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccacctctcctgcagggccagtcagagtgtagcagcgacttagcctggtacagcagaacctggccaggcctccaggcctccncatcctatgatcgcactccacgaaggccatgatactccagcctaggttcagtgcaggtgggtcagggacagtacgttcactcctcaccatcagcacgcctgcagtctagtaagtatttagctaattttatactgtacagtcaagttataataacgtgtacccttcgtactagttcggaccgtagggaacctagtcgtaggactacgtacgaaagtactggacgatcgcacgta

SEQ ID NO: 68456 - DNA, 653 bp, Homo sapiens
  misc_feature: GYAE6OF01B9T77.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcagggccagtcagagtgttagcagcgacttagcctggtaccagcaagaactggccaggcctcccgaggcctcctcatctatgatcgcatccaacgaaacgggcccaacgtgaatacctccccgagcccgtaaggttccaagggttcgggaccgtagggttcggggtcgtaggggaacaggtacgtttccaactcgtaccaacctataccgagccgtaacgtccgtgaccgtacgttacgtaggtaagttacttttagacctttaagttttacttacgtgtaacctaggtactaagttaacttaaacgtaaccgttcggtacccttacccggttaacttccggttttacggaccgtaaacggggtaaccctaaaggtccgtaagggaagttaacgtaaccgaaaacgttacgtggtacggtactacgtacccgacgttacg

SEQ ID NO: 68457 - DNA, 541 bp, Homo sapiens
  misc_feature: GYAE6OF01EWE3D.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcaagaaacctggccaggctcccaggcctcctcatctatgatgcatccagaagggccatgatactcccagccaggttcagtggcaggtggtctgggacagagttcactcacacatcagcacgcctgcagtctagaagtatttagacttaatttattactgtacagtactagttaataagtaactcggtacctaccgttactacgtttcggaccgtaggggtaacctaaggtccgtagggaagtacgtaacgaaaacgtaacgtggtacggacttcgacctacgtacg

SEQ ID NO: 68458 - DNA, 516 bp, Homo sapiens
  misc_feature: GYAE6OF01BQOJT.51.76.G10.1.454.CMB.1.raw
  modified_base (510)..(510): a, c, t, g, unknown or other
  misc_feature (510)..(510): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagcccaccctctcctgcaggggccagtcagagtgttagcagcgacttagcctggtaccagcagaacctggccaggcctcccaggctcctcatctatgatgcatccacgaagggccactgatactcccagcctaggttcagtggctagtgggtctgggacagagttcactctcaccatcagcacgcctgcagtctagatatttgactaatttattactgtcagctaagtaataatacgtcggtcctaccgtactacgtttggaccgagggacctaagtcgtaggacgtagtacgaacgtaacgtgtagactcgcncgtacg

SEQ ID NO: 68459 - DNA, 683 bp, Homo sapiens
  misc_feature: GYAE6OF01DJ6QV.51.76.G10.1.454.CMB.1.raw
  modified_base (195)..(195): a, c, t, g, unknown or other
  misc_feature (195)..(195): n is a, c, g, or t
  modified_base (637)..(637): a, c, t, g, unknown or other
  misc_feature (637)..(637): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanacgccaccctctcctgcagggccagtcagagtgttacgcagcgtacttacgcctacggtaccagacaacgaaacctggccaggcctcccgaggtcctcctactatctatgaatcgaactaccgtaccgaacggaccgtacctacgtacgtacttacccgtaccgaccggaccggttaacggttacgtagggtacggtacggttacgggttcgggttacggtaacggaacgtaacggttaaccgttccgtaaccttccctaaccgaacccgttacgtaccgtacggaccgtaccgtccgtagtaacgttacgttacgttaagtaacgtttttgtttaaccttaagtttaacttttacgtacgttacgtactaacgtaactaacgttaacttaacgtaacgtccttacgtaccttacggttacgtacggacgtacggaactcgngtaagactacgtaaacgtaacgtcgtacgactatccgactcttacg

SEQ ID NO: 68460 - DNA, 702 bp, Homo sapiens
  misc_feature: GYAE6OF01D7IMX.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccacgtggaagaagtagtgatgacgcagtcctaccacgcccacctgtctgtgtcctaccggaaggggaaagacgcccaccctctccgtgcgacgggccagtcgagtagttgtacgcagcgtacttacgccgtacggtaaccagaccgaacgaaaccgtcggaccgacggcctacccgacggccttccctctacttactagtgtatcgactactaccgaacggaacgggcccagtagtaactacctacccgacgaccgtaggttccgaggtcgggacgtagggttcgggttcggtacggggaacaggtacgttaccgtaccttcctaccaacctagtaccgacgaccgtacgtcccgtgaccgtaggttctaggtaagtttagttttacgaactttaattttacttacgttacgtacgtaagtacgtaagttaattaaacgttacggtaccggttcccttaaccggttactttaccggttccgggaccggtaaccggggtaacaacggttcggtaggaacgtacaaaccggtaaacgtacgtggtacgaccgtacgacctacgttacg

SEQ ID NO: 68461 - DNA, 586 bp, Homo sapiens
  misc_feature: GYAE6OF01EQDZV.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcaagaacctggccaggctcccaggcctcctcatctatgatgcatccacgaagggccatgactactcccgagccaaggttccaggtggctaggtcggtcgtgggacaggtcgttcactctacaccatcagcagcctgcagtctagtaagtagttttagacttaatttattacgttgtacgtagtactaagttaacttaagtaaccgttcgtacccgttaccgttaccgttacgttttaccgggaccgtaacggggaaccctaagggtcgtagggacgtaacgtaaccgtaaaaccggtacgttacggtacggactcgtacctaaccgtacg

SEQ ID NO: 68462 - DNA, 550 bp, Homo sapiens
  misc_feature: GYAE6OF01DE1Y4.51.76.G10.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccaccctgtctgtgtctccgaggggaanagccaccctctcctgcagggccagtcagngtgtagcagcgattagcctggtaccagcagaacctggccaggctcccaggctcctnatctatgatgcatccacaagggccactgatacncccagccaggttcagtggctaggtgggtctgggacagtagttcactcaccaccatcagacagtcctgcagtctagtagtatttgactaatttatttactgtctagtctaagttaataattaacgtcgtaccttaccgttacttaccgttttacggaccgtacggggtaccaacggtcgtagggaggtaacgtaacccgtaaaacggtacgtacgtacgggtactagccgtacctacg

SEQ ID NO: 68463 - DNA, 509 bp, Homo sapiens
  misc_feature: GYAE6OF01DTZYX.51.76.G10.1.454.CMB.1.raw
  modified_base (301)..(301): a, c, t, g, unknown or other
  misc_feature (301)..(301): n is a, c, g, or t
  modified_base (496)..(496): a, c, t, g, unknown or other
  misc_feature (496)..(496): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccanaagggccatgatactcccagccaggtttcagtggcaggtgggtctgggacagagtttcaactctacacatcagcagcctgcagtctgaagtattttgtctaatttattactgtcagctagtataatactggtctccgtactactttggccgtaggggaccaaggctaggacgatacgaaacgaacgttgtacggntcgcctacgtacg

SEQ ID NO: 68464 - DNA, 536 bp, Homo sapiens
  misc_feature: GYAE6OF01C6HNV.51.76.G10.1.454.CMB.1.raw
  modified_base (196)..(196): a, c, t, g, unknown or other
  misc_feature (196)..(196): n is a, c, g, or t
  modified_base (351)..(351): a, c, t, g, unknown or other
  misc_feature (351)..(351): n is a, c, g, or t
  modified_base (410)..(410): a, c, t, g, unknown or other
  misc_feature (410)..(410): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggcctcccaggctcctcatctatgatgcatccacgagggccactgatactcccagccaggttcagtgcaggtggtcgtggacngagttcactctcaccatcagcagcctgcagtctagtagtatttgactatttattacttntctagactaagttaattaataacttcggtcccttaccgttaccttacgtttcggaccgtacggggaaccaaggtcgtagggagtactaacgtaaacgaacgttcggtaggactcgtaccacgtacg

SEQ ID NO: 68465 - DNA, 521 bp, Homo sapiens
  misc_feature: GYAE6OF01CGN5W.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggcctcctcatctatgatgcatccacaagggccatgatatcccgagccaggttccaggtggcaggtgggtctgggacagagttcactctcacatcagcagcctgcagtctagaagtattttgactaatttattactgtcagtctaagtataacgtactacggtccttcgtactacgtttcggccgtacggggaccaaggcgtaggaagtactacgaaacgtacgtaggtacggactcgctaccgtacg

SEQ ID NO: 68466 - DNA, 617 bp, Homo sapiens
  misc_feature: GYAE6OF01DKWU6.51.76.G10.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaangccacctntcctgcagggccagtcagagtgttagcagcgacttagcctggtaccagcagaaacctggaccaggcctccgaggcctcctcatctatgatcgcactccgaacgaacgggcccacgtagactacgtccccaggtcccgtaaggtttccaagggttcggacgtagggttcgggtcgtggggactaggtacgttctactccgtacaccatcacgtcacgtcctgactagtcgtagaagttagttttacgacttaattttagttacgttagtactagtactaagttagttaaacgttaacgtcggtaccttaccgttacttacgttttacggaccggtacgggtaaccgtaacggtcgtagggacgtacgtaaccgaaacggttaacgtcggtacggtacgtcgaccgtaccgttacg

SEQ ID NO: 68467 - DNA, 546 bp, Homo sapiens
  misc_feature: GYAE6OF01BGSO7.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaangccacctctcctgcagggccagtcagagtgttagcagcgacttagcctggtaccagcagaacctggccaggcctccaggcctctcatctatgatgcatccacaaggccatgatactccagcctaggttcaggtggctaggtggtctgggactagagttcactcgtcacatcagcagtcctgctagtctagaagtagtttcgacttaatttacttacgtacgtactagtactagtaataacgtacgtacggtaccttaccgttactacgtttacggaccgtacgggtaaccgaagtcgtaggaacgtacgtaacgaaaacgtacgtcggtacgactcgacgtaccgtaacg

SEQ ID NO: 68468 - DNA, 591 bp, Homo sapiens
  misc_feature: GYAE6OF01BQGYD.51.76.G10.1.454.CMB.1.raw
  modified_base (461)..(461): a, c, t, g, unknown or other
  misc_feature (461)..(461): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgacttagcctggtaccagcagaaacctggccaggctcccaggctcctcatctatgatcgcatccaacgaacgggccatgactactcccgagccaggttcagtggcaggtcgggtctgggactaggtagttccacttcctaccgtacctaacttcgaacgtcgtacgcccgttagaccgtacgttccgtagtaagttacttttagacttaattttattacgttntacgagtactaagtaattaagtaacttcgtacccttacgtacttacgtttacggaccgtaacggggaacctaagccgttaggaacgtacgtacgaaacgtaccgttggcggtacgtcgaccgtacgtacg

SEQ ID NO: 68469 - DNA, 577 bp, Homo sapiens
  misc_feature: GYAE6OF01BESOM.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctcccgaggcctcctcatctatgatgcatccacgaacgggccactgaactactacccagcctaggttcaggtggctaggtcgggtctggggactaggtagttcacttcctacaccatcagccagcctgctagtcgtagaagtattttcgacttaattttattacttgtacagtctaagttaataagttaaccgttggtacccttaccgtaacttaccgtttcgggaccggtaacgggtaaccctaggtcgtagggtaacgtactaacgaaacgtaacgtggtacggacgtacgtcctaccgtacg

SEQ ID NO: 68470 - DNA, 615 bp, Homo sapiens
  misc_feature: GYAE6OF01DN4A0.51.76.G10.1.454.CMB.1.raw
  modified_base (197)..(197): a, c, t, g, unknown or other
  misc_feature (197)..(197): n is a, c, g, or t
  modified_base (467)..(467): a, c, t, g, unknown or other
  misc_feature (467)..(467): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcacgggccagtcagagtgttagcagcgacttagcctggtaccagacacgaaacctggaccaggcctccgacggcctcctcatcgtatgatgctactccaacgacggaccagtagactactcccgagccgtaggttcgaggtcgcgtaggtcgggtcgtaggacgagtacgtctacgtcctacgactactcgacgacagtccctgactaggtactagaagtttacttttagaactttaagttttactgtacgtanacggtaactagttaaacttaacgtacgttccggacccttacgtacgttaccggtttacggaccgtaaggggaaccctaggtaacggttaggaacgtaacgtaaaccgtaaaggttaacttgggtaacggtctacggtcctacgttacg

SEQ ID NO: 68471 - DNA, 566 bp, Homo sapiens
  misc_feature: GYAE6OF01BMY8R.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctccaggctcctcatctatgatgcatccacgaagggccactgatactcccagtcaggttcagtggcagtgggtctgggacagagttcactctcaccatcagcagcctgcagtctagaagtattttgactaatttattacttgtactagtctaagttacttaataacgttcggtacccttaccgttaccgtacgttttacgggacccgtaacgggggtaaccctaaggtccgtagggaacggtaacgtaccgtaaaaccggtaacgtacggttacggtactacggcctaacccgtacg

SEQ ID NO: 68472 - DNA, 521 bp, Homo sapiens
  misc_feature: GYAE6OF01E2KZ8.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgggagaagtagtgatgacgcagtctccagccaccctgtctgtgtctccgaggggaaanagccaccctctcctgcagggccagtcagagtgtagcagcgacttagcctggtaccagcagaaacctggccaggctcccaggcctcctcatctatgatcgcatccacgaacgggccactgactatcccagccaggttcaggtggcaggtgggtctgggacaggagttcactctcacctatcagcagcctgcagtctagaagtattttgactaattttattactgtcagtctaagttataataactcggtcctacgtacttacgtttggaccgtagggaccagcgtaggacgagtacgaaacgtacgtggtcggatcgcacgtac

SEQ ID NO: 68473 - DNA, 544 bp, Homo sapiens
  misc_feature: GYAE6OF01BDRRF.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgtagcagcgacttagcctggtaccagcagaaacctggccaggctcccaggctcctcatctatgatgcatccacaagggccactgatatcccagccaggttcagtggcaggtgggtctggggacaggagttcactcctcaccatcagcacgcctgccagtctagaatattttgacttaatttattacttgtctagtctaagttaataacttaacgtcggtacccttccgttaactacgttttcggacccgtacggggtaccaaggccgtagggtacgtagtacgaaacggtaacgtcggtggacttcgcctacgtac

SEQ ID NO: 68474 - DNA, 522 bp, Homo sapiens
  misc_feature: GYAE6OF01CQRF4.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgacttagcctggtaccagcagaaacctggccaggctcccaggctcctcatctatgatgcatccacaagggccactgatactcccagccaggttcagtggcaggtgggtctgggacagagttcactctcacatcagcacgcctgcagtctagtaagtattttgactaattttattactgtcagtctaagtataataacgttggccttaccgtactacgtttcggaccgacggggaccaacggcgtaggagtactacgaaaacgacgtaggtcggctcgccaccgtacg

SEQ ID NO: 68475 - DNA, 619 bp, Homo sapiens
  misc_feature: GYAE6OF01BVKCY.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcaagaaacctggccaggcctcccgaggcctcctcattctatgactgcactccaacgtaacgggcccaactgaatactacccagccctaggttcaggtggctagggtcggtcgtgggacaggtacgttcactctcaccgactcgacgcacgcctgctagtctagtaagttagttttgacttaattttacttacgtgtactaagtactaagttaacttaaacgttaaccgttacggtacccttaccgtttaaccgttacgttttaccggggaccgtaaccggggtaaccctaacgggtccgtagggaacgtaacgtaaccgtaaaaccggtacgttaggtacggaccgttacgaccgtaccgtaacg

SEQ ID NO: 68476 - DNA, 588 bp, Homo sapiens
  misc_feature: GYAE6OF01CDDFL.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgtagcagcgacttagcctggtaccagcagaaacctggaccaggcctcccgaggcctcctcatctatgatgacactccaacgaacgggccacgtagactactcccagccgtaggttcaggtggcgtaggtgggtcgtagggactagtacgttccgacttcgtaccaacctataccgagccagtccctggacctagttcctaggtaagttattttacgactttaaattttactttactcggtactacgactaagttaataacgttaacgtcgtacccttacgtacttaccgttggccgtaagggacctagccgtaggaacgtactaacgaaacgtacgtggtacgcgtactcgaacgtacg

SEQ ID NO: 68477 - DNA, 531 bp, Homo sapiens
  misc_feature: GYAE6OF01DWAAF.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctcccaggctcctcatctatgatgcatccacagggccatgatactcccagccaggttcagtggcaggtgggtctgggacagtagttcactctcaccatcagcagcctgcgtatgagtatttgacttaatttattactgtcagtacaagttaataattaacgtcggtcctaccgttaccgtacgttttcggacccgtacggggacctaagtcgtggtagactacgaaaccgacgttggtcggtactgacctcgtagttcg

SEQ ID NO: 68478 - DNA, 590 bp, Homo sapiens
  misc_feature: GYAE6OF01DM7L0.51.76.G10.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccgaggcctcctnatctatgatgcatccacgaaggccactgatactcccagcctaggttcaggtggcaggtgggtctaggggacaggtagttccactctaccacatcagacagcctgcgtagtcgtagtaagtagttttagtacttaatttatttacgtgttactagtacgtaagttaattaaacgttaacgtcggtaccgttaccgttacttaccgttttacgggacccgtacggggtaaccgtaacggtccgtagggaacgtaacgtaaccgaaaaccggtaacgttacggtacggacgtacgaccgtaccgtacg

SEQ ID NO: 68479 - DNA, 564 bp, Homo sapiens
  misc_feature: GYAE6OF01BAHN6.51.76.G10.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (415)..(415): a, c, t, g, unknown or other
  misc_feature (415)..(415): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgtagcagcgacttagcctggtaccagcaagaaacctggccaggcctcccaggcctcctnatctatgatgcatccagaacgggccatgactactcccgagtccgaaggttcaaggtcggactagggtcgggtctggggactaggtacgttcacgtctacacatcagcacgcctgctagtctgaagtnttttgacttaatttatactgtacagtctaagtactaatacgtcgtccttacgtacttacgtttcggaccgtacggggaacctaggtccgtagggaactcgtaaccgtaaacggtacgttcgggtaggaccttcgaccgtaccgttaacg

SEQ ID NO: 68480 - DNA, 686 bp, Homo sapiens
  misc_feature: GYAE6OF01DLE4Y.51.76.G10.1.454.CMB.1.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgcgagggccagtcagagtgttagcagngacttagcctggtaccagcagaaacctggccaggcctccgaggcctcctnatctaatgatcgaccatcccgaacgaacgggccaacgtgaactaccgtcccaaggtcccgtaggttacaaggttgggaccgtaagggtcggggtaccgtagggggactaacgggtacggtttccaaccgttcctacctaacctaacttccgaacgccgaacgtcccgtggtaccgtaggtccgttaaggtaacgtttagttttacgaaccgtttaaattttaactttacgttacgtacaacgtactaaaggttaactaaacgttaaccgtccggtaccttacccgtaacgttaccgttttacgggaccggtaacggggtaaccctaacggtcgttaggaacgtaacgttaaccgaaaacggtacgttcggtacgacgtacgaccgtaccgttacg

SEQ ID NO: 68481 - DNA, 563 bp, Homo sapiens
  misc_feature: GYAE6OF01CW9Q2.51.76.G10.1.454.CMB.1.raw
  modified_base (197)..(197): a, c, t, g, unknown or other
  misc_feature (197)..(197): n is a, c, g, or t
  modified_base (525)..(525): a, c, t, g, unknown or other
  misc_feature (525)..(525): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagttgtagcagcgacttagccgtggtaccagcaacgaaaccgtggaccaggcctcccgaggcctccctcatctatgatgcatccaacgaagggccactgatactcccagcctagttcagtggctaggtgggtcgtagggacagtagttccacgtctacacctatcgacgcacgcctcgcgacgtctagtaagtagttttagacttaatttatttactgtacagtactaagtaattaactacgtcggtacccttaccgttacgttacgtttcggaccgacggggtaccagtcgtagggaanacgtaacgtaaacgtacgtggtacgatcgcctactacg

SEQ ID NO: 68482 - DNA, 515 bp, Homo sapiens
  misc_feature: GYAE6OF01CYZ5N.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgagggggaaanagccaccctctcctgcagggccagtcagagtgttagcagcgacttagcctggtaccagcagaacctggccaggctcccaggctcctcatctatgatgcatccacaagggccactgatactcccagcctaggttcagtggcaggtgggtctggggacaggtagttcacgttctcaccatcagcacgcctgctagtctagaagtatttgtactaatttattactgtcagctaagtattaatactgtccttaccgtactacgtttggccgagggtaccagtcgtggagatacgaaacgacgtggtacgactcgcactac

SEQ ID NO: 68483 - DNA, 507 bp, Homo sapiens
  misc_feature: GYAE6OF01BD3XW.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgtagcagcgacttagcctggtaccagcagaaacctggccaggctcccaggctcctcatctatgatgcatccacaagggccactgatactcccagccaggttcagtggctaggtgggtctggggacaggagttcactctcaccatcagcagcctgcagtctagaagtattttggacttaatttattactgtcagctagtataatactggtcctccgtactacgtttggaccgtaggggaccaagcgtaggagactacaaacgactggtagctgcactacg

SEQ ID NO: 68484 - DNA, 597 bp, Homo sapiens
  misc_feature: GYAE6OF01AW85C.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggagggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgtagcagcgacttagcctggtaccagcagaacctggccaggctcccaggctcctcatctatgatgcatccacgaaggccacgtgatactcccgagccgaggttccaaggtcggacgtaggtcgggtcgtaggggacaggtacgtttcacgttcctacaacctagttccgacgtccacggtcctagaccgtacggtactaggtaagttattttacgacttaattttacgttacttacgtactacgtactaagttaattaactaacgtcgtaccttacgtacttacgtttcggaccggtacgggtaaccgacggtcgtaggaacggtataaccgtaaacgtacgtacggtacggactcgaccgtacgtaccg

SEQ ID NO: 68485 - DNA, 571 bp, Homo sapiens
  misc_feature: GYAE6OF01A356C.51.76.G10.1.454.CMB.1.raw
  modified_base (196)..(196): a, c, t, g, unknown or other
  misc_feature (196)..(196): n is a, c, g, or t
  modified_base (402)..(402): a, c, t, g, unknown or other
  misc_feature (402)..(402): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctccaggctcctcatctatgatgcatccagaacggccatgactactcccagccaggttcaggtggcagtgggtctaggggactagtacgttcacgtctacacatcagtcagccctagctacgtctagaagttntttgactttaatttacgttactgtacctaggtactaagttaataaacgttacgtcggtacccttacgtacgttacgtttacgggaccgtaacgggaccgtaacgtcggttaggacgtaacgtaaccgaaaacggttacgtacgggtacgacgttacgccgtaccgtacg

SEQ ID NO: 68486 - DNA, 535 bp, Homo sapiens
  misc_feature: GYAE6OF01DT296.51.76.G10.1.454.CMB.1.raw
  modified_base (196)..(196): a, c, t, g, unknown or other
  misc_feature (196)..(196): n is a, c, g, or t
  modified_base (349)..(349): a, c, t, g, unknown or other
  misc_feature (349)..(349): n is a, c, g, or t
  modified_base (398)..(398): a, c, t, g, unknown or other
  misc_feature (398)..(398): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcaagaaacctggccaggcctcccgaggctcctcatctatgatgcatccaacgaagggccatgatactcccagccaggttcagtggcaggtggtcngggacagtacgttcacttctacacatcagcagcctgcagtctgtaagtnttttgactaattttacttactgtcagtactagttaataatacgtcgtaccttccgtacttacgtttcggacgtacgggaccgagtcgtaggagtactaacgtaaacgaacgttcggtacggtctacgctaccgtacg

SEQ ID NO: 68487 - DNA, 533 bp, Homo sapiens
  misc_feature: GYAE6OF01AX8SF.51.76.G10.1.454.CMB.1.raw
  modified_base (197)..(197): a, c, t, g, unknown or other
  misc_feature (197)..(197): n is a, c, g, or t
  modified_base (500)..(500): a, c, t, g, unknown or other
  misc_feature (500)..(500): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggcctcccgaggcctcctcattctatgatcgcactccaacgaacgggccaacgtgatactcccgagcccgtaggttcagtgggctaggttgggtctggggacaggtagttcactctacacatcagcagcctgcagtctagaagtattttagacttaatttattactgtcagtctagtataattacgtgtcctaccgtactacgtttcggccgtagggacaggcgtagganactacgaaagtactcggtgactcgctacgtacg

SEQ ID NO: 68488 - DNA, 560 bp, Homo sapiens
  misc_feature: GYAE6OF01CT4C7.51.76.G10.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (276)..(276): a, c, t, g, unknown or other
  misc_feature (276)..(276): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaangccacctntcctgcagggccagtcaggagtgttagcagcgacttagcctggaccagcagaactggcaggctccaggctctnatctatgatgcatccaacgaaggccactgatactccagccgaggttcaggtggcgaggtggcgtggggacaggtagttccacgtctaccaccatcagcgagtcctgcagtcgtagtaagtatttagacttaatttattactgtactagtactaagttataacgtaacgtcggtaccttaccgttacgtaccgttttacggaccgtaacgggaacctaacggtcgtaggacgtacgtaaccgtaaacggtaacgttacggtacggtacgtcgtaccgaccgtacg

SEQ ID NO: 68489 - DNA, 555 bp, Homo sapiens
  misc_feature: GYAE6OF01ADTWL.51.76.G10.1.454.CMB.1.raw
  modified_base (197)..(197): a, c, t, g, unknown or other
  misc_feature (197)..(197): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcaagaaacctggaccaggcctccgaggcctcctcatctatgatcgcatccacgaacgggcctacgtgactactcccagcctaggttcaggtgactaggtggtctggacagtacgttcactctcacntcagcagcctgctacgtctagtagtatttcgacttaagtttactactgtacgagtactaagtaataataacgtcgtaccttaccgttactacgtttacggaccgtagggtaaccaaggtccgtaggacgtactaccgaaacgtacgtacgtacgtacgtcgtaccgtacgtacg

SEQ ID NO: 68490 - DNA, 565 bp, Homo sapiens
  misc_feature: GYAE6OF01EAHZV.51.76.G10.1.454.CMB.1.raw
  modified_base (197)..(197): a, c, t, g, unknown or other
  misc_feature (197)..(197): n is a, c, g, or t
  modified_base (392)..(392): a, c, t, g, unknown or other
  misc_feature (392)..(392): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccagcagaaacctggccagctcccaggctcctcatctatgatgcatccacaagggccactgatatcccagccaggttcagtgcagtgggtctgggacagagttcactctacacatcagccagccctgcagtcctgaagtnttttagacttaattttattactgtacagtctaagttataacttaacgtggtacccttaccgttaacgtcgttttacgggacccgtagggggtaaccccaaggtccgttagggaacgtacgttaaccgaaaaccgtaacgttcggtacggtacctacggtacccaccgttaacg

SEQ ID NO: 68491 - DNA, 572 bp, Homo sapiens
  misc_feature: GYAE6OF01AZ7E0.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggcctcccgaggcctcctcatctatgatgcatccacgaacgggccacgtgatactcccagcctaggtcaggtggctaggtgggtcgtgggacaggtacgttcgactctaccaccatacacgacacgcctgctagtctagtaagtattttagacttaatttacttacgttgtacgagtactaagtaattaactaacgtcgtacccttacgttactacgtttcggaccgtacggggtacctaaggtccgttaggacgtacgtaacgtaaacgtaacggtacgtacggtacctacgaccgtaccgtacg

SEQ ID NO: 68492 - DNA, 760 bp, Homo sapiens
  misc_feature: GYAE6OF01DKS88.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtcctccgaaggggaaagcgcccaccctctcctgcgagggccagtcagagtgtagcagcgtacttagccgtaggtaccagacgacgaaaccgtggaccaggcctcccgaggtcctcctctactctagtgtactcgactactaccgaacgaacgggcctaacgtagactacctaccccgacgtacccgtaacggttcgaacgggttcgggacgttacggggttcgggtaccgtaggggaacctaggtaccggtttcctaacccgttcctacccgtaacccgtacttaccgaacggtaccgacggtcccgtacgtaccgtaacggttccgtaaggtaacgtttacgttttagtaacctttaaattttaacgtttacgttacgtaccgtaacgtaccgttaaagttaacttaaacgttaaccggttaccggttaccccgtttaacccggttaacgtttacccggttttaccgggacccggtaacggggtaaacccgtaaggtccggtaagggaaacgtaccgtaaaccgtaaaaccggtaacggttacgggtacggtaccgtacgtcccgtaacgttaccg

SEQ ID NO: 68493 - DNA, 637 bp, Homo sapiens
  misc_feature: GYAE6OF01A9E8M.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggctcccaggctcctcatctatgatgcatccacgaacgggccactgactactcccgagcctaggttcaggtggactagggtcgggtctaggggactaggtacgttcacgttctcaaccgatcgacgtcgacgtcctgccgtagttacgtagtaagttatttagtacttaagttttacttacgttagtaccaagtacctaagttaacttaaacgttaaccgttcggtaccccgttacggttaaccttacggttttaccgggacccgtaacgggggtaaaccctaagggtccgttaggggaacttaacgtaaacccgtaaaaccgggtaaacgttcgggtaacggtccgttaacgggccctaaccgttacg

SEQ ID NO: 68494 - DNA, 578 bp, Homo sapiens
  misc_feature: GYAE6OF01BSBRR.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctctagccaccctgtctgtgtctccgaggggaaanagcccaccctctcctgcagggccagtcagagtgttagcagcgacttagcctggtaccagcaagaaacctggccaggctcccaggcctcctcatctatgatcgcatccacgaacgggccaacgtgactactcccgagcccgtaggttcaggtggcaggtgggtcctggggacagggtattcgacttcctacaccatcagcacggcccttagccgagttcgtagtaacgttattttgactttaaattttacttacgttagtaccagtactaagttaataaactaacgttcggacccttaccgtacttacgtttcggaccgacgggtaaccagtccgtaggacgtactaaccgaaacgtacgtggtagacctgaccgtactacg

SEQ ID NO: 68495 - DNA, 574 bp, Homo sapiens
  misc_feature: GYAE6OF01B9V0P.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaatccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcaagaaacctggccaggcctcccaggcctcctcatctatgatcgcatccaagaacgggccactgactactcccagccaggttcagtggcgtaggtgggtctggggacaggtacgttcactctacaccactcacgcacgcctgcagtctagtaagttatttagtacttaattttattacttgtactagtactaagtaattaacgttaacttacggtaccttaccgttactacgtttcggaccgtacggggaaccgaaggtcgtagggacgtacgtaaccgtaaacgtaacgttacggtacggtacgtacgccgtacgtacg

SEQ ID NO: 68496 - DNA, 539 bp, Homo sapiens
  misc_feature: GYAE6OF01CQFF3.51.76.G10.1.454.CMB.1.raw
  modified_base (198)..(198): a, c, t, g, unknown or other
  misc_feature (198)..(198): n is a, c, g, or t
  modified_base (319)..(319): a, c, t, g, unknown or other
  misc_feature (319)..(319): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaanagcccaccctctcctgcagggccagtcagagtgtagcagcgacttgcctggtaccagcagaacctggccaggctcccaggctcctcatctatgatgcatccacaagggcctaactgatacncccagcccaaggttccaaggttggactaggtgggtctggggacaggacgttcactctacaccatcagccagtcctgccagtctagaagtattttagactaatttactactgacctaagctaagttataatacgtgtcctaccgtactacgtttcggccgtaacggggaccaggtcgtaggacgactaccgaaacgacgtcggtacgactacgccacgtac

SEQ ID NO: 68497 - DNA, 530 bp, Homo sapiens
  misc_feature: GYAE6OF01D15V2.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccagaacgggccactgatatcccagccaggttcagtggcaggtggtctgggacagagttcactctcaccatcagcagcctgcagtctgaagtattttgctaattttattactgtctagctagttataaattacgtcggtcccttaccgtactacgttttcgggaccgtacggggaccaaggtcgttagggagtactaaccgaaacgaacgtcggtacggacgtcgcaccgtaacg

SEQ ID NO: 68498 - DNA, 506 bp, Homo sapiens
  misc_feature: GYAE6OF01AICQ0.51.76.G10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagagtgtagcagcgacttagcctggtaccagcagaacctggccaggctcccaggctcctcatctatgatgcatccacaagggccactgatactcccagccaggttcagtcggctaggtgggtctgggacagtagttcactctcaccatcagcagcctgcagtctagaagtatttgactaatttattactgtcagcagtataataactcgtccttaccgtactactttcggccgacgggaccaacgcgtaggagatacgaaacgacgtagtacggctcgcacgtac

SEQ ID NO: 68499 - DNA, 546 bp, Homo sapiens
  misc_feature: GYAE6OF01B2KTI.51.76.G10.1.454.CMB.1.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgttagcagcgacttagcctggtaccagcaagaaacctggccaggcctcccgaggcctcctnatctatgatcgcatcccacgaacggccatagactactcccagccgtaggttcaggtcggcgtaggtcgggtctaggggacaggtagttccacttctaccacatcacgtcagtctgctagtcgtagaagttatttgacttaatttattactgtacagtctaagtaataataacgtgtccttacgtacttacgtttcgaccgtagggaaccagcgtaggaacgtctaacgaaacgacgttgacggactcgctcgtacg

SEQ ID NO: 68500 - DNA, 597 bp, Homo sapiens
  misc_feature: GYAE6OF01CRKS4.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtcctccgaggggaaancgcccaccctctcctgccagggccagtcagagtgtagcagcgacttagcctggaccagcagaacctggaccaggcctcccgaggcctcctcatctatgatgcatccaacgaaggccatgatactcccagccgagttcagtcggactaggtcggtctaggggactaggtagttcacgtctacacgtactacgagccacgccgtgctagtctagtaagtagtttagacttaatttacttactgtactagtacgtaagttaattaacgtaaccgttacggtacccttaccggttacttaccggttttacgggacccggtaacggggtaaccaacggtacgtaggtacgtaactaaccgaaacgtacgttacgggtacggtaccgtcgtaccgtaccgtacg

SEQ ID NO: 68501 - DNA, 683 bp, Homo sapiens
  misc_feature: GYAE6OF01A471N.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccacctctcctgcgagggccagtcagagtgtagcagcgtacttagcctggtaccagtcaagaaccgtggaccaggcctcccgaggtcctcctcatctatgatcgactactccgaacgaacgggtccctaagtcgaacttaccgtccccgaaggtcccgttaagggtttccaagggttcgggcgtaagggtttcggggtactacggggaactaaggtcgtttaccaaccgttcctacccgaactactccgaagccgacggtcctcggacgtacgtacgttagtaagttacgttttgtaactttaagttttacttacgttgtaccaagttactaaggttaataaccgttacgttaccggtaccttaccgtaccgttacggtttccggaccggttaacgggaacccgtacggtacggttaggaacgttaaccaacggtaaaacccgtacggttcggacgggtaccttaccggacccgtaacgttacccg

SEQ ID NO: 68502 - DNA, 580 bp, Homo sapiens
  misc_feature: GYAE6OF01DVF06.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagcccaccctctcctgcagggccagtcagagtgtagcagcgacttagcctggtaccagcaagaacctggaccaggcctcccgaggcctcctcactctatgatgcactccacgaagggccactgtatactcccagcctatcgttacaggtggctaggtgggtcgtagggactaggtagttccactccgtacacctatacgacgacacgtcccgtagcctacgttcgtagtaagttacttttagtacttaattttacttaacttgtactagtactaagttaattaaactaacgtcggtacctaccgttacttacgtttacggaccgtacggggaccgtaagtcgtaggacgatacgaacgtacgtcggtagtacgtcgctaaccg

SEQ ID NO: 68503 - DNA, 538 bp, Homo sapiens
  misc_feature: GYAE6OF01EPL0P.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcagaaacctggccaggctcccaggctcctcatctatgatgcatccacgaagggccatgatactcccagccaggttcagtggcaggtggtctgggacagagttcactctacaacatcagcagcctgcagtctagaagtattttgactaattttatacttgtcagtctaagtaataacgtaacgtcggtaccctaccgtacttacgtttcggaccgtacggggtaacctaaggtctagggacgtactaaccgaaacgtaacgtggtacggactcgccgtacctacg

SEQ ID NO: 68504 - DNA, 613 bp, Homo sapiens
  misc_feature: GYAE6OF01DITQA.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctccagataccactggagaagtagtgatgacgcagtctccagccaccctgtctgtgtctccgaggggaaanagccaccctctcctgcagggccagtcagagtgtagcagcgacttagcctggtaccagacacgaaactggccaggcctcccgaggcctcctcatctatgatgcactccaacgaacgggccaactgactactcccagcctaggttcagtgctaggtgggtctggggacaggtagttccgacttccgtacaccagtacacgtccacgccgtgcgtagtctaggtaagttagttttacgacttaattttaactttactacgtactagacctaagttaacgttaaacgtaacgttcggtacccttaccgttaccgttaccgttttacggaccggtaacggggtaaccgtaacggtacgtagggaacgtaacgtaaccgtaaacggtacgttacggttacggacgttacggaccgtaccgtacg

SEQ ID NO: 68505 - DNA, 592 bp, Homo sapiens
  misc_feature: GYAE6OF01CZFU5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgtagcagcgacttagcctggtaccagcaagaaacctggccaggcctcccgaggcctcctcatctatgatgcatccagaagggccactgatactcccagcctaggttcaaggtcggcaggtcgggtctggggacaggtacgttccaacttcctacacactcagcacgcctgacacgtactagaagtagttttcgacttaattttacttaacttcgtacagtacgtaagttaattaaacgtaacgttcggtacccttacccgttacttaccgttttacgggaccgtaacggggaccaacggtcgttagggaacgtaacgttaaccgaaaacggtaaccgttggtacggctacggcctacccgtaac

SEQ ID NO: 68506 - DNA, 611 bp, Homo sapiens
  misc_feature: GYAE6OF01B5HZP.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccgaggcctcctcatctatgatgcatccaacgaacgggccactgatactcccagccgtaggttcaagtggcaggtcgggtctgggacaggtacgtttcactctcaccatccagcacgtccctgaccgtaggtcctaggtaaagttatttttacgacgttaaattttacttaccgtttgttaccaggtacctaaggtttaacttaaagttaaaccgttcgggttacccttaccggttaaccttacggttttaccgggacccgtaacgggggtaaccctaaggtccgttagggaagtacttaaccggaaaacgtacgttggtacgacgtcgaccacgtacg

SEQ ID NO: 68507 - DNA, 581 bp, Homo sapiens
  misc_feature: GYAE6OF01D61UP.51.76.G10.1.454.CMB.1.raw
  modified_base (197)..(197): a, c, t, g, unknown or other
  misc_feature (197)..(197): n is a, c, g, or t
  modified_base (316)..(316): a, c, t, g, unknown or other
  misc_feature (316)..(316): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgttagcagcgacttagcctggtaccagcagaaacctggccaggctcccaggcctcctcatctatgatgcatccacgaaggccatgatacnccagccaggtcagtgcagtggtctggacngagttnactctcacatcacgcacgctcgctaggtctaggtaagtagttttgacttaagttttacttacttagttacagtactaagttaataaagttaccgtcggtacccttacgttacgttaccgttttcgggacccgtaacgggggaaccctaacgggtcggttaacgggacgtacgtaaccgtaaaaaccggtaacgttacgggtacggtccgtacgggtcccaaccgttaacg

SEQ ID NO: 68508 - DNA, 603 bp, Homo sapiens
  misc_feature: GYAE6OF01AE9SU.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgccagggccagtcagagtgtagcagcgacttagcctggtaccagcagaacctggccacggctcccgaggcctcctcatctagtgatcgctactcccaacgacgggcccaatgactactcccagccgtaggttcgaggttcggacgtagggtcgggtcgtaggggtaacaggtacgtttccacttccacgtaaccatcgacgcacgtccgtgacgtagtccgttagtaagttattttacgaactttaattttacttaacgtagtacagtactaagtaataactaacgtcggttcccttaccgttaccgttacgtttacggaccggtaacgggtaccaacggtcgtaggaatacgtaacgaaacgtacgtggtcgagtacgacgtaccgtac

SEQ ID NO: 68509 - DNA, 670 bp, Homo sapiens
  misc_feature: GYAE6OF01B53AB.51.76.G10.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggctccgaggctcctcatctatgatgcactccaanaacgggccactgactactcccgagccaggtttcaggtcggcagggttcgggtctggggactaggtacgtttcaccgttctaccacctatccgagccacgccctagaccgtaggttaccgtagtaaacggttatttttacgaacgtttaaactttttacttacgtttacgtactaagtaccttaaggttaaactaagttaaccgtcgggttaacccttacccggttaccttaccggttttacggaaccccggtaacgggggtaaccctaacgggttccgtaaggggtaacgtaaaccggttaaccgtaaaaaccgggttaaccgttacgggttacggtaacccgtacggtaacccgtaaccgttaccgg

SEQ ID NO: 68510 - DNA, 588 bp, Homo sapiens
  misc_feature: GYAE6OF01CXHLL.51.76.G10.1.454.CMB.1.raw
  modified_base (198)..(198): a, c, t, g, unknown or other
  misc_feature (198)..(198): n is a, c, g, or t
  modified_base (358)..(358): a, c, t, g, unknown or other
  misc_feature (358)..(358): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgcagggccagtcagagtgtagcagcgacttgcctggtaccagcaacgaaccgtggccaggcctccgaggctcctcatctatgatgcactccaagaacggccactgactactcccagcctaggttcgagtggctaggtcggtcgngggacagtacgttcactctacacatcgagcacgctcgcagtcgtagtaagttagtttacgacttaattttacgttacgtagtacgtagtacgtaagttaacttaaacgtacgtacgtaccgttaccgttacttaccgtttacggaccgtaacggggtaaccaaggtccgtaagggtaactaacgtaacgtaaaaccgacgttacggtacgtacttacgacctaacgtacg

SEQ ID NO: 68511 - DNA, 645 bp, Homo sapiens
  misc_feature: GYAE6OF01BYCIG.51.76.G10.1.454.CMB.1.raw
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagccaccctctcctgcagggccagtcagagtgttagcagcgacttagcctggtaccagcaagaacctggccaggcctcccaggcctcctcatctatgatgcatccanacgggccacgtgactactcccagtcctaggttcaggtcggacgtaggtgggtcgtgggaacctaggtacggtttcaacgttccgtaccaaccgacttaccgacggtaccacgtcccgttacggacctacggttaccgtaggttaacgttacgttttacggtactttaaattttacgtttaaccttagttactaacgtactaacgttaacgtaaattaaccgttacgggttacccttaccggttacctacggttttaccgaccggtacgggtaacctaacggtcgtaagggactacgtaaccgaaaccgtacgttcggtacggtactcggcctacgttacg

SEQ ID NO: 68512 - DNA, 644 bp, Homo sapiens
  misc_feature: GYAE6OF01C336L.51.76.G10.1.454.CMB.1.raw
  modified_base (193)..(193): a, c, t, g, unknown or other
  misc_feature (193)..(193): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccacctgtctgtgtctcgaggggaancgccaccctctcctgcagggccagtcagtgtgtagcagcgacttagcctggtaccagcaacgaaccgtggccaggcctccgaggcctccgtcatctagtgatcgcatacccgaacgaacggacccacgtagactaccgtcccagcctaggttcaggtcggacgtagggttcggtcgcggactaggtaactttccacgttcctaccaacctactacgacgtaccgtacgtcccgtgtacgtacgtacgtagtaagttacgttttacgtaacttaacttttacgttacgttacgtacgtacgtaacgtaacgttaacgtaacgtaacgttcggtacccgttaccgtttacgtacggttttccggaaccgggtaacgggtaccgtaacgggtcgtagggtaacgtacgtaacgtaaacggtacggttagtacggtacgtacgccgtacgtaccg

SEQ ID NO: 68513 - DNA, 561 bp, Homo sapiens
  misc_feature: GYAE6OF01BANOF.51.76.G10.1.454.CMB.1.raw
  modified_base (197)..(197): a, c, t, g, unknown or other
  misc_feature (197)..(197): n is a, c, g, or t
  modified_base (375)..(375): a, c, t, g, unknown or other
  misc_feature (375)..(375): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggcctccaggctcctcatctatgatgcatccacgaacgggccactgatactccagccaggttcagtgcaggtgggtcgtgggacaggacgttcacgtctacaccntcagcacgctgcagtctagaagtagttttgacttaatttattactgtctagtactaagtaattaagttaactcggtacccttacgttaccgtaccgttttcgggacccgtacggggtaacctaacgggtcgtagggacgtacgttaacgaaacgtaacgtcggtacggtactacgacctacgtacg

SEQ ID NO: 68514 - DNA, 552 bp, Homo sapiens
  misc_feature: GYAE6OF01BJBTI.51.76.G10.1.454.CMB.1.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgtagcagcgacttagcctggtaccagcagaacctggcaggctcccaggctccncatctatgatgcactccaacaagggccactgactatcccagccaaggttcagtggcaggtcggtctgggacagacgttcactgtcaccatcagcagcctagcagtctagacgtatttgacttaagtttattactgttacagtctaagttataaagtaactccggtaccttacccgttactaccgttttcggaccgtacggggtaaccaaggtcttagggactacgttaacgaaaaccgttagtacgtacgggacttcgaccgtacctaacg

SEQ ID NO: 68515 - DNA, 573 bp, Homo sapiens
  misc_feature: GYAE6OF01C2I0J.51.76.G10.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccanagggccactgactactcccagccaggttcaggtggcaggtgggtctgggacaggtagttcacttctcaccatcacgcagcctgctagtctgtaagtattttgctaattttattactgtctagctaagttaataacttaacgtcggtacccttacccggttacttaccgttttacgggacccgtaacggggtaccctaaaggtccggttagggaagtacgttaacccgtaaaacggtaacgttggtacgggtactacggaccgtacccgtacg

SEQ ID NO: 68516 - DNA, 567 bp, Homo sapiens
  misc_feature: GYAE6OF01BBSZJ.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaacctggccaggctccaggctcctcatctatgatgctatccaacgaacgggccacgtgactactcccagcctaggttcagtggcgtaggtcgggtctaggggactaggtacgtttccactcctacacctatccagcacgtcctagctagtctagaagttacttttgactttaatttactactgtacgagtctaagttaataaacttacgtcgtaccgttaccgtacttacgtttcggaccgagggtaccctaaggtcggtaggaaggtactaacgaaacgtacgtcggtacgacgtcgaccgtctacg

SEQ ID NO: 68517 - DNA, 568 bp, Homo sapiens
  misc_feature: GYAE6OF01C8NNB.51.76.G10.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
  modified_base (390)..(390): a, c, t, g, unknown or other
  misc_feature (390)..(390): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagngtgtagcagcgacttagcctggtaccngcagaacctggccaggctcccaggctcctcatctatgatgcatccanagggccatgatacncccagccaggttcagtggcaggtggtctgggacnggtagttcactctcaccatcagcacgcctgcagtctagaagtntttgacttaatttattactcgtacagacgtagttaataacgtactcggtcccttaccggttacttaccgttttacgggacccgaacgggggtaacccaagggtccgtagggtaacgtaacgttaaccggtaaaaccgtaacgttacgggtacggtaccgtacggccctaaccgttacg

SEQ ID NO: 68518 - DNA, 571 bp, Homo sapiens
  misc_feature: GYAE6OF01BRR3S.51.76.G10.1.454.CMB.1.raw
  modified_base (198)..(198): a, c, t, g, unknown or other
  misc_feature (198)..(198): n is a, c, g, or t
  modified_base (406)..(406): a, c, t, g, unknown or other
  misc_feature (406)..(406): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccaccctctcctgcagggccagtcagagtgttagcagcgacttagcctggtaccagcagaaacctggccaggctcccaggctcctcatctatgatgcatccacgaagggccactgaactactcccagccaggtttccaggttggcaggtcgggtctgggacaggacgttcacgtctacaccatcagcagcctgcagtctagtaagtntttagacttaatttattacgttgtcagtactaagttaactaaagttaaccgtcggtacccgttccgttacttccggttttacggacccggtaggggaaccctaaggtcgttagggaacgtacgtaccgaaaacgtacgttgggtacgaccgtggcccacgttacg

SEQ ID NO: 68519 - DNA, 651 bp, Homo sapiens
  misc_feature: GYAE6OF01DDFRD.51.76.G10.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagcgatcgtatacacgaccggtgctcgatttagtcactcatacagggggaggaactgctcagttaggacccagacggaaccatggaagccccagcgcagcttctcttcctcctgcttactctggcctcccagataccactgggagaagtagtgatgacgcagtctccagccaccctgtctgtgtctcgaaggggaaancgccaccctntcctgcgagggccagtcagagtgtagcagcgacttaggcctaggtaccagacaagaaaccgtggaccgacggcctcccgaggtcctcctcacttcctaattcgatcgactaactaccgaacgaacgggcctaacgtgaacttacacccgaacgtaccgtaacggttacgaggtcggacgtacgggtcgggtcgtaggggaacaggtacgttacactcgtaccgtacactacgacgtccacgtccgtacgtcgtaacggtcgtagttaacgttagtttacgactttaatttacttactgtacagtctaagtaattaactaacgtcgtaccttaccgtaacgttacgtttacggacggtacggtaacgtaacgaccggtaggaacgtaacgtaaccgtaaacggtacgttacgggtcgtaacgtccgtaccggaactttaccg

SEQ ID NO: 68520 - DNA, 595 bp, Homo sapiens
  misc_feature: GYAE6OF01BLXUI.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctgtaccagcagaacctggaccaggcctccgaggcctcctcatctatgatgcatccacgaacgggccacgtgatactcccagccaggttcagtggcgaggtcggtctgggacaggtacgttcacgtctacaccatcgagcacgcctgctagtactagtaagttattttgacttaatttacttacgttacgtactagtacgtaagttaacttaacgttaacgttccggttacccgttacccgttaacgttaccggttttaccggaccggttaacggggaaccctaagggtccgttagggaacgtacgtaaccgtaaacgtacgtacggtacggtactcggaccgtaccgttacg

SEQ ID NO: 68521 - DNA, 701 bp, Homo sapiens
  misc_feature: GYAE6OF01B52T7.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctcgaggggaangccacctctctgcgagggccagtcagagtgttagcagcgtacttagccgtggtaccagacaagaaccgtggaccagggcctcccgaggtcctccctatacttctatggactcgcctaacgtccaacgaacggccacgtgactactcccgagtcctaggttcaggtcggcgtagggttgggtcgtagggaactagttacgttacaccttccgtaccaacctactccgacgaccgtacgtcccgtagaccgtacgtcgttaagtaacgttagttttacgtaactttaaagttttacgttacgttcgtaacgtagtaccgttaaaggtttaacgttaaaccgtttaaccggttaccggttaacccgttacccggttacctttaaccggttttaccgggaacccggttaaccggggtaaaccctaacgggtacgttaagggtaacgtaaccggttaaccgtaaaaccgtacggttacggtacggtaccgtaccgtccgtaaccgttacg

SEQ ID NO: 68522 - DNA, 706 bp, Homo sapiens
  misc_feature: GYAE6OF01CR3XD.51.76.G10.1.454.CMB.1.raw
  modified_base (199)..(199): a, c, t, g, unknown or other
  misc_feature (199)..(199): n is a, c, g, or t
  modified_base (325)..(325): a, c, t, g, unknown or other
  misc_feature (325)..(325): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctaccgaggggaaanacgcccaccctctcctgcgagggccagtcagagtgttagcagcgactagcctggtaccagcagaaacctggccaggcctcccgaggctcctcatcatgatgcatccacaagggccagtgacttacncccagtccaggtttcaggtcggctaggtgggtcgtggggaactaggtacggttcctaacgtccgttaccgaacctacgttaccgaacgtccgaacggtcccgttaggacccgttaacggttaccttaagggttaaacgttacggttttttacgaacgttttaaacttttacgtttaacgttggttacctaaggtaccgtaagttaaactttaaacgtaaccgttcggtacccgttaccgttaaccgttaaccggtttttaccgggaacccggttaaaccgggggtaaccctaacggggtccgttaaggggaacgttaaaccgtacccggtaaaaacggtacgttacgggtacgtaccggttacgaccgtaaccgttaccgg

SEQ ID NO: 68523 - DNA, 574 bp, Homo sapiens
  misc_feature: GYAE6OF01EIEYT.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagagtgttagcagcgacttagcctggtaccagcagaaacctggccaggctcccaggcctcctcatctatgatgcatccacaagggccactgatactcccagccaggtcagtggcaggtggtctgggacagngttcactctacacatcagcagtcctgcagtctagtaagtactttttgactttaaattttatttaacttagtcgtaagtctaagttaattaaacttaaccgttaccggtccttaccgttaccgttaaccgttttacgggaacccggtaacggggtaacccaacggtccgtagggaacgtactaaccgaaacgtaaccgtgtacggacttcgactaccgtacg

SEQ ID NO: 68524 - DNA, 555 bp, Homo sapiens
  misc_feature: GYAE6OF01B4G7G.51.76.G10.1.454.CMB.1.raw
  modified_base (195)..(195): a, c, t, g, unknown or other
  misc_feature (195)..(195): n is a, c, g, or t
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccatggagaagtagtgatgacgcagtctccagccaccctgtctgtgtctccaggggaaangccaccctctcctgcagggccagtcagagtgtagcagcgacttagcctggtaccagcagaacctggccaggctccaggctcctcatctangatgccatccagaacgggccaagtgatacncccaagccaggttcagtggcaggtcgggtctgggacaggtacgttcactcgtcaccatcagcacgcctgcagtctagtaatacttttgacttaatttattactgtacagtacgtagttaactaagttaccgttacggtcccttaccgtacgttacgttttacgggaccgtaaggggacctaaggccgttagggactacgtaacgaaacgtaacgtcggtacggtctacgtcctacgtacg

SEQ ID NO: 68525 - DNA, 497 bp, Homo sapiens
  misc_feature: GYAE6OF01A8UFW.51.76.G10.1.454.CMB.1.raw
  modified_base (196)..(196): a, c, t, g, unknown or other
  misc_feature (196)..(196): n is a, c, g, or t
  modified_base (492)..(492): a, c, t, g, unknown or other
  misc_feature (492)..(492): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcagtgggtctgggacagagttcactctcaccatcagcagcctgcagtctgaagtatttgactaatttattactgtcagcagtataataactgtacctccgtactacgtttcggaccgtagggaccagtctggagtatacaaacgactgtagctcgcncgtac

SEQ ID NO: 68526 - DNA, 566 bp, Homo sapiens
  misc_feature: GYAE6OF01DTD64.51.76.G10.1.454.CMB.1.raw
  modified_base (317)..(317): a, c, t, g, unknown or other
  misc_feature (317)..(317): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggcctccaggctcctcatctatgatgcatccagaagggccactgatacncccagccaggttcagtggcaggtgggtctgggacagtagttcactctacaccatcagcgagccctgctaagtctagtaagtattttgacttaaattttattaactgtacagtactaagttaataagtaacgtgtcccttaccgtacttacgtttcggaccgaacggggtaccaaggtccgtagggaacgtaaacgtaaccgaaaacggttaaacgttcggtacgggtacttacggaccgtaccgtaacg

SEQ ID NO: 68527 - DNA, 521 bp, Homo sapiens
  misc_feature: GYAE6OF01A4ZPT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcaagaaacctggccaggctcccaggcctcctcatctatgatgcatccacgaagggccactgatactcccagcctaggttcagtggctaggtgggtctggggacaggtagttcacgtcctacaccactcagcacgcctgactagtctagaagtattttgactaatttacttactgtctagtctaagtataagtactggtccttccgtactacgtttggaccgagggaccaagtcgtaggagactacgaagacgtgtgactgcacgtac

SEQ ID NO: 68528 - DNA, 500 bp, Homo sapiens
  misc_feature: GYAE6OF01AK2RX.51.76.G10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (389)..(389): a, c, t, g, unknown or other
  misc_feature (389)..(389): n is a, c, g, or t
  modified_base (493)..(493): a, c, t, g, unknown or other
  misc_feature (493)..(493): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttagcagcgacttagcctggtaccagcagaacctggccaggctcccaggctcctcatctatgatgcatccacaacgggccactgatatcccagccaggttcaggtggcagtgggtctgggacagagttcactctcaccatcagcagcctgcagtctgaagtnttttgctaatttattactgtcagtctagtataataactcgtctaccgtactacgtttcggccgtacgggaccagtcgtaggagcgtacaacgaacgtggtagangcactac

SEQ ID NO: 68529 - DNA, 544 bp, Homo sapiens
  misc_feature: GYAE6OF01BYW5S.51.76.G10.1.454.CMB.1.raw
  modified_base (349)..(349): a, c, t, g, unknown or other
  misc_feature (349)..(349): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccacgtgatatcccagccaggttcagtgcagtgggtctgggacngagttcactctcaccatcagcagcctgcagtctagtagtattttgacttaatttacttacttcgtactagtctaagttataaacttaacgtcggtacccttccgttacctacgttttcggacccgtaggggaaccctaaggtcgtagggacgtagtaccaaacggtacgtaggtacggacgtcgcctaccgtacg

SEQ ID NO: 68530 - DNA, 533 bp, Homo sapiens
  misc_feature: GYAE6OF01AM5PS.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgccagggccagtcagagtgttagcagcgacttagcctggtaccagcagaacctggccaggctcccaggcctcctcatctatgatgcatccacaagggcccactgactactcccagccgtaggttcaggtggctaggtgggtctggggacaggtagttcactctacaccatcagcacgcctgcagtctagaagtatttgacttaatttattactgtcagtactaagtataatactcggtacctacgtactacgtttcggaccgtacgggacctaggtcgtaggagtactacgaaacgtacgtggtacggctcgccacgtacg

SEQ ID NO: 68531 - DNA, 574 bp, Homo sapiens
  misc_feature: GYAE6OF01AH6AQ.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagcctaggttccaggtcggcgtaggtgggtctgggacagtacgttcactctaccaccatcagcacgcctgctagtcctagaacgtattttgacttaatttacttacgtgttacgagtactaagttaataagttaaccgtacggtacccttaccgtacttacgtttcggaccgtacggggaaccctaacggtcgtaggaacgtacgtaaccgaaacggtaacgttacggtacggtactacgccgtaaccgtaccg

SEQ ID NO: 68532 - DNA, 562 bp, Homo sapiens
  misc_feature: GYAE6OF01BQOU3.51.76.G10.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (287)..(287): a, c, t, g, unknown or other
  misc_feature (287)..(287): n is a, c, g, or t
tcagcgatcgtatacacgaccggtgctcgatttagtcactcatacagggggaggaactgctcagttaggacccagacggaaccatggaagccccagcgccagcttctcttcctccgtgcctactctggctcccagatacccactggagaagtagtgatgacgcagtcctccagccaccctgtctgtgtctccagggaaangccaccctntcctgcaggccagtcagngtgttagcagcgtacttgccttggtaccagcagaacctggccaggctcccgaggctcctnatctatgattcgactatccgagacgggccagtgactacgtcccagcctaggttcaggtcgcagtgggtctggactgacgttcactcacaccatcacgcacgctcgctacgtctagtagtatttcgacttaactttattacttacgtacgtacgtacgtaagttagtaacgttaacgtcgtacctaccgttactacgtttcggaccgtacgggaccgtagtccgtaggacgtacgtaccgaaacgtacgttacgtacgtactacgtcgtccgtacg

SEQ ID NO: 68533 - DNA, 566 bp, Homo sapiens
  misc_feature: GYAE6OF01C78L3.51.76.G10.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcaagaaacctggccaggctcccaggctccncatctatgatgcatccacaagggccactgactactcccagcctaggttcagtggcaggtgggtctgggacagacgttcactctcaccatcagcagctgcagtctagaagtatttgacttaatttattacgtgtacagtactaagttagtaaacttacgttacggtacccttaccgttacttacgttttaccggaccggtacggggtaaccgtaacggtaccgtagggaacgtacgtaaccgaaaacgtacgtacggtacggacgtacggccaacgttaacg

SEQ ID NO: 68534 - DNA, 618 bp, Homo sapiens
  misc_feature: GYAE6OF01ERZ3F.51.76.G10.1.454.CMB.1.raw
  modified_base (197)..(197): a, c, t, g, unknown or other
  misc_feature (197)..(197): n is a, c, g, or t
  modified_base (434)..(434): a, c, t, g, unknown or other
  misc_feature (434)..(434): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttacgccttaggtaccagcaaggaaaccctggacccagggcctcccgaggccctcctacacttcctatgaatcgacactccaacgaacggcccatgactactcccagtccgtaggttcaggtggcagggttcgggtactgggacaggtacgttcactctaccaccatcagcgacgtctgctagtctagaagttntttagacttaattttactacgttctacacgtacgtaagtaattaacgtacgtacggtacccttaccggtaaccgttaccggtttacgggaccggtaacgggtaaccctaacgggtccgtagggtaacgtaacgttaacgaaaccggtaacggttcggtacggtacctacggtccaaccgttacg

SEQ ID NO: 68535 - DNA, 529 bp, Homo sapiens
  misc_feature: GYAE6OF01B4BBC.51.76.G10.1.454.CMB.1.raw
  modified_base (194)..(194): a, c, t, g, unknown or other
  misc_feature (194)..(194): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctcaggggaaanagccacctctcctgcagggccagtcagagtgttagcagcgacttagcctggtaccagcagaaacctggccaggctcccaggctcctnatctatgatgcatccacaagggccactgatatcccagccaaggttcaggtggcaggtgggtctgggacagtagttcactctcaccatcagcagcctgcagtctagaagtatttgactaatttattactgtacagtactaagtataataactggtacctaccgtactacgttttggaccgtacgggaccaaggtcgtaggaacgtactaacgtaaacgtaacgtcggtaggtacgtacgctaccgtacg

SEQ ID NO: 68536 - DNA, 517 bp, Homo sapiens
  misc_feature: GYAE6OF01BSVPS.51.76.G10.1.454.CMB.1.raw
  modified_base (511)..(511): a, c, t, g, unknown or other
  misc_feature (511)..(511): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatactcccagccaggttcagtggcaggtgggtctgggacagagttcactctcaccatcagcagcctgcagtctagaagtatttgactaatttattactgtcagcagttataataacgtcgtccttaccgtactacgtttcggaccgtacgggaccaaggcgtaggagtactacgaaacgtaacgtggtacggactcggccnccgtac

SEQ ID NO: 68537 - DNA, 717 bp, Homo sapiens
  misc_feature: GYAE6OF01D7J8R.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcaagaacctggccaggcctccgaggctcctcatctatgatcgctactccacgaacgggccactgactactcccgagccgaaggtttccaaggtcggactagggttcggggtactacggggactaggtacgtttccgaacttccttacgaaccctagtaccgaacgccacggtacccttggaccgtacggttaccgttaaggtaacgtttacgtttttacggaacctttaaagtttttaacgtttacgtttacgttacgtaacggttacctaaaggtttaaacttaaaacgttaaccgttaccggttacccctttacccggttaaccgtttaaccggtttttaccgggacccggttaacgggggtaaacccttaaacgggtccggttaaggggtaaccgtaacgttaaacccgaaaaccggttaacgttacgggtacggtaccgttacggacccgtaaccgtaacg

SEQ ID NO: 68538 - DNA, 527 bp, Homo sapiens
  misc_feature: GYAE6OF01B6BI3.51.76.G10.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccaccctctcctgcagggccagtcagngtgttagcagcgacttagcctggtaccagcaagaacctggccaggctcccaggctcatcatctatgatgcatccacgaacgggccactgatatcccagccaggttcaggtggcagtgggtctggggactggagttcactctcaccatcagcagccctgcagtctagaagttatttgacttaatttattactgtacagactagtaataaattactggtacctccgtactacgttttcggaccgacggggaccaggtcgtgggacgtacgtacgaaacgtacgtaggtaggctggcctaaccg

SEQ ID NO: 68539 - DNA, 589 bp, Homo sapiens
  misc_feature: GYAE6OF01A6JPL.51.76.G10.1.454.CMB.1.raw
  modified_base (196)..(196): a, c, t, g, unknown or other
  misc_feature (196)..(196): n is a, c, g, or t
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctccaggcctcctcatctatgatgcatccacgaacgggccacgtgacttacncccagcctaaggttcaggtggctaggtcgggtcngggacaggtagttcaactctcaccatcagcagcctgctagtctagtaagttattttgacttaagttttacttacgttgttacagacgtaagttaactaacttaacgtcggtacccgttaccgttaccgttacgttttcggaccgtaacggggtaaccctaaggtcgtagggaacgttacgtaaccgtaaaaccggtacgttacgggtacgtaccgttcggaccctaccgttaacg

SEQ ID NO: 68540 - DNA, 566 bp, Homo sapiens
  misc_feature: GYAE6OF01BZDG7.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacaggggggaggaactgctcagttaggacccagacggaaccatggaagccccagcgccagcttctcttcctcctgctactctggctcccagataccactggagaagtagtgatgacgcagtctccagccaccctgtctgtgtctccaggggaaangccaccctctccgtgcagggccagtcagaggtgttagcagcgacttagcctggtaccagcagaaacctggccaggctcccaggctcctcatctagtgatgcactccgacaaggggcctacgtgatactcccgagccgaggttcagtggcaggtgggtctgggacagacgttcactctcacctctcgagcgagcctgcagtctgaagtagtttcgactaagtttacttactgtacagcgtaagttactaagttactcggtaccttccgtacgtacgttttcggaccgtacggggtacctaacggtcgttagggacgtacgtaccgaaacggtacgtacgggtacggtacgtcggtccgtaccgtaaccg

SEQ ID NO: 68541 - DNA, 522 bp, Homo sapiens
  misc_feature: GYAE6OF01EAKZL.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaacctggccaggctcccaggcctcctcatctatgatgcatccacaagggccactgatatcccagccaggttcagtggcaggtgggtctgggacaggagttcactctcaccatcagcagcctgcagtctagaagtatttgactaatttattactgtcagctagtaataataacgtggtacccttaccgtactacgtttcggaccgtacggggacctaaggtcgtaggacgtatacgaaacgacgtggtacggctcgcacctacg

SEQ ID NO: 68542 - DNA, 570 bp, Homo sapiens
  misc_feature: GYAE6OF01EMVQV.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggctcccaggctcctcatctatgatgcatccacgaagggccactgatactcccagccaggttcagtggcaggtgggtctgggacagagttcactctcacatcagcacgcctgcagtctagaagtattttgacttaatttacttactgtacagtctaagttataactacgttcggtacccttcgtaccttaccgttttgggacccgtaacgggggtaaccctaagggtaccgttagggaagtaaccgtaaccgaaaacggttaaccgttggttacgggtacgtacggacctaccgttaaccg

SEQ ID NO: 68543 - DNA, 784 bp, Homo sapiens
  misc_feature: GYAE6OF01BNA2P.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccacctgtttgtgtctccgaggggaaangcccacctctcctgcagggccagtcagagtgtagcagcgacttagcctggtaccagcaagaacctggccaggcctccgaggcctctcatctatgatgccataccgaacgaacgggcctacgtcgaacttacctcccgagtcccgtaagggttactaaggtcggacgtaagggttcggggttcgtacggggactaaggtacgtttaccaccgtttcctaccaaccgtactaccgacgacccggacgtccccgtacgggaccgtaacggttccgtaagggttaaacgtttagttttttaccgtaacgttttaaaacgttttttaacgtttaaccgtttacggtttaaccgtaacgttacggttaaaagtttaaactttaaaacggttaaccggtttacccgggttaaccctttaaccccgggttttaaaccgtttacccgggttttacccggggtaacccggttaacggggggtaaacccctaaacgggttaccggttaacggggtaaagtaaccgttaaaacccggaaaacggttaaaccgttacgggttaccgggtacttaccgggaaccttaccgtacggtttacccg

SEQ ID NO: 68544 - DNA, 612 bp, Homo sapiens
  misc_feature: GYAE6OF01AFBOS.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgccaccctctcctgcagggccagtcagagtgttagcagcgacttagcctggaccagcaagaaccgtggccaggcctcccgaggcctcctcactctatgatcgactactaccgacgaacggcctactgactactcccgagccgtaggttcaggtcggctagggtcgggtcgtagggactaggtacgttccaccgttcctaccactactcgagccgacgtcctgaccgagttcgtaggaagtttctttagacttaatttacgttactagtactagtactaagttaactaacgttaccgtcgttacccttaccgttaccgttacgtttaccggaccggtaacgggtaacctaacggtccgtaggaacgtacgtaaccgtaaacgtacgttcggtacggtactacgccgtaacgtaccg

SEQ ID NO: 68545 - DNA, 649 bp, Homo sapiens
  misc_feature: GYAE6OF01E5I3J.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgccaccctctcctgcgacgggccagtcaggagtgttagcagcgacttagcctggtaccagcaacgaaacctggccaggcctacccgaggccctcctacacttactagtgactcgacactaccaaccgaacggggcccacgtgaactactcccgagtccgtaaggtttccgagggtcggacgtagggttcgggtcgtagggactaggtacgttccacgttcctaccacctatcacgcgtacgcctagcgtacgtctaggtaagtacgttttacgacgttaattttacgttacgttacgtacgtagtacttaagtaacttaacgtaacgtccggttacccttaccgtacttacggtttacgggaccgtacggggaacctaggtccgttagggaacgtacgtaacccgtaaaacggtacgttacgggttacggaccttcggaccctacgttacc

SEQ ID NO: 68546 - DNA, 748 bp, Homo sapiens
  misc_feature: GYAE6OF01D2BNA.51.76.G10.1.454.CMB.1.raw
tcagcgatcgtatacacgaccggtgctcgatttagtcactcatacagggggtagggaactgctcagttaggacccagacggaaccatggaacgccccagcgcaacgcttctcttcctcctgcctacctctcggctcccgagataccacgtgggagaacgttagttgtagtggacgcagtctccagcctaccctgtcctggtgtctccgaggggaagacgccaccctctccgtgcgagggccagtcagacgtggtacgcagcgacgttcgcctggtaccagcacgaaccgtggccaggtcctccgaggtcctcctcattctatggtagtcgacctactaccgaacgtaacgggccctaacgttcggaacttacgtaccccgaggacccgtagggtttccaacgggtcgggtaccgtacgggtttacggggttccgtaggggggaacctaaggggttacggtttcccgtaaccgtttccgtacccgaacccgtagtaccggtaacgggtccggtaacggtcccgtaggtaccgtacggttaccgttacgggtaacgtttacgttttacgacctttaacttttaaccttacgttacgtaccgtaacgtacgttaagttaagtaaacgttaacgtacggtacccgttaccgtacgttacgtttcggaccgtaacgggtaaccgtacggtcgttaggacgtacgtaaccgaaacggtacggttcggtacggtacgtacggtaccgtacgtacg

SEQ ID NO: 68547 - DNA, 573 bp, Homo sapiens
  misc_feature: GYAE6OF01EQNPF.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgttagcagcgacttagcctggtaccagcagaaacctggccaggctccaggctcctcatctatgatgcatccacaacgggccactgatactcccagcctaggttcagtggcaggtggtcgtgggacaggagttcactctcaccatcagcagccctgcacgttctaggtaagtattttagacttaattttattacgttgtctagtccgtaagttaattaaacgttaacgtcgggtacccttaccgtaacttaccgttttcgggacccgtaacggggtacccaaggtcgtagggagtaacgtaaccgtaaaacggaacgttggtacggtacctcgtaccgacctacg

SEQ ID NO: 68548 - DNA, 612 bp, Homo sapiens
  misc_feature: GYAE6OF01CM7WJ.51.76.G10.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgccaccctctcctgcagggccagtcagagtgtagcagcgacttagcctggtaccagacagaacctggccaggcctcccgaggcctcctnatctatgatgaccaactccaacgaacgggccaactgactactcccagcctaggttcaggtcggacgtaggtcgggtcgtagggaactaggtacgttaccacttccgtaccaacctactaccgacgaccgtacgcctagaccgtagttacgtagtaacgttatttacgtacttaacttttattactagttactagtactaagttaacgtaaacttaccgtacgtacccgttaccgtacttacgtttcggaccgtaaggggacctaagtcgtaggaacgtactaaccgtaaaccgtacgtacggtacgtactacgaccgtactacg

SEQ ID NO: 68549 - DNA, 571 bp, Homo sapiens
  misc_feature: GYAE6OF01BFWRZ.51.76.G10.1.454.CMB.1.raw
  modified_base (198)..(198): a, c, t, g, unknown or other
  misc_feature (198)..(198): n is a, c, g, or t
  modified_base (397)..(397): a, c, t, g, unknown or other
  misc_feature (397)..(397): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgtagcagcgacttagcctggtaccagcaagaacctggaccaggcctcccaggtcctccgtcatctatgatcgctactaccacgaacgggcccaacgtgaactactcccgagtcctaggttcaggtcggacgtaggtcgggtacgtagggactaggtacgttcacttcnccacactcgacgcacgtcctgtcagttcgagtaagttatttgacttaatttactacttgtacagtctaagttataaactacgtcggtaccttaccgtactcggtttcggacgtacgggaactacggcgtaggaactagtaaccgaaacgtacgtggtacgatcgacctcgtacg

SEQ ID NO: 68550 - DNA, 564 bp, Homo sapiens
  misc_feature: GYAE6OF01DK19S.51.76.G10.1.454.CMB.1.raw
  modified_base (196)..(196): a, c, t, g, unknown or other
  misc_feature (196)..(196): n is a, c, g, or t
  modified_base (383)..(383): a, c, t, g, unknown or other
  misc_feature (383)..(383): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctccaggcctcctcatctatgatgcatcccaagacgggccactgactactcccagccaggttcagtggctaggtgggtctgggacagagttcactctcaccatcacgtcgacncctgcgagtctacgtaagtattttacgacttaattttattaaccgttgtacgtagtaactaagttaattaacttaacgttcggtcccttacgtacttacgtttcggacccggtaggggaaccaaggtcgtaggaacggtacaaaccgtaaacgaacgttggacggtacgtgccgtactacg

SEQ ID NO: 68551 - DNA, 619 bp, Homo sapiens
  misc_feature: GYAE6OF01EH3PR.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccaccctctcctgcagggccagtcagagtgttagcagcgacttacgcctggtaccagcagaaacctggccaggcctcccgaggcctcctcatctatgatgcactaccgaacgacgggccacgtgactacctcccgacgccgtaggttcaggtcggcgtagggtgggtcgtagggactaggtacttcactctaccacactacgacgcacgtccgtgacgtacgtcgtagtaagttacgttttagtacttaattttacttacgttcgtacgagtacgtaagttaactaagttaaccgttccgtaccgttaccgttacgttaccgttttacgggaccgtacggggtaaccgtacggtacggtaggtaacggtaacgtaaccgtaaacggtaacgtacgggtacggtacgtcgtacccgtactacg

SEQ ID NO: 68552 - DNA, 722 bp, Homo sapiens
  misc_feature: GYAE6OF01DK2ZE.51.76.G10.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccagcctccaggcctcctnactctatgatcgactactacccgaacgaacgggaccctacgtcgtaactacctaccccgaagtacccgtaaggtttccgaagggttcgggaccgtagggttcggggtcgtaggggaactaggtacggtttaccaccgtttcctaccaacctacgtccgaagccgaacgtccctaggaccgtaaggttaccgttaaggtaaacgtttgtttttacggaacttttaaatttttacgtttaccgttgttacctaacggttcttaaaggttaactttaaacgttacccggttaccggttacccctttaacccggtttacgttaccggttttccgggaacccggtaaacggggtaacccctaagggttccggtaagggtaaactacgttaacccgaaaacggttacgttcgggtacgtaccgtacgtacccgtacgttaccg

SEQ ID NO: 68553 - DNA, 705 bp, Homo sapiens
  misc_feature: GYAE6OF01BR66S.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgccaccctctcctgcgagggccagtcaggagtgtagcagcgacttagcgtaggtaccagcaagaaccgtggaccaggcctacccgaggcctccctcaacttcctagtcgatcgacctactacccgaacgaaacggggcccctaacgtaggtaacttaacctaccccgaaggtcccgtaagggtttccaaggggttcggacgtaacggggttcgggttcggtaggggaacctaagggtacgtttaccaacgttccctacgaacctactaccgacggaccgaacggcccttacggtacctaaggttaccgttaaaggttaacgtttacgtttttacggtaacctttaaagtttttaccgttaacgttagttaccgtaagtactaacggtttaaataaaccgttaccgtacggttacccttacggtaccttacgtttcgggaccgtaacgggaacctagtcgtagacgtactaacgtaaacggtattcggtacgtgtacgctacgtacg

SEQ ID NO: 68554 - DNA, 537 bp, Homo sapiens
  misc_feature: GYAE6OF01DCQWC.51.76.G10.1.454.CMB.1.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttagcagcgacttagcctggtaccagcagaaacctggccaggctccagctctcatctatgatgcatccanaagggccactgatactcccagccaggttcagtggctaggtggtctgggacagngttcactcncaccntcagcagcctgctagtctagaagtattttgactaatttattactgtcagctaagttactaagtaactcggaccttaccgtactacgttttcggccgtaacggggacctaacggtcgtagggaagtactaaccgaaaacgtaccgtggttacggacgttcgacctaccgttacg

SEQ ID NO: 68555 - DNA, 512 bp, Homo sapiens
  misc_feature: GYAE6OF01CSQ5O.51.76.G10.1.454.CMB.1.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgacttagcctggtaccagcagaaacctggccaggctcccaggctcctcatctatgatgcatccanagggccactgatactcccagccaggttcagtggcagtgggtctgggacagagtcactctcacatcagcagcctgcagtctagagtattttgactaattttattactgtcagctagtataatacgtggtacctaccgtactacgtttcggaccgtacggggacctaagtcgtaggagtactacgaaacgtacgtgtacggctcgcacgtacg

SEQ ID NO: 68556 - DNA, 548 bp, Homo sapiens
  misc_feature: GYAE6OF01CG58D.51.76.G10.1.454.CMB.1.raw
  modified_base (197)..(197): a, c, t, g, unknown or other
  misc_feature (197)..(197): n is a, c, g, or t
  modified_base (359)..(359): a, c, t, g, unknown or other
  misc_feature (359)..(359): n is a, c, g, or t
  modified_base (412)..(412): a, c, t, g, unknown or other
  misc_feature (412)..(412): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgtagcagcgacttagcctggtaccagcagaacctggccaggcctcccgaggctcctcatctatgatgcactaccaacgaacgggccactgaatactcccagcctaggttccaggtggctaggtgggtcgngggacaggtacgttcacgttctcaccactcagcagcctgcagtctagtaagtnttttcgattaatttatttactgtacagtctaagtattaatacgttcgtccttaccgttacttcgtttcggaccgtacgggtaccaggtcgtaggagtactaacgaaacgtacgtcggtacggactacgccacgtac

SEQ ID NO: 68557 - DNA, 527 bp, Homo sapiens
  misc_feature: GYAE6OF01BFV14.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggcctcccaggctcctcatctatgatgcatccacaacgggccactgatatcccagccaggttccagtggcaggtgggtctggggacaggagttcactcgcacatcagcagcctgcagtctgaagtattttgactaatttatactgtcagtctaagttataatacgtcggtcccttacgtactacgttttcggaccgtacgggaccaacggtcgtaggagtactaccgaaaacgacttacggtagctcgactccgtaacg

SEQ ID NO: 68558 - DNA, 708 bp, Homo sapiens
  misc_feature: GYAE6OF01B9ZEL.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgtagcagcgacttagcctggtaccagcagaaacctggccagggcctcccgaggcctccctcatctatgactgaccactaccaacgaacgggcccaactaggactaacctcccaacggtccctaaggtttcaggtggcgtaggtcgggtcgtagggacaggtacgttccacgtcctaccacctaatccgaacgccaacggtccttacgaccgtacggttacgttaacggtaagttacgtttttaagtaccgtttaaaacgtttttaattttaaccgttacgttaaccgtaacgtaccttaaaggtttaaactttaaacgttaacccgttacggtacccctttaccggttaacccttaaccggtttttaccgggaaccccggtaacgggggtaaaccctaaacggtcggttaacgggaacggtaccgttaacccggaaaaccgtacgttaggtacggaccgttcggaaccctacccgttacg

SEQ ID NO: 68559 - DNA, 638 bp, Homo sapiens
  misc_feature: GYAE6OF01DYIUG.51.76.G10.1.454.CMB.1.raw
  modified_base (197)..(197): a, c, t, g, unknown or other
  misc_feature (197)..(197): n is a, c, g, or t
  modified_base (325)..(325): a, c, t, g, unknown or other
  misc_feature (325)..(325): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcaagaacctggccaggcctcccgaggcctcctcattcctatcgatgcactccacgaagggccatgatacnccagcctaggtcaggtgcgtaggtgggtcgtgggactaggtacttcactctccaacctatcacgcacgcctgctagtctagtaagttattttcgactttaagttttacttacgttagttacaagtacgtaagttaacgttaaacgttaaccgttcggttacccttaccggttaaccgttacggtttttaccggggaacccggtaacgggggtaaaccctaagggtaccggttaagggaacggtaaacgttaaaccggtaaaacgggtaaccgttaggggttaccggtacgttaccggccgtaacccgttacgg

SEQ ID NO: 68560 - DNA, 526 bp, Homo sapiens
  misc_feature: GYAE6OF01ANIYE.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccaggtcagagtgttagcagcgacttagcctggtaccagcagaacctggccaggctcccaggcctcctcatctatgatgcatccacgaagggccacgtgatactcccagccaggttcaggtggcaggtgggtctggggacaggtagttcactctcaccatcagcagcctgcagtctagaagtatttgctaatttattacttgtcagtctaagttataatacgtcgtacctaccgtactacgtttggccgtagggaccaaggcgtaggacgactaaccgaaacgtaacgtggtaggactacgcgacctacg

SEQ ID NO: 68561 - DNA, 696 bp, Homo sapiens
  misc_feature: GYAE6OF01DCTAU.51.76.G10.1.454.CMB.1.raw
  modified_base (209)..(209): a, c, t, g, unknown or other
  misc_feature (209)..(209): n is a, c, g, or t
tcagcgatcgtatacacgaccggtgctcgatttagtcactcatacagggggaggaactgctcagttaggacccagacggaaccatggaagcccccagcgcagcttcctcttcctcctgctactctggctcccagactaccactggaagagtagtgatgacgcagtcctccagccctaccctgtctgtcgtacctaccgaaggggaaacnccgccctaccctctccgtcgacgacgggccagtcaggagtagttacgctaggcctagttaccgcgtacgtacacgcgaaccgtaacgcggtcccaggtccctacccgaggccctcctactactctagcgtaactccgacgaccctaccgaaccgggaactaccgtactacgtacctaccgtccgaccggtcgtacgtggacggtggtacggtgtcgggtacgtacggaacttcgacgttccactacctacacgatcgacgcgcgtctgtaacgtcgttaggaactttagtttacgttaacttacgtttaatttacgcgttacgtacaagttaactaagttaaacccgtacgtaccgttacgttacccttaccggtacccgttttacgggaccgttaccggggaccggtaaaccggtacgcggttaaacggaacggtaccaaaacggtaccgtaacggttacggacgtacggtcctacgtccttaccg

SEQ ID NO: 68562 - DNA, 610 bp, Homo sapiens
  misc_feature: GYAE6OF01EPBDS.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgtagcagcgacttagcctggtaccagcaagaaacctggccaggcctcccgaggcctcctcatctatgatcgcactccacgaacgggccacgtgactactcccagccgtaggttccaggtcggacgtagggtcgggtcgtagggactaggtacgttcaccttctacacctatcgacgcacgccgtgactagtcgtagaagttagttttacgactttaattttagttacttcgtactagtactaagttaattaacgttaacgttcggtacccttaccgtaacgttaccgtttacgggacccggtaacggggaaccgtaacggtcgtagggtaagtaacgtaaccgtaaacgttacgtacggtacggtactcgaccctcgtaacg

SEQ ID NO: 68563 - DNA, 688 bp, Homo sapiens
  misc_feature: GYAE6OF01BNZO0.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggaccaggctccaggctcctcatctatgatcgcactacccaacgaacgggcccaacgtgtactactcccagccctaggttccaaggttggcctaggtcgggtcgtggggacaggtacgttcaaccttcgtacaaccctagtccaacgtccgacgtcccttcgacgtacgtaccgttaggtaacggttactttttacggactttaaattttaacgtttacgtttacggtactaacggtactaaaggtttaacttaaacgttaaccgttacggtacccgttaacccggttaccgttaacccggtttttaccgggacccggttaaacggggtaaacccgttaacgggaccggtttagggacggttaaacgtacccgaaaacggttaacgtacgggtacgggttacgtacgtacccgtaacgttaaccg

SEQ ID NO: 68564 - DNA, 531 bp, Homo sapiens
  misc_feature: GYAE6OF01COTFE.51.76.G10.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctcccaggctcctcatctatgatgcatccanaagggccatgatatcccagccaggttcagtggcaggtgggtctgggacagtagttcactctcaccatcagcagcctgcagtctagaagtattttgactaattttattacttgtcagctagtataagtactcggtccttaccgtataccgtttggaccgtaaggggtaccaaggtcgtagggaacgtactacgaaaacggtaacgttcggtacggactacgcaccgtacg

SEQ ID NO: 68565 - DNA, 731 bp, Homo sapiens
  misc_feature: GYAE6OF01BUNGN.51.76.G10.1.454.CMB.1.raw
  modified_base (198)..(198): a, c, t, g, unknown or other
  misc_feature (198)..(198): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtcgtctccgaaggggaaancgcccaccctctcctgcgaggccagtcagagtgtagcagcgattagcctggaccagcagaacctggcagctccagctcnatctangatgaccactaccaacgaacggccctaagtgaactactcccgagtaccgtaggttccagggttcggcgtaggtcgggtacgtaggggaacctaaggtacggtttaccaaccgttccgttacccaaccgtacgtaccgaaaggtccctaacggtcccgttacggaaccgttaacggttaccgttaaaggttaaagttttacgtttttacgggtaaaccttttaaactttttaaccggtaacgttacgtaaccgtaacgggttactaaaggtttaaacttaaaccgttaccggtcccggttaccgttaacccggttaccttaccggttttacgggacccggtaaacggggtaaccctaacgggtcgttaacggggaacttaaaccgtaaacccggtaaaaggttaccgttacgggtaccggttaccgtaccgtaacccgtaccgttaacg

SEQ ID NO: 68566 - DNA, 517 bp, Homo sapiens
  misc_feature: GYAE6OF01AKVRW.51.76.G10.1.454.CMB.1.raw
  modified_base (196)..(196): a, c, t, g, unknown or other
  misc_feature (196)..(196): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatccacgaacgggccatgatatcccagccaggttcaggtgcaggtcggtctggacagngttcactctcacntcagcagcctgctagtctagagtatttgacttaatttatactgtcagtcagttaataataacgtgtccttaccgtactacgtttcgaccgtacgggaccaggtcgtaggacgtcgtaccaaacggtacgtggtacggactcgcgactacg

SEQ ID NO: 68567 - DNA, 636 bp, Homo sapiens
  misc_feature: GYAE6OF01DSWKF.51.76.G10.1.454.CMB.1.raw
  modified_base (196)..(196): a, c, t, g, unknown or other
  misc_feature (196)..(196): n is a, c, g, or t
  modified_base (328)..(328): a, c, t, g, unknown or other
  misc_feature (328)..(328): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccaccctctcctgcgagggccagtcagagtgtagcagcgacttagcctggtaccagcagaaacctggccaggcctcccgaggcctcctcatctatgatgacactaccgaacaagggcccacgtgactacncccagcctaggttcaggtgcgtaggttgggctggggacaggtacgtttcacttctaccaacctatccgaagccgaacgtcccgtagacctaggtcgtagtaagttacgttttagactttaattttattaacgttgtacctaagtactaaggttaataaacgtaacgttcggtacccttaccgttacgttaccgttttacggacccggtaacggggaacctaacgggtccgtagggtaacgtaaccgttaaccggtaaaacgttaccggttacgggttacggtaccgttacgacccgtaaccgttaacg

SEQ ID NO: 68568 - DNA, 573 bp, Homo sapiens
  misc_feature: GYAE6OF01D9JGC.51.76.G10.1.454.CMB.1.raw
  modified_base (416)..(416): a, c, t, g, unknown or other
  misc_feature (416)..(416): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagacgccaccctctcctgcagggccagtcagagtgttagcagcgacttagcctggtaccagcagaaacctgccaggctcccaggctcctcatctatgatgctactccacgaacgggcccaacgtgacttactcccagcctaggttcaggtggcaggtgggtctgggacaggtagttccacttccgtacacctatcacgccagtcctgcgagtctagaagttnttttgacttaattttacttacttgtcagtactaagttaattaacgtacttcgtcccttaccgtacttacgtttcgggaccgtacggggaacctaaggtccgtagggaacgtaacgtaacgaaacgtaacgttggtacggaccttcgccgtacctacg

SEQ ID NO: 68569 - DNA, 540 bp, Homo sapiens
  misc_feature: GYAE6OF01C0NUM.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccagaagggccactgatactcccagccaggttcagtggctaggtgggtctggggacaggtagttcacttcacacatcagacagcctgcagtctgtaagtattttgtactaatttattactgtctagtactaagttaataatactcggtacctaccgttactacgttttcggaccgtacggggaaccacggtcgtaggagtacgtaacgaaacgtaacgtacggtacggctacgcctaccgtacg

SEQ ID NO: 68570 - DNA, 742 bp, Homo sapiens
  misc_feature: GYAE6OF01DCD92.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcacgaaacctcggacaggcctcccgaggcctcctacactctatgatgcatcccacgaagggccactgactacgtcccagtccgtaggttcaggtcggctagggtgggtcgtagggactagtacggtttcacttaccgtacccaaccgtacgtcacggtaccgacggtcccgtggtaccctaacgggttccgttaaggtaaaccggtttagtttttacgtaacgttttaaaacgtttttttaacgtttaacccgttacggtttaccgtaacggttaaccgttaaaggtttaaacttaaaaccggtttaaacccgttaccggggtttaccccctttaacccggttttaacccgttaaccgggttttttacccgggaaccccgggtaaacgggggtaacccgtaaaccgggtcggttaaggggaacgttaaccgttacccgtaaaaacggtacgttacgggtacggtacgttccggaccgttaaccgtacg

SEQ ID NO: 68571 - DNA, 569 bp, Homo sapiens
  misc_feature: GYAE6OF01D9U9T.51.76.G10.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (356)..(356): a, c, t, g, unknown or other
  misc_feature (356)..(356): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgtacttagcctggtaccagcagaacctggccaggctccaggctccncatctatgatgcatccacgaacgggccatgatactcccagcctaggttcagtggcaggtgggtctgggacagngttcacttctcaccatcagcacgcctgctagtctagtaagttattttagacttaattttactttacttgttacagtactaaggttaattaaacgttaacgtcggtacccttaccgttaccttacgttttcgggaccgtacggggtaacctaggtcgtagggacgtactaaccgtaaacggtaacgttcggtacggtactacgcctacgtaacg

SEQ ID NO: 68572 - DNA, 743 bp, Homo sapiens
  misc_feature: GYAE6OF01DEY0E.51.76.G10.1.454.CMB.1.raw
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggggaaanacgcccaccctctcctgcagggccagtcagngtgtagcagcgacttgcctggaccngcagaactggcaggctccaggctcctcatctatgatcgctactccaacgaacgggccacgtgatactcccgagtccgtaggtttccaggtcggacgtagggttgggtccgtaggggaactaggtacgttccaaccgtttctacccgaacctacgtaccgacggtaccgaacggtccccgtaggtccgtaacggttaccgttaagggtaaacgttttaacgttttttcggtaaaccttttaaaatttttttaaccgttttaaccgttacggttaccgtaaacggttaacctaaagggtttaaaactttaaaacgttaacccggtttaccgggtacccctttaacccgggtttaacctttaacccgggtttttaaccgggacccggtaaacgggggtaaccctaacgggtaccggtaggggtaacgtaaccgttaaacccgtaaaacggtaaccgttcgggtacggtaccgtaccggacctaccgttaccg

SEQ ID NO: 68573 - DNA, 565 bp, Homo sapiens
  misc_feature: GYAE6OF01EP7WX.51.76.G10.1.454.CMB.1.raw
  modified_base (356)..(356): a, c, t, g, unknown or other
  misc_feature (356)..(356): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgacttagcctggtaccagcagaaacctggccaggctcccaggcctcctcatctatgatgcatccacgaagggccactgatactcccagccaggttcagtggcaggtggtctgggacagngttcactctacaccatcagcagcctgtagtctagtaagtattttagacttaattttattactgtacagtactaagtaattaagtaacgtcggtacccttaccgttaacttaccgtttcggaccgtacggggtacccaaggtcgtagggtaagtaacgtaccgaaaaccggtaacgttacggtacgggaccgttagacctaccgattccg

SEQ ID NO: 68574 - DNA, 513 bp, Homo sapiens
  misc_feature: GYAE6OF01ASIB6.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccatctcctgcagggccagtcagagtgttagcagcgacttagcctggtaccagcagaaacctggccaggctcccgaggctcctcatctatgatgcatccacaagggccactgatactcccagccaggttcagtggcaggtgggtctggggacaggagttcactctcacatcagcagcctgcagtctgtaagtatttgactaatttattactgtcagtactaagtataatactcggtaccttaccgtactacgtttcggccgtagggtaccaggctaggagtaacgtacgaaacgtacttggtaggctgctacg

SEQ ID NO: 68575 - DNA, 483 bp, Homo sapiens
  misc_feature: GYAE6OF01A3UY1.51.76.G10.1.454.CMB.1.raw
  modified_base (194)..(194): a, c, t, g, unknown or other
  misc_feature (194)..(194): n is a, c, g, or t
  modified_base (478)..(478): a, c, t, g, unknown or other
  misc_feature (478)..(478): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaaacctggccaggctcccaggctcctcatctatgatgcatccacaagggccactgatatcccagccaggttcagtgcagtggctgggacagagttcactctcaccatcagcagcctgcagtctgaagtatttgctaatttattactgtcagcatataatactgtcctctactacgtttggcctagggaccagcgtaggagtactacaacgactgtaggctgcncgtac

SEQ ID NO: 68576 - DNA, 712 bp, Homo sapiens
  misc_feature: GYAE6OF01DCIOP.51.76.G10.1.454.CMB.1.raw
  modified_base (157)..(157): a, c, t, g, unknown or other
  misc_feature (157)..(157): n is a, c, g, or t
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacncagtctccagccaccctgtctgtgtctccgaggggaaanagccaccctctcctgcagggccagtcagagtgtagcagcgacttagcctaggtaccagcaagaacctggccaggcctcccaggctcctcatctatgactgcactccacgaacggcctacgtgactaacgtcccgagccgtaggttcagggtcgccgtagggttgggtacagggaactacggtacgttccgaacttccgtacaccgactccgagtaccgacgcctgccgtaagtttaccgtagtaagttacttttacggtaactttaaagttttacgttttaccgtagtaccgtaacggttaacttaacggtttaaactttaaaacgttaccggttaccgggttaccccttttaacccggttaaccgtttaccgggttttaccgggaacccgggtaaccgggggtaaccgtaacgggtacccggttaagggtaaacggtaaaccgttaaacccggtaaaacggttaacccggttagggttaccgggtaccgttaccgtaccgtaaaccgtttaccgg

SEQ ID NO: 68577 - DNA, 691 bp, Homo sapiens
  misc_feature: GYAE6OF01CX2PG.51.76.G10.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
tcagcgatcgtatacacgaccggtgctcgatttagtcactcatacaggggaggaactgctcagttaggacccagacggaaccatggaacgccccagcgcagcttctcttcctcctgctactctggcctcccagataccactggagaagtagtgatgacgcagtctccagcccaccctgtctgtcgtcctaccgaaggggaaacncgcccaccctctcctgccagggccagtcagagtgtancagcgatgcctggaccngcagaacngcagctccagcctctnatctangactgaccatacccgaacgaacgggtccaacgtgtaaactctccccgaagcccgtaagggttccaagggtcggactaggggtcgggttacgaggggaactaggtacggtttaccacgtttaccctacaaccgtacgtccgtaacggaccgacgtcccgtacggtccgtaacggttccgttaaggtaaacgtttagtttttacggaaacctttaatttttaacgtttacgttagtaaccgtacggtactaaggttaactaaaccgttaaccgtaccgtacccgttaacccgttacgttacccgtttacggacccggtaagggtaacccaagggttcgacggtaacggtaacctaaacgggaaaccgttacgttacgggtaggtaccgtaccgtccgtaacgtcg

SEQ ID NO: 68578 - DNA, 643 bp, Homo sapiens
  misc_feature: GYAE6OF01CI1Z9.51.76.G10.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (435)..(435): a, c, t, g, unknown or other
  misc_feature (435)..(435): n is a, c, g, or t
  modified_base (465)..(465): a, c, t, g, unknown or other
  misc_feature (465)..(465): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtcctccgaaggggaaancgcccacctctccngcagggccagtcagagtgtagcagcgacttagcctggtaccagcagaaacctggaccaggcctcccgaggtcctcctcatctatgatcgacactccaacgaacgggccacgtgaactactcccgagtccgtaaggttcgaaggtcggacgtagggtcgggtcgtaggacgagtacgtcactctacactatacagctacgctgactagtcgtaggaacgtttnttttacgaactttaatttttactaacgttntaccgtaagtaccgtaaagtttaataaacgttaaccgttccggtaccccgtttaccgtaacgtttacccggtttacggggacccgtaacggggtaaaccctaacgggtcgtacgggaataccgtaaaccggaaaaccgttacggtacggtacggtactaccgtaccgtaaccgttacg

SEQ ID NO: 68579 - DNA, 610 bp, Homo sapiens
  misc_feature: GYAE6OF01EZ3XR.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcactccaacgaacgggccacgtgaactactcccaagccaggttcaggtcggcaggttgggtctgggacaggtacgttccactcctaccacctatcagccacgcctgactagtctaggtaagttattttagacttaattttactttaacgttgttacgagtacgtaagttaacttaaacgtaaccgttcggttacccttacccggttaacttaccggttttacgggacccgtaacgggggaaccctaacggtcgttagggaacgtacgtaaccgaaaacgtaccgtgggtacggtaccgtacgtaccgaccgttaccg

SEQ ID NO: 68580 - DNA, 774 bp, Homo sapiens
  misc_feature: GYAE6OF01CA999.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcaacgaaacctggaccaggcctccaggctcctcatctatgatgcatccacgaacgggccactgactactcccagtcccgtaggttccagggtggaccgtagggttcgggtcgtacggggaactaggtacgtttccacgttccttaccaaccctagttccgaacggtccgaacggtcccgtacggaccgttacggttaacccgttagggtaaacgtttaacttttttacgggaaaccttttaaagttttttaacttaaccggttacgttaaccgtacgtaaccggtttaacgggtttaaccggggtttaagttttacccgtaacgtttccccggttaaccccgggttaacccgggtttaccccgggggaaaccccgtaaaacggggggtaaaccccgtaaaaagggggttaaccgggtaaaaaccgttaccgggaaaaaacccggttaacgttaccggggttaggtacccgttacgggaaccccttaaacccgttacgttacccgtttcgtttaaccccg

SEQ ID NO: 68581 - DNA, 576 bp, Homo sapiens
  misc_feature: GYAE6OF01CPC8E.51.76.G10.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcactcatacaggggaggaactgctcagttaggacccagacggaaccatggaagccccagcacagcttctcttcctcctgctactctggctcccagataccactggagaagtagtgatgacgcagtctccagccaccctgtctgtgtctccaggggaangcccaccctctcctgcagggccagtcagagtgttagcagcgacttagcctggtaccagcaagaacctggccaggcctcccaggctcctcatctatgatgcatccacgaagggccctaacgtgatactccccagccctaggttcaggtggcgaggtgggtcgtgggaactgtacgttcacttctacacctatcagcgacgcctagctagtctaggaagttattttgacttaattttacttacttgtacagtactaagttaagtaacttactacggtacccttaccgttacgttacgtttcggacccgtaacgggtaccgaaggtcgtagggaacgtaacgtaacgaaaccgttacgtcgggtacgccgtacgccgtaactacg

SEQ ID NO: 68582 - DNA, 642 bp, Homo sapiens
  misc_feature: GYAE6OF01BB1WX.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaacctggcaggctcccaggcctcctcatctatgatcgctatccaacgaacgggccaacgtcgaactaacctccccgaacggcccgtaacggttctacgggtcgggaccgtagggttcggggtcgtaggggaaccagggtacgttccaacgttccctacgaaccctagtaccgacgccacgtccctacggacctacggtcgtagtaagttagttttacgaccgttaattttactttacgtgttacgagtacctaagttaataacgttacgttccggtaccgttccgtacgttacggtttcggaacccggtaaggggtaacctaggcgttaggaacgtacgtaacgaaaaccgtacgtacggtacggtatcggactaccgttaacg

SEQ ID NO: 68583 - DNA, 577 bp, Homo sapiens
  misc_feature: GYAE6OF01C3LJY.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggaccagcaagaacctggccaggcctccaggctcctcatctatgatgcactccaacgaagggccacgtgaatactctacacgccgtaagggtttccaagggttcggacgtaggttggggtcctagggggaacctagggtagtttcaaccttctaccaaccagttacacgacaacgcccgtgctagtctagtaaggtactttgactaatttattaactgtacaagactagtaataagtaactggtaccctaccgtactactttcgggaccgtaagggaacccaaggctaggaagtaactacgaaaaccgtactaggtaggtctgcctaaccg

SEQ ID NO: 68584 - DNA, 627 bp, Homo sapiens
  misc_feature: GYAE6OF01EVSX3.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtgtctccgaggggaancgccaccctctcctgcagggccagtcagagtgtagcagcgtacttagccgtaggtaccagcaagaacctggaccaggcctcccgaggcctcctcactctatgatgcactccaacgacgggccacgtagactactcccacgcctaggttccaggtggacgtaggtcgggtacgtgggacaggtacgttaccacgttctaccgacctatcgacgacacgtccctgacctagttccgtaagtacgtttagtttacgactttaagtttacttacgttcgtactacgtactaagttaacttaacgttaaccgtacggttacccgtttaccgttaccgttacgtttacgggaccgtaacggggtaacctagggtacgtagggacgtaactaaccggtaaacgtacgttcggtacggtacctacggccctaacgtacg

SEQ ID NO: 68585 - DNA, 629 bp, Homo sapiens
  misc_feature: GYAE6OF01DPTVZ.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgcccacctctcctgcagggccagtcagagtgttagcagcgacttagcctggtaccagcagaacctggccaggctccaggctcctcatctatgatgcactccaacgaacgggcctaacgtgaactactaccccgagaccctagggtttaccaggttcgggaccgtagggtcggggtactgggggaacaggtacgtttccactcctacacctactcacgcacgtcctagctacgtctagtaacgttattttcgacttaattttattaacttgtacgtagtactaagttattaaacgttaacgttcggttaccttaccgttaacttacgttttcggaccgtaacgggggtaacctaacggtaccgttagggaacgtaacgttaccgaaaaccggttacgttacgggtacggtaccgttacggacctaccgttac

SEQ ID NO: 68586 - DNA, 598 bp, Homo sapiens
  misc_feature: GYAE6OF01DRPEU.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgagggggaaanagcccaccctctcctgcagggccagtcagagtgtagcagcacttagcctggtaccagcagaacctggccaggctcccgaggctcctcatctatgatgcactccacgaacggccatgactactcccagcctaggttcagtggcgtaggtgggtcgtgggactaggtacgttcactctacaccatcacgcacgtcctgctacgtctagtaagttattttagtacttaattttacttacgttagttactagtactaagttaacttaaacttaacgttcggtacccttaccgttaccgttaccgttttaccgggacccggtaacggggaacccgtaacggtacgtagggaacgtaacgtaaccgaaacggtaacgttggtacggacgtacgccgtaccgtacg

SEQ ID NO: 68587 - DNA, 637 bp, Homo sapiens
  misc_feature: GYAE6OF01CZQ51.51.76.G10.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgccaccctctcctgcagggccagtcagagtgttagcagcgacttagcctggtaccngacagaacctggaccaggcctcccgaggcctcctcattctagtgatcgcactccgaacgaacgggccctaacgtgaacttaccgtcccagccgtaggttcaggtggctaggtcgggtcgtaggggactacggtacgttccacgttctaccacctactacgacgtaccacgccgtgactaggtcgtagtaacgttagttttacgactttaagttttacttacgttagtaccgtacgtacgtaagttaacttaacgttaaccgtacggtcccttaccgttacgttacgtttcggaccgtacggggtaaccaaggtccgtaagggaacgtaacgttaaccgaaacggttacgttcggtacggtaccttacggaccgtaccgttaacg

SEQ ID NO: 68588 - DNA, 538 bp, Homo sapiens
  misc_feature: GYAE6OF01E31WR.51.76.G10.1.454.CMB.1.raw
  modified_base (199)..(199): a, c, t, g, unknown or other
  misc_feature (199)..(199): n is a, c, g, or t
  modified_base (320)..(320): a, c, t, g, unknown or other
  misc_feature (320)..(320): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagcccaccctgtctgtgtctccgaggggaaancgccaccctctcctgcagggccagtcagagtgtagcagcgacttagcctggtaccagcagaaacctggaccaggctcccaggcctcctcatctatgatgcatccacaagggccatgatacncccgagccaggttcaggtggctaggtgggtctgggacagtagttccactctcaccatcagcacgcctggaccaggtctagaagttatttgacttaattttactttacgtgtacgagctaagtataataacgtcgtaccttaccgtactacgtttcgggccgtagggaccaagtccgtaggacgtacgtacaaacgacgtacgtagctcgctacgtacg

SEQ ID NO: 68589 - DNA, 536 bp, Homo sapiens
  misc_feature: GYAE6OF01CARQ7.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggcctcccaggcctcctcatctatgatgcatccacaacgggccactgactactcccagcctaggttcaggtggcaggtgggtctggggactaggtacgtttcaccttctaccaccatcacgcacgcctgcagtctagtaagtattttgacttaatttacttactgtcagctagtaataactaacgtcgtccttacgtacttacgtttggccgtacgggaccacgtcgtaggagtactacgaaacgacgtggtacggatcgcacgtac

SEQ ID NO: 68590 - DNA, 584 bp, Homo sapiens
  misc_feature: GYAE6OF01AUAMN.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgccaccctctcctgcagggccagtcagagtgtagcagcgacttagcctggtaccagcagaacctggccaggcctcccgaggcctcctcatctatgatgcactccacgaacgggccacgtgactactacccagccgtaggttcaggtcggacgtaggttcgggtctaggggactaggtacgttaccaccgtcctacgaccatcgagcacgctgcgagtcgtagtaagttatttacgacttaatttacgttacgtctacgagtactaagttaataacgttaacgtcgtacccttacgttacgttacgtttcggaccgtacgggtaccaaggtcgtaggacgtacgtaacgaaacggtacgtacggtacgtactcgaccgtacgtacg

SEQ ID NO: 68591 - DNA, 693 bp, Homo sapiens
  misc_feature: GYAE6OF01C23D5.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacaggggtaggaacgtgctcagttaggacccagacggaaccatggaagccccagcgcagcttctcttcctcctgctactctggctcccagataccgactggagaagtagtgatgacgcagtctccagcccaccctgtctgtgtcctccgaggggaanagcccacctcgtcctgcagggcctagtcagagtgttagcaggcgacttagcctggtacagacaagtaaactggaccaggctacccgaggacctccgtactacttcctaatggtaactgacctagtacccaagaacgggcccaacgttgaacttaacctcccgaagtccctaaggtttcaaggttcggcgtaggtggggtacctaggggtaccaggtacgttcgaccttacgtccaacctagtaccgacgacaacgcccgttagtacgtaacgttcctaaggtaagttacgttttagttaaccgttaaatttttaaccgtacttaggttacctaaggtactaaggttaacttaaacgttaaccgttaccgtacccgttacccttacgttaccggttttcgggaacccgtacggggtaaaccgtaacggtacgtagggtaactacgtaacgtaaaccggtacgtacggtacgacttcggaaccttaccgttacgg

SEQ ID NO: 68592 - DNA, 677 bp, Homo sapiens
  misc_feature: GYAE6OF01BJ7OH.51.76.G10.1.454.CMB.1.raw
  modified_base (199)..(199): a, c, t, g, unknown or other
  misc_feature (199)..(199): n is a, c, g, or t
  modified_base (661)..(661): a, c, t, g, unknown or other
  misc_feature (661)..(661): n is a, c, g, or t
tcagcgatcgtatacacgaccggtgctcgatttagtcactcatacagggggaggaactgctcagttaggacccagacggaaccatggaagggccccagcgcagcttctcttcctcctgctactctggctcccagataccactggagaagtagtgatgacgcagtcctccagccaccctgtctgtgtctccgaggggaancgccaccctctcctgcgagggccagtcagagtgtagcagcgtacgttacgcctggtaccagacaagaaccgtggaccgaggcctcccgaggcctcctcacttctatgatcgctactccgaacgaacggccctacgtagactacctcccgagccgtaggttcgaggtcggacgtaggtcgggtacgtagggactaggtacgttccacgttacctacgaacctactaccgaacgccgtacggtcccgtagtaccgtaacggttaccgtaaggttaacgtttacgtttttacgtaaccgttttaaattttaccgttaccgtttacggtacctaaggtacttaacgttaattaaaccgttaaccgtccggttacccttaccggtaaccttccggtttacgaacccggtacgggtaaccctaggtccggtaggaactaacgtaccgtaaacggcgttggaccggtanaccggactaccgttag

SEQ ID NO: 68593 - DNA, 651 bp, Homo sapiens
  misc_feature: GYAE6OF01AFAIM.51.76.G10.1.454.CMB.1.raw
  modified_base (197)..(197): a, c, t, g, unknown or other
  misc_feature (197)..(197): n is a, c, g, or t
  modified_base (392)..(392): a, c, t, g, unknown or other
  misc_feature (392)..(392): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccctaccctctcctgcagggccagtcagagtgttagccagcgacttgcctggtaccagcaagaacctggccaggcctacccgaggcctcctcattctatgatcgcactaccgacgaagggccagttgaactactacccagccgtaggttcaggtcgcgtaggtcgggtatcggggaactaggtacgtttaccncgttaccctactaaccgactcacgtacgacggtacctcgacctagtacgtacggtaacgttattttacggtacttaaattttacgtttacgtacgttacgtaacgtacgtaaacgttaattaacgttaaaccgttcggtacccgttaccgttaccgtaacgttttcggaccggtaaccgggtaaccgaacggtcgttacggaacgtacgtaaccgtaaaacgtaacgttcggtacggtaccgtcgtaccgtaacctacg

SEQ ID NO: 68594 - DNA, 532 bp, Homo sapiens
  misc_feature: GYAE6OF01D0296.51.76.G10.1.454.CMB.1.raw
  modified_base (197)..(197): a, c, t, g, unknown or other
  misc_feature (197)..(197): n is a, c, g, or t
  modified_base (344)..(344): a, c, t, g, unknown or other
  misc_feature (344)..(344): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctccctgcagggccagtcagagtgtagcagcgacttgcctggtaccagcagaactggccaggctccaggctcctcatctatgatgcatccacgacgggccactgatactcccagccaggttcagtggcaggtgggtcnggggacaggtagttcactctacaccatcagcagcctgcagtctagtaagtattttgacttaatttattacttgtacagactaagtataatactcgtcctaccgttacttacgttttggaccgtacggggacctaagtcgtaggacggtataaccgaaacgaaccgtggtacgtcgtacgccgactacg

SEQ ID NO: 68595 - DNA, 508 bp, Homo sapiens
  misc_feature: GYAE6OF01EZPJX.51.76.G10.1.454.CMB.1.raw
  modified_base (196)..(196): a, c, t, g, unknown or other
  misc_feature (196)..(196): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatcccacaagggccacgtgatactcccagccaggttcagtggcaggtggtctggacagngttcgactctcaccatcagcagcctgcagtctagagtatttgactaagtttattactgtcagctagtataataactgtccttcgtactacgtttcggaccgtagggaccagcgtaggagtactacgaaacgacgtgtaggactcgcacgtacg

SEQ ID NO: 68596 - DNA, 656 bp, Homo sapiens
  misc_feature: GYAE6OF01DEVHE.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccaccctgtctgtgtctccgaggggaaanagcccaccctctcctgcagggccagtcagagtgtagcagcaacttagcctggtaccagcaacgaaacctggaccaggcctacccgaggcctcctcatctatgatgcactccacgaacggccactagactacgtcccagccgacggtttcaggtcggcgtaggttcgggtcgtaggggaacacggtacgttcgaccttacgtacaacctacgtaccgacgtccgacggtcccgtagaccgtaacgttacgttaggtaaagtttacgttttacggtaactttaagtttttaacgtttacgttacgttaccgtaagtacgtaatttaacgttaaacgttaaccgtccggtacccttaccgtttacgttacggttttaccggaccggtaaccgggaaccgtaacggtcgtagggaacgtacgtaaaccgtaaacgtaacgttgtacggcgtacgctaccgtacg

SEQ ID NO: 68597 - DNA, 544 bp, Homo sapiens
  misc_feature: GYAE6OF01AF1IR.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggcctcctcatctatgatgcatccaacagggccactgactactcccagccaggttcagtggcaggtcgggtcgtgggacaggtagttcactctccacatcagcacgcctgcagtctagaacgttattttagacttaattttacttacttgtactaggtctaagttataacttaacttcggtacccttaccgtacttacgtttcggccgtacggggaccaggtcgtagggacgtataccgaaacgtacgtggtacggactcggccactacg

SEQ ID NO: 68598 - DNA, 581 bp, Homo sapiens
  misc_feature: GYAE6OF01AN32F.51.76.G10.1.454.CMB.1.raw
  modified_base (196)..(196): a, c, t, g, unknown or other
  misc_feature (196)..(196): n is a, c, g, or t
  modified_base (423)..(423): a, c, t, g, unknown or other
  misc_feature (423)..(423): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccaccctctcctgcagggccagtcagagtgtagcagcgacttagcctggtaccagcagaacctggccaggcctcccaggcctcctcatctatgatcgcactccgacaacgggtcccacgtgatactcccacgccgtaggttcaggtggactaggtgggtctggggactaggtagttccacgttctaccacatccagccagcctgcgtagtcgtagaagttactttnactttaatttacttacgtgtacagtacgtaattaacttaacgttaaccgtggtacccttaccgtaccttacgtttcgggaccgtacggggaccctaaggtcgtaggaacgtactaaccgaaacgttaccgtcgggttacgccgtacgcctacgttacg

SEQ ID NO: 68599 - DNA, 695 bp, Homo sapiens
  misc_feature: GYAE6OF01BAM51.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcagggccagtcagagtgttagcagcgacttagcctggtaccagcagaacctggccaggcctccaggcctcctcatctatgatcgcatccacgaacgggccacgtgactactcccgagccgtaaggttcaggtcggacgtaggttcggggtactggggaacctaggtaacggtttccaacgttcctaccgaacctagttccgaacgtccgaacgccttacggacgtaacggttccgtaggtaacggttactttttacggactttaaagtttttacttaacgtttacgttaccgtaacgtacgttaaacgtttaacttaaacgttaaccggttaccgggtacccctttaacccggttaaccgtttaaccgttttacggggacccgttaacgggggtaacccgtaacgggtccgttaagggaacgttaaacgtaccgtaaaacggtacgttcggttaccggtactacggtacctaccgttaacg

SEQ ID NO: 68600 - DNA, 772 bp, Homo sapiens
  misc_feature: GYAE6OF01DZEP1.51.76.G10.1.454.CMB.1.raw
  modified_base (758)..(758): a, c, t, g, unknown or other
  misc_feature (758)..(758): n is a, c, g, or t
tcagcgatcgtatacacgaccggtgctcgatttagtcactcatacaggggggaggaactgactcagttaggacccagacggaaccatggaagcccctagcgcagcttctcttcctcctgctactctggctcccagataccactggagaagtagtgactgacgcagtctccagccacctgtctgtgtctaccgaggggaaacacgccaccctctacctgcgtaggaccagtccaagagtagttagactagcgtacttagacctaggtaccagacaacgaaaccgtcggaccacggcctaccgaggccttacctctagtctatcgtacttcggactaccgtacccaacgaacgggtccctaagtacggtaacttaccgacccggtagtacccgtaagggttaccaacggttcggtaccgtaagggtttccgggtaccgtacggggtaactaacggtacgtttaccgaaccgttctacccgtaaccgtaaccgttacggaacggtaccggtaccggttccgttaacgtacgtttaaccgggttacttaagggtaacgttttacgtttttacggaactttttaaaacgtttttacgtttaccgttacgttaccgaacgttaccgttaaagttaacgttaaacggttaacgttccgggttaacccttaccgtttaacgttaaccgtttaccgggacggtaaaccggggtaacctaacgggtacgttaggaacgttactaaccgtaaacgtcgtacgtcgtacnccgtacacgttacg

SEQ ID NO: 68601 - DNA, 569 bp, Homo sapiens
  misc_feature: GYAE6OF01CTK0E.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaaccgtggccaggcctcccgaggcctcctcatctatgatgcatccacacgggccatgatactcccagcctaggttcagtggctaggtgggtctgggacagtagttcacgtctcacatcacgcacgcctgcagtctagtaagtatttagtacttaattttacttacttgtacagtctaagttactaaatacgttcggtacccttaccgttacttaccgttttacggacccggtaacggggacctaaggtccgtaggaacggtacgtaaccgtaaaacggtacgttcggtacggtcgtacgccgtaccgtacg

SEQ ID NO: 68602 - DNA, 730 bp, Homo sapiens
  misc_feature: GYAE6OF01APRU6.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcgagggccagtcagtagtgtagcagcgacttagcctaggtaccagcaagaaccctggacccaggcctcccgaggtcctcctcactctatgatcgactactacccaacggaacgggccctacgtgtaactaccgtccccgaaggtcccgtaaggtttcgaagggttcggaccgtaggggtttcggggtacgtaggggaactacggtacgtttaccaccgttccacccgtaacctacgtaccgacgaccgtaccgtccgttcggacgtacgttaccgttaaggtaagtttacgttttacgtaacctttaaagtttttaactttacgttcgttaccgtaacggtaaccgttaaaggttaacttaaaccgttaccgttaccggttacccgtttaccggttaaccgttaccgggttttaccgggaacccggtaaccggggtaaccctaacggtccggtaggaacgtaacgtaaaccgtaaacgtaccgttaggtacggtacgtcgtacccgtaaccgttacg

SEQ ID NO: 68603 - DNA, 684 bp, Homo sapiens
  misc_feature: GYAE6OF01DMNW0.51.76.G10.1.454.CMB.1.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccacctctcctgcagggccagtcagagttgtagcagcgacttagcctggtaccagcaagaacctggccaggcctcccaggcctcctnatctatgatcgcatccgaacgaacgggcccagtgaactacctcccagcccgtaggttccaaggttcggacgtagggttcgggtaccgtaggggaactaggtacgtttccaacgttcctaccgaacctactaccgacggccgtacgtcccgtacgtccgtaacggttacgttaggtaacgttagtttttagtacctttaatttttaacttacgtttagttacgtagtactaagttaacttaaacgttaaccgttacggtacccgttaccgtttaacgttaccggttttacggaccggtaaccgggtaaccgtaacggtaccggtagggtaacggtaacgtaaccgtaaaacggtaaccgttacgggttacggtaccgtacggacccgtaaccgttacg

SEQ ID NO: 68604 - DNA, 796 bp, Homo sapiens
  misc_feature: GYAE6OF01ADFBX.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagacgccaccctctcctgcaggggccagtcagtagtgttagcagccgtacttacgcctaggtaccagcaacgtaaacctgggaccacggcctcccgagggcccttcctcacttcctaagtgatcgcctactacccgaacgaacggggcccacgtacgacttactcccgacgtcccgtaaggtttaccgaggtcgggacgtagggtacggggttcgttacgggggacgtaagggttacgtttcccgaacgtttcccgtacctaacccgtaacttacgaacggaccaacggtccccgttacggaccgttaacgggttaccgtttaagggtaaacggttttaacgttttttacggtaaaccgttttaaatttttaacggttttaaccgtttagggttacccgttaagggtaccgttaaagtttaaacgtttaaaccgttaaaccgttaccgggttaaccctttaccccggttaacgttaccggtttttaccggggacccggtaaaccggggtaaccctaacgggtacggtacgggtaacggtaaccgtaaaccgtaaaacgtaacgttacgggttaccggtacgttcggtacctaacccgtacg

SEQ ID NO: 68605 - DNA, 572 bp, Homo sapiens
  misc_feature: GYAE6OF01BIMXC.51.76.G10.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (433)..(433): a, c, t, g, unknown or other
  misc_feature (433)..(433): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctcctgcaggccagtcagagtgttagcagcgacttagcctggtaccagcaagaacctggaccagctcccaggctcctnatctatgatgcatccanagggccatgatacncccagcctaggttcaggtggactggtcgggtcgtgggactagtagttccacttctaccacctatcacgcacgtcctgctagttctaggaattattttacgactttaatttacttacgtntctagtacgtaattaacttaataacgtccggtaccttaccggttacttccgtttaggacccgtaggggaaccctaggtcgtaggaagtaaccgtaacgaaacggtaacgttcggtacggtacctcgacctaccgttacg

SEQ ID NO: 68606 - DNA, 522 bp, Homo sapiens
  misc_feature: GYAE6OF01BDCF4.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatccacaagggccactgatactcccagccaggttcaggtgcagtgggtctgggacagagttcacgtctcaccatcagcagcctgcagtctagaagtattttgacttaatttattacttgtctagtctaagtaataataacgtcggtcccttaccgtactacgtttcggccgtacgggaccaagtcgtaggactactacgaaacgacgtgtacggactcgcactacg

SEQ ID NO: 68607 - DNA, 579 bp, Homo sapiens
  misc_feature: GYAE6OF01COGCI.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanacgccaccctctcctgcagggccagtcagagtgttagcagcgacttagcctggtaccagacagaaacctggccaggcctcccgaggctcctcatctatgatgcatccacgaacgggccagtgactacgtcccagccgaggttcgagtggcgtaggtcgggtctaggggacaggtacgttcacgtctacactatcgacgcacgcctgcgtagtactagtagttatttcgtacttaatttattacgtgtacgagtacgtaagttaataacttacgtcggttccttaccgttacgttacgtttcggaccgtacgggtacccaaggtcgtagggacgtacgtaaccgtaaacggacgttacggtacggaccttacggcctacgtacg

SEQ ID NO: 68608 - DNA, 793 bp, Homo sapiens
  misc_feature: GYAE6OF01DPPI4.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaangccaccctctcctgcagggccagtcagagtgttagcagcgtacttagcctggtaccagacacgaaacctggacccagggcctacccgaggtcctcccgtctatctaatgatcggaccactcccgaacgaacgggcctaacgtagaacttaactccccgaacgccgtaaggttccaagggttcgggaccgtagggttcgggtcgtacgggggtaacaggttacggtttaccacttccgtaccaacctacgtaccgacggtaccgaacggtcccgtacggaccgtaacggttacgttaacggtaaacggtttaacgtttttacggttaacctttaaagttttttaacgtttttaaccggtttacggtttaccgtaacggtaaccgtttaaaggtttaaacgttaaaaccgtttaacgttaccgggttaccccctttaacccggtttacccgtttaaccggttttttaccgggacccgggtaaaccgggggtaaaccgtaacgggtacccggttaagggtaacggtaaacgttaaaccggtaaaaccggttaaaccgttacgggttacgggtaccgttaccggaccgtaacccgttaccgg

SEQ ID NO: 68609 - DNA, 548 bp, Homo sapiens
  misc_feature: GYAE6OF01E09V4.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcagaaacctggccaggctcccaggctcctcatctatgatgcatccacaagggccactgatactcccagccaggttcagtggcaggtgggtctgggacagagttcactctcaccatcagcagcctgcagtctagaagtattttgactaattttattactgtcagtctaagtaataataacgtcggtacccttaccgtactacgttttcggaccgtaacggggaaccaaggtcgtagggaacgtaacgtaccgaaaacggtaacgttaggttacggaccttcgccgaaccgtacg

SEQ ID NO: 68610 - DNA, 712 bp, Homo sapiens
  misc_feature: GYAE6OF01DCU7J.51.76.G10.1.454.CMB.1.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanacgccaccctctcctgcagggccagtcagagtgtagcagcgacttagcctggtaccagcaagaaacctggccaggctcccaggctccncatctatgatgcatccaacgaagggcccactaggactacctcccgagccgtaggttccgaggtcggcgtagggtcggtacggtgggaactagggtacttaccactttaccaccgacctacgtacgagtaccgtcgaccgtcggacgtaacgttacgaggttaagtttacgttttacggaaacttttaaactttttacttaacggttcgttaccgaagtaaccgttaaagttaaagttaaaaccgttaaccgtccgggttaccctttaaccccggttaagttttacccgggtttaccggacccgggaaacggggttaacccgaacggttaccggttaaggggaacgttaaacccgtaaaacccggtaaaaaccgggttacgttaggggtaaccccgggttcaacccgggtaaccttaacccgtttaacgg

SEQ ID NO: 68611 - DNA, 654 bp, Homo sapiens
  misc_feature: GYAE6OF01CU1ON.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgattgcctggtaccagcagaacctggccaggctccaggctctcatctatgatgacatccaacgaacgggccacgtgatacctcccagccgtaggttcaaggttggacgtagggtcgggtacgtagggggaaccaggtacgtttccaacgttcctaccaaccgtaatcgacggtaccacgtcccgtagccgtaacggttacgtaggtaaggttatttttaggtaacctttaaagtttttaactttaacgtgttaaccgtacggtaacttaaaggttaacttaaacgttaacgttcgggtaccccttaccgttacttaacggttttccgggaaccgtaacgggggaccctaaagggtccgtagggaacgtacgtaaccgaaaacggtaacgttcggtaccggctacggcctaaccgtacg

SEQ ID NO: 68612 - DNA, 566 bp, Homo sapiens
  misc_feature: GYAE6OF01B0BQP.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtagcagcgacttagcctggtaccagcagaaacctggccaggctcccaggctcctcatctatgatgcatccacgaagggccatgatactcccagccaggttcagtggctagtgggtctgggacaggagttcactctcaccatcagcagcctgctagtctagaagtattttgacttaattttattacgttgtacagtctaagttaataacttaacgtcggtacccttaccgttacttacgttttcgggaccctacgggggtaaccctaaggtccgttagggacgtacgtaaccgtaaaacggtaccgttaggttacgggaccttcggaccctaaccgtacg

SEQ ID NO: 68613 - DNA, 584 bp, Homo sapiens
  misc_feature: GYAE6OF01CABRZ.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggctcccgaggcctcctcatctatgatgcatccacgaacgggccactgatactcccagcctaggttcagtggcgtaggtgggtcgtgggacaggtacgttcaccttcgtacaccactcacgacgacgcctgactagtcgtagtaagttattttagtacttaattttatttacgttgtacgagtactaagttaattaacgttaacgtcggtaccttaccgttacgttacgttttcggaccggtacgggtaccgaacggtcgtacggagtacgtaaccgaaacgtacgttacggtacggtacgtacgaccgtacgtacg

SEQ ID NO: 68614 - DNA, 681 bp, Homo sapiens
  misc_feature: GYAE6OF01BQEWG.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagngcccaccctctcctgcagggccagtcagagtgtagcagcgacttagcctggtacccagcaacgaacctggccgacggcctcccgaggcctcctacacttctaagtgtagtgctacgtaccaacgaacgggcctacgtgtactactcccacgccgtacggttcgaggtggcgtaggtcggggtcgtagggactaggtacgttctaccgtcctaccgaaccagtccgagccgacgtccgtacgtaccgtagttacgtaggtaagtttacgttttagtaccgtttaaattttacgtttacgtacgttaccgtagtaacgtaaggtttaaacttaacgtttaaccgttaccggttacccttaacccgttacgtttaccggttttaccgggacccggtaaacggggtaacccgtaacggtcggttaacggtaaggtaaccttaaccggaaacgttaacgtcggtacggtaccacggtcctaaccgttacg

SEQ ID NO: 68615 - DNA, 592 bp, Homo sapiens
  misc_feature: GYAE6OF01BY97U.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgggagaagtagtgatgacgcagtctccagccaccctgtctgtgtctccgaggggaaancgcccaccctctcctgcagggccagtcagagtgtagcagcgacttagcctggtaccagcagaacctggccaggctccaggcctcctcatctatgatgcatacccacgaacgggccactgactactcccagccgtaggttcaggtggcgtaggtcgggtcgtaggggtacaggtacgttccacgttctccgacctactcaggcacgcctcgccgtagtcgtaggtaagtatttttgaccttaattttacttacgttcgtactagtactaagttaacttaaacgttaacgtcggtacccttaccgttaccgttacgttttcggaccgtaacggggtaccgtaacggcgtaggaacgtacgtacgaaacggtacgtggtcgtacgtcgctacctacg

SEQ ID NO: 68616 - DNA, 757 bp, Homo sapiens
  misc_feature: GYAE6OF01CULWN.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgtagcagcgacttagcctaggtaccagacaaggaaaccctggccaagggcctcccgaggcctcctcatctaagtgatcgcactacccaacgaacgggccaacgtgaactaaccgtcccgaagtccgtaggtttccaagggttcgggactagggttcgggttacgtaggggaccagggtacgtttccacgttcctaccacctaatccgacgccgtaacgtcccgtagtaccgtaacggttacgtaggttaaacggtttacgtttttaacggaacttttaaacgttttttacgtttaaccgtttacggttaaccgtaacggttaaccttaaaggtttaaactttaaacgttaaccgtttccgggtaccccctttaaccggtttaaccgtttaccggtttttaccggggaaccccgggtaaacgggggtaaccctaacgggttcgggtaacgggtaacggtaaaccgtaaccggtaaaaaccggtaacggttcgggttaacggtacgttacccgccgttaaacccgttaccg

SEQ ID NO: 68617 - DNA, 711 bp, Homo sapiens
  misc_feature: GYAE6OF01BAKT7.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccagacaagaaacctggccaggcctcccgaggcctcctcatctatgatgcactccgaacgacgggccactgactactcccacgccgtaggttcaggtcggacgtagggtcgggtcgtagggactaggtacggtttccaccgttccgtaccaacctacgtaccgacgaccgtacgtcccgtacggtaccgtacggttaccgtaacgggttaagtttacgtttttacggaactttaaacgtttttaactttaaccggttacgttaccgtaacggtaacgttaaaggtttaaacttaaacgtttaacccggttccggttaacccctttaccggttaacctttacccgggtttttacgggaaccccggtaacgggggtaaccctaacgggtaccggttagggaacgttaacgtaacccgtaaaacggtacgttcggtacggtacctacgcccgtaacgttaccg

SEQ ID NO: 68618 - DNA, 604 bp, Homo sapiens
  misc_feature: GYAE6OF01BTN16.51.76.G10.1.454.CMB.1.raw
  modified_base (195)..(195): a, c, t, g, unknown or other
  misc_feature (195)..(195): n is a, c, g, or t
  modified_base (294)..(294): a, c, t, g, unknown or other
  misc_feature (294)..(294): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanacgccaccctctcctgcagggccagtcagagtgttagcagcgtacttagcctggtaccagccaagaaaccctggaccaggcctcccgaggtcctccctnatctagtgactgacactccaacgaacgggcccagtaggaatactcccagcctaggttcaggtggcgtaggtgggtctgggacagtgttcactctcacatcacgcacgctgcgtagtctagtaagtatttacgacttaatttactttactgtaccgagtacctagttaacttaacgttaacgttacggttaccccgttaccgttaccttacgttttaccggaccggtaacggggaaccgtaacgtaccgtaggtaacgtacgtaccgaaaacggtaaccgttaggtacggttactacggaccgtacgtacg

SEQ ID NO: 68619 - DNA, 580 bp, Homo sapiens
  misc_feature: GYAE6OF01BYTL1.51.76.G10.1.454.CMB.1.raw
  modified_base (367)..(367): a, c, t, g, unknown or other
  misc_feature (367)..(367): n is a, c, g, or t
  modified_base (385)..(385): a, c, t, g, unknown or other
  misc_feature (385)..(385): n is a, c, g, or t
tcagcgatcgtatacacgaccggtgctcgatttagtcactcatacaggggaggaactgctcagttaggacccagacggaaccatggaagcccccagcgcagcttcccttcctcctgctactctgctcccacgataccactggagaagtagtgatgacgcagtctccagccaccctgtctgtgtctccgaggggaaagagccaccctctcctgcagggccagtcagagtgttagcagcgacttagccgtggtaccagacacgaaaacctcggccaaggcctccaggctccctcatctaatgactgccaatccacgaagggccatgatactcccaagctaggttcaggtgcgagtgggtctggacagtntcactctacaccatcacncgagcctagctagtctagtaagtatttgacgtaatttagttactgtacgaagtcaagttaataacgttacgtacgtcccttaccgttacgttacgtttacggccgaacggggtacctaaacggtcgtacgggtaacgagtaaccctaaacggtaaaccgttgggtacggtactacggacctaaccgtcgtttacg

SEQ ID NO: 68620 - DNA, 508 bp, Homo sapiens
  misc_feature: GYAE6OF01EONDG.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggagggactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatccacaagggccactgatatcccagccaggttcagtgcaggtggtctgggacaggattcactctcaccatcagcagcctgcagtctagaagtattttgactaatttattactgtcagtctagtataataacgtgtcctcgtactactttggaccgtagggtaccaagtcgtaggacgtataccgaaagtaacgtggtacgctacgcactacg

SEQ ID NO: 68621 - DNA, 616 bp, Homo sapiens
  misc_feature: GYAE6OF01CG8VY.51.76.G10.1.454.CMB.1.raw
  modified_base (197)..(197): a, c, t, g, unknown or other
  misc_feature (197)..(197): n is a, c, g, or t
  modified_base (324)..(324): a, c, t, g, unknown or other
  misc_feature (324)..(324): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccacctctcctgcagggccagtcagagtgtagcagcgacttagcctggtaccagcaagaacctggccaggcctcccgaggcctcctcatctatgatgacatccaacgaacggccacgtgactacncccgagcctaggttcaggtcggcgtaggtgggtcgtagggaacaggtacgttcactccgacactactccgaagccgacgtccctgacgtagttacgtaggtaagttacttttcgtaacttaaagttttaactttaacgttacgtactacggtaactaagtttaataaacgttaacgttcgttaaccttccgttacgtacgttttacggaccggtaacggggaaccgtaacgtacggtaggtaacgtaacgtaacgtaaaacgtacgtagtacgtcgtacgccgtaacgtacg

SEQ ID NO: 68622 - DNA, 728 bp, Homo sapiens
  misc_feature: GYAE6OF01DK5GP.51.76.G10.1.454.CMB.1.raw
  modified_base (197)..(197): a, c, t, g, unknown or other
  misc_feature (197)..(197): n is a, c, g, or t
  modified_base (328)..(328): a, c, t, g, unknown or other
  misc_feature (328)..(328): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctccctgcaggggccagtcagagtgttagcagcgtacttagcctaggtaccagcagaaacctggccaggcctccaggcctacctcatctatgatgctactccaacgacggcctatgataccnccgacgccgtacggttcaggtcggactagggtcggtacgacgggactaggtacgttacctacgtacctaccgaacgtactaccgaacgtccgacggttcccgtaggaccgttacgtacgttacggtaaagtttcgtttttacgtacctttaagtttttacgttaacgtcggttaacctagtaaaccgttaaggtttaaaccttaaccgtttaacgggtccccgtttacccgttaacccggtttaccgtttaccgggttttaccggggaaccccgggttaacggggggtaaaccccctaaggggttaccggttaaacggggaagttaacccgtttaaaccgggaaaaccgttcggttaacgggttcccgtaaaccgtcggtaaccccttacgttaacccgg

SEQ ID NO: 68623 - DNA, 808 bp, Homo sapiens
  misc_feature: GYAE6OF01ASYWC.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccacctctcctgcagggccagtcagagtgtagcagcgacttagcctggtaccagcaagaacctggaccaggcctcccgaggcctcctcatctatgatgcactcccacgaacgggccacgtgtactactccccagccgtacggttccaggttcggacgtaggtcgggttacgtacgggggaacctaggtacggttaccctaccgttcctaccgtaacccctagttacccgaacgccgtaaccggtccctacggaccgtaacggttccgttaaggtaaagtttacgtttttacggaacctttaaaagtttttaacctttaacgtttacggtttaccgtaagtaccgttaaagttaaaccgtttaaaacgtttaaacccggtttccgggttaaccccgttttaaccccgggtttaacccgttttaaaccgggtttttaccccgggggaaaccccgggtttaaaccggggggtaaacccccgttaaaacgggttcccggttaagggggtaaaaccggttaaacccgttaaacccggtaaaaaaccccggttaacgggttaccggggttaaccgggtaccgttaacccgggcccctaaacccggtttaaccgg

SEQ ID NO: 68624 - DNA, 626 bp, Homo sapiens
  misc_feature: GYAE6OF01CWWM2.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcaagaacctggccaggctcccaggcctctcatctatgatgcatccaacaagggccatgatatctcagcctagggtttacaggtcggacgtagggttcggggtcgttagggggacaaggtacggtttaccaccttccgtacaaccctaagtccaagccaacggcccctggacctaggttctaggaaagtttagttttacgacttaatttttacttaccgttcgtactaaggtactaagttaaacttaaagttaacgttcggtacccttaccgttaacttaccggttttcgggacccggtaggggaaccctaaggtcgttaagggtaacgtactaaccgaaaacgtacggtacggttaggccgtcgccgtaacccg

SEQ ID NO: 68625 - DNA, 504 bp, Homo sapiens
  misc_feature: GYAE6OF01AI7G7.51.76.G10.1.454.CMB.1.raw
  modified_base (197)..(197): a, c, t, g, unknown or other
  misc_feature (197)..(197): n is a, c, g, or t
  modified_base (475)..(475): a, c, t, g, unknown or other
  misc_feature (475)..(475): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagngccaccctctcctgcaggggccagtcagagtgttagcagcgacttagcctggtaccagcagaacctggccaggctcccaggctcctcatctatgatgcatccacaagggccactgactatcccagccgaggttcagtggcagtgggtctgggacagagttcactctaccacatcagcacgcctgcagtctgaagtatttgactaagtttattactgtactagctagtataatacgtgtacctaccgtactacgtttcggccgagggaccagctagganactacaaacgtagtgtgacngcnccgtac

SEQ ID NO: 68626 - DNA, 752 bp, Homo sapiens
  misc_feature: GYAE6OF01CPCLF.51.76.G10.1.454.CMB.1.raw
  modified_base (206)..(206): a, c, t, g, unknown or other
  misc_feature (206)..(206): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctcncctgcagggccagtcagagtgttagcagcgacttagcctggtaccagcagaaacctggccaggcctcccgaggcctcctcatctatgatgacactccaacgaacgggcccaactgactacgtcccgagccgtaggttcgagtcggcaggtcgggtcgtaggggacaggtacgttcgtaccttccgtacaacccgtaactaccgacggaccaacggtcccgttcggaccgtacggttacgttaggtaaacgtttacgtttttacggtactttaaacgttttttaacgtttaaccgttcggttaccgtaacggtacgtaaacggtttaaacttaaaacgttaacccgtttacgggtaccccgtttacgttacggtttaaacccgtttaccggtttttaccggggaaccccgggttaaacggggggtaaaccccgtaaacggggtaccggttaaacgggggtaaaccggtaaacgttaacccggtaaaaaacccggttaaccggttacgggttacggggtaccccgttacggtacccgttaaaccccgg

SEQ ID NO: 68627 - DNA, 647 bp, Homo sapiens
  misc_feature: GYAE6OF01BULEN.51.76.G10.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtcctccgaggggaaacngccaccctctcctgcagggccagtcagagtgttagcagcgtactagcctggtaccagcaagaaccgtggccaggcctcccgaggcctcctnactctatgatcgacataccgacgtaacgggccagtgaatacctcccgagtccgaggttcgaggtcggactagggtcgggtacgtcgggaactaggtacgttcaccgttacgtaccaacctagtaccgacggtaccaccgtccgtacggacgtacgttaccgtaaggtaatttcgttttaacgacttttaaacgttttattacgttacgttcgtaagtcgttaaaggttaactaaacgttaacgtccggtaacccgtttacgtaccgtttacgttccgggaaccgtacggggtaaccagggtacgtacggaactaacgtaaccgtaaagtcgtaggtcggactcggaccctcggtac

SEQ ID NO: 68628 - DNA, 918 bp, Homo sapiens
  misc_feature: GYAE6OF01C35EY.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagcccaccctgtctgtgtctccgaggggaaancgcccaccctctcctgcagggccagtcagagtgttagcaggcgtacttacgcctaggtaccagaccaggaaaccgtggaccgacgggccctacccgaggtcctcctacacttcctattaggatggacctactacccgaaacgaacgggggaccctaacgtcgtaacttaccttacccccgaagtccccggtaacggtttacgaacgggttacggggtccggtaagggtttcgggggttacggttacgggggaacccgttaagggttaccggttttaccgtaaccgtttacccttacccgtaaccccgtattacccgaacggttacccgaccgttacccgtacggtaccgttaacggttacccggtttaaaggttaaacggtttaccgtttttttacggaaaccttttaaacgtttttttaacgttttacccgttacggtttaccgtaacgggttaaccttaaacggttttaaaacgtttaaaacgtttaaccccgttacgggttaaccccccgtttttaacccggtttaacccgtttaacccgggtttttccggggttaaccccgggaaacccggggggttaaacccgttaaacccgggtccggtttaaaccggggttaaggttaaccccggtaaacccggttaaaaacgggttacccggtttaacgggttaccggtaaccggtttacccggaaccccggttaaaccctttaacccggg

SEQ ID NO: 68629 - DNA, 595 bp, Homo sapiens
  misc_feature: GYAE6OF01DRU8Y.51.76.G10.1.454.CMB.1.raw
  modified_base (196)..(196): a, c, t, g, unknown or other
  misc_feature (196)..(196): n is a, c, g, or t
  modified_base (415)..(415): a, c, t, g, unknown or other
  misc_feature (415)..(415): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctcctgcagggccagtcagagtgtagcagcgacttagcctggtaccagacacgaaacctggaccaggcctcccaggctcctcatctatgatgcactccaacgaacgggccactgactactcccagccaggttcaggtggacgaggtggtcgtgggacagtagttcgactctaccaccatacgagccacgtcctgctagtctagtaagttntttagacttaattttacttactgtcgaagtactaagttaataacgttaacgtcgtacccttaccgtacttacggtttacggacccggtaacggggtaaccctaaggtcggtaggtaacgtaaccgttaaccgtaaaaccggtacgttcgggtacggtcgttacggacctaccgttaaccg

SEQ ID NO: 68630 - DNA, 556 bp, Homo sapiens
  misc_feature: GYAE6OF01BUUZZ.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggcctccgaggctcctcatctatgatgcactccaacgaagggccactgatactcccagccaggttcagtggctaggtgggtctggggacaggtacgttcaccgtctaccgaacctatacacgcacgccttgacgtagtccgtagtaagttattttacggactttaaatttattactgtacagtctaagtaactaagtaactcgtacctacgttactacgtttcgaccgtagggacctaaggtcgtaggagtacgtacgaaacgtacgtggtacgacgtgactaccgtag

SEQ ID NO: 68631 - DNA, 745 bp, Homo sapiens
  misc_feature: GYAE6OF01E3OS3.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagacaagaaacctggacccaggcctacccgaggcctccctcgacttctagtgatcgacactaccaacgaacgggccatgactactcccagcctaggttcaggtcggactagggtcgggtcgtaggggactaggacgtttcaccgttctaccaacctataccgacgccgtacgtcccgtgtaccgtacggttccgtaaggtaacggtttacgtttttacggaacccttttaaagtttttaacgtttaacgttcggttaccgtaacggttaccgttaaaggtttaaacgtttaaacgttaaaccggttaccgggttaccccgtttacccggtttaaccgtttaccggtttttaccggggaaccccggtaaacggggggtaacccctaacgggttccggttaaggggaacgttaaaccgttaaacccggtaaaaccgggttaacccggttagggttaccgggaacctttaccgggaacccgtacccgttaaccgg

SEQ ID NO: 68632 - DNA, 738 bp, Homo sapiens
  misc_feature: GYAE6OF01AJV75.51.76.G10.1.454.CMB.1.raw
  modified_base (195)..(195): a, c, t, g, unknown or other
  misc_feature (195)..(195): n is a, c, g, or t
  modified_base (465)..(465): a, c, t, g, unknown or other
  misc_feature (465)..(465): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaancgccaccctctccgtgcgagggccagtcagtagtgtagcagcgtacttgccgtggtaccagcaacgaaccgtcggaccgacggtcctacccgaggtcctcctactacttactagtgtactcgactactacccgaaccggaacgggtccctaacgtacgtaaccttaccgtaccccgacggtaccgtaacggttacgtacgggtcggacggtacgggttcgggtcgtaggggaacctaggtaccgttaccgccgttacctaccaacccgtntaccgacgtcgtacgcccgttaggactacggttacgttaagtaacgtttacgttttaacgtacttttaacgttttacttacccgttgttacgtagttaaccttaagttaacgttaaacgttacccggttaccgttacccgttaaccggttacgttaccggtttacggtacccgggtaaaccgggttaccgaacgggttcggtagggtaaactacggtaaaccgtaaacgggtaccgttacgggttcggtaacctacggtaaccctcgttaacg

SEQ ID NO: 68633 - DNA, 574 bp, Homo sapiens
  misc_feature: GYAE6OF01D6P3F.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccacctgtctgtgtctccgaggggaaancgcccaccctctcctgcagggccagtcagagtgttagcagcgacttagcctggtaccagcagaacctggccaggctcccaggctcctcatctatgatgcatccacaagggccactgatactcccagccaggttcagtgcaggtgggtctgggactagagttcactctacacctatcacgacacgccgtagcacgttacgtagtaagtatttttacgactttaatttatttacgttgttacgagtacgtaagttaattaaacgtaacgttacggtcccttaccgtacttaccggttttacggaccggtacggggtaacctaaggtccgtaggtacgaactaccgtaaacggtaactggttacggactacgcgtacctacg

SEQ ID NO: 68634 - DNA, 514 bp, Homo sapiens
  misc_feature: GYAE6OF01CR29L.51.76.G10.1.454.CMB.1.raw
  modified_base (197)..(197): a, c, t, g, unknown or other
  misc_feature (197)..(197): n is a, c, g, or t
  modified_base (503)..(503): a, c, t, g, unknown or other
  misc_feature (503)..(503): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgtagcagcgacttgcctgtaccagcagaacctggccaggcctcccaggctcctcatctatgatgcatccacaagggccactgatactcccagcctaggttcagtggctaggtgggtctgggacaggtacgttcactctcaccatcagcacgcctgctagtctgtaagtattttgactaatttacttactgtcagctaatataatacgtgtcctacgtactacgtttcggaccgtacgggaccaaggctggagtactacgaaacgtacgtcgtagntacgcacgtac

SEQ ID NO: 68635 - DNA, 560 bp, Homo sapiens
  misc_feature: GYAE6OF01EBNQX.51.76.G10.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacgaagggccactgatntcccagccaggttcagtggcaggtggtcgtgggacaggacgttcaactctacacatcagcacgcctgcgagtctagaagtagttttgactaattttacttactgtacagactaagtaataataacgtcgtaccttaccgtactaccgttttcggaccgtaacggggacctaacggtccgtagggaacgtaacgtaaccgaaaaccgtaaccgtaggttaggaccgttacgccgtaaccgtaacg

SEQ ID NO: 68636 - DNA, 599 bp, Homo sapiens
  misc_feature: GYAE6OF01EUXZ7.51.76.G10.1.454.CMB.1.raw
  modified_base (196)..(196): a, c, t, g, unknown or other
  misc_feature (196)..(196): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacagggggaggaactgctcagttaggaaccagacggaaccatggaagccccagcgcagcttctcttcctcctgctactctggctcccagataccactggagaagtagtgatgacgcagtctcagccaccctgtctgtgtctccgaggggaaanagccaccctctcctgcagggccagtcagagtgttagcagcgacttagcctggtaccagcaagaaacctggccaggctccaggcctcctcatctatgatcgcatccacgaacgggccaatgatactcccagcctaggttcaggtggacgtagtgggtctgggacaggtnttcactcgtcaccatcacgcacgccgtgcagtctaggtaagttagttttagacttaagttttacttacttgtactagtactaagttaactaagttaaccgttcggtacccttaccgttacttaccggttttcggacccggtaaggggtaacccctaagggtcgttagggaacgtaacttaacccggaaaaacgtacggttacggtcggtaccgtacggtacccgtaccgttaacg

SEQ ID NO: 68637 - DNA, 629 bp, Homo sapiens
  misc_feature: GYAE6OF01DJ8RE.51.76.G10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagngtgtagcagcgacttagcctggtaccagacagaacctggaccaggcctcccgaggctcctcatctatgatgcactccaacgacgggccagtgatacncccagcctaggttcaggtcgcgtaggtgggtctgggacnggtagttcactctacactactcacgcacgcctgcgtacgtacgtagtaagttagttttacgaactttaattttactttacgttacgttacgtaagtacctaagttaacttaacgttaccgttaccggttacccgttacccggttaaccgttaccggtttttaccgggaacccggtaacgggggtacccaacgggtcgtagggaacgtaacgtaacccgaaacgtacgttacgggttacggtaccgttacggacctacccgttaacg

SEQ ID NO: 68638 - DNA, 116 bp, Homo sapiens
  misc_feature: GYAE6OF01B8MB0.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgc

SEQ ID NO: 68639 - DNA, 704 bp, Homo sapiens
  misc_feature: GYAE6OF01DS7PI.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctccctgcagggcccagtcagagtgttagcagcgacttagcctggtaccagcacgaaacctggccaggcctcccgaggctcctcatctatgatgactatccaacgacgggcctactgactactcccagcctaggttcgagtcgggcgaggttgggtcgtagggaacctaggtacgtttcaaccgttcctaccgaaccaattaccgacgaccgaacgtccgtcggctaacggttaccgtaggtaaacgtttacgttttacggtaacctttaaagtttttacgtttacgttacgttaccgtaacggtacgtaaagttaagtttaaacgttaaccggttccgggttacccttacccggttaccgttaaccggttttaccgggacccggtaaacggggtaacccgtaacgggtaccggttaagggtaacgtaaacgttaaacccgaaaaaccgtaaccggttcggttaaccgggaccttacggacccgtaacccgttaacg

SEQ ID NO: 68640 - DNA, 584 bp, Homo sapiens
  misc_feature: GYAE6OF01CAFYY.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccattggagaagtagtgatgacgcagtctccagccaccctgtctgtgtctccgaggggaaangccaccctctcctgcagggccagtcagagtgttagcagcgacttagcctggtaccagcagaacctggccaggctcccaggctcctcatctatgatgcatccacgaagggccactgactactcccagccaggttcagtggcaggtgggtctgggacagtacgttcactctcaccatcagcacgcctgcagtctagtaagtattttgacttaattttacttacgttagtactagtacgtaagttaattaaacgttaaccgttacggtacccttaccgttaccttaccgttttcgggacccgtacgggggaaccctaaggccgttagggaacggtaacgttaacccgaaaacggtacgttacggtcggtacgtacgcccgtaaccgtacg

SEQ ID NO: 68641 - DNA, 689 bp, Homo sapiens
  misc_feature: GYAE6OF01BK2VQ.51.76.G10.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaancgcccaccctctcctgcagggccagtcagagtgtagcagcgacttagcctggtaccagcagaacctggccaggcctcccaggtcctcctnactctatgatcgacactccgaagaacgggcctatagacttaccgtcccaaggtccctaggttccaaggtggactaggggttcggtcgtaggggaactaggtacgtttaccaaccgttccgtaccaacctacgtcgaacgccgtacgcccgttagaccgtagttacgtagtaaagttagttttacgactttaagttttacttacgttgtactaacgtacgtaaagttaacttaacgttaaccgttaccggtacccgttaacccgttacgtttaaccggttttaccgggaccggtaaaccggggtaaccgtaacgggtacggtagggaacgtaaccgttaaaccggaaaacgttaccggttacgggttaccggtaccgttacgtaacccgtaacccgttacg

SEQ ID NO: 68642 - DNA, 565 bp, Homo sapiens
  misc_feature: GYAE6OF01DSH6F.51.76.G10.1.454.CMB.1.raw
  modified_base (198)..(198): a, c, t, g, unknown or other
  misc_feature (198)..(198): n is a, c, g, or t
  modified_base (387)..(387): a, c, t, g, unknown or other
  misc_feature (387)..(387): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagccaccctgtctgtgtctccgaggggaaancgcccaccctctcctgcgagggccagtcagagtgtagcagcgattagcctgtaccagcagaaacctggcaggctcccaggctcctcatctatgatgcatccaacgaacgggccaactgactactcccagccaggttcaggtggctagggtggtccgtggggacagtagttcactcgtaccaccatcacncagaccctgcagtctgaagtatttgacttaatttacttactgtacgtagactagtaattaaatactacggtacccttaccgttaccgtacgttttacggaccgacggggtaccaacggtcgtagggaagtaacgaaaccgtaaacgaacgtaggtacggtactcgaccaccgttaacg

SEQ ID NO: 68643 - DNA, 552 bp, Homo sapiens
  misc_feature: GYAE6OF01EJ58R.51.76.G10.1.454.CMB.1.raw
  modified_base (373)..(373): a, c, t, g, unknown or other
  misc_feature (373)..(373): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggctcccaggctcctcatctatgatgcatccacaagggccactgatactcccagccaggttcagtggcgagtggtcgtggacagagttcactctcacatcagcngcctgcagtctagaagtattttgctaattttattactgtcagtcaagtattaataactcggtccctaccgtactacgttttcggacccgtaacgggggaaccctaaggtcgtagggtacgtacgtaacgtaaaaccggtaaacttcgggtacgggtaccgtcgcccgtaccgttaaccg

SEQ ID NO: 68644 - DNA, 513 bp, Homo sapiens
  misc_feature: GYAE6OF01A19VR.51.76.G10.1.454.CMB.1.raw
  modified_base (421)..(421): a, c, t, g, unknown or other
  misc_feature (421)..(421): n is a, c, g, or t
  modified_base (507)..(507): a, c, t, g, unknown or other
  misc_feature (507)..(507): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacgaacgggccactgatactcccagcctagtcagtggcaggtgggtctgggacagacgttcactctcaccactcacgcagtccctgcagtctagagtatttgactaatttattactgtcagtntagtataatacgtcgtcctcgtactacgtttcggaccgacggggaccaggcgtaggagtatacgaaacgtacgtcgtaggctcgcncgtacg

SEQ ID NO: 68645 - DNA, 521 bp, Homo sapiens
  misc_feature: GYAE6OF01BTEFL.51.76.G10.1.454.CMB.1.raw
  modified_base (197)..(197): a, c, t, g, unknown or other
  misc_feature (197)..(197): n is a, c, g, or t
  modified_base (403)..(403): a, c, t, g, unknown or other
  misc_feature (403)..(403): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagagtagtgatgacgcagtctccagtcaccctgtctgtgtctccgaggggaaanagcccaccctctcctgcagggccagtcagagtgttagcagcgacttagcctggtaccagcagaaacctggaccaggcctcccgaggctcctcattctatgatgcatccacagggccactgatactcccagccgaggttcaggtggcaggtgggtctgggacaggagttcaccgtctacacctatcagcagcctgcagtctagtatntttagactatttattactgtcagtcattataatactaggtccctcgtactacgtttcggccgtacgggacctagcgtggacgtataccgaaacgacgtaggtcgtactcgctcctacg

SEQ ID NO: 68646 - DNA, 509 bp, Homo sapiens
  misc_feature: GYAE6OF01BX18I.51.76.G10.1.454.CMB.1.raw
  modified_base (196)..(196): a, c, t, g, unknown or other
  misc_feature (196)..(196): n is a, c, g, or t
  modified_base (396)..(396): a, c, t, g, unknown or other
  misc_feature (396)..(396): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctccaggctcctcatctatgatgcatccacaagggcccatgatactcccagccaggttcagtggcagtgggtctggggacagtacgttcacttcctacaccatcacgcagcctgcagtctagaagtntttgactaatttattactgtcagcagtataatactgtacctcgtactacgtttcgaccgagggaccagtcgtaggagtactacaaacggacgtcggacgactcgctacgtacg

SEQ ID NO: 68647 - DNA, 584 bp, Homo sapiens
  misc_feature: GYAE6OF01AY8MM.51.76.G10.1.454.CMB.1.raw
  modified_base (197)..(197): a, c, t, g, unknown or other
  misc_feature (197)..(197): n is a, c, g, or t
  modified_base (410)..(410): a, c, t, g, unknown or other
  misc_feature (410)..(410): n is a, c, g, or t
  modified_base (433)..(433): a, c, t, g, unknown or other
  misc_feature (433)..(433): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccacctctcctgcagggccagtcagagtgttagcagcgacttagcctggtaccagcaagaaacctggccaggcctcccaggcctcctcatctatgatcgcatccaagaacgggccatgactactcccagccaggttcaggtggctaggtggtacgtgggacagtacgttcactctacacatcgacgcacgcctgactagtctagtaagtntttacgacttaatttattacgtntacagtactaagttaactaagtaacgtcggtacccttacgttacgttacgtttcggaccggtaacgggtaacctaacggtcgtagggaacgtaacgtaaccgtaaacggtaaaccgttggtaccgggtagtaccgtaccgtaccgttaacg

SEQ ID NO: 68648 - DNA, 592 bp, Homo sapiens
  misc_feature: GYAE6OF01C2GAG.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcgacgggccagtcagagtgttagcagcgtacttgcctggtaccagcaagaaaccgtggccaggcctcccaggcctcctctatctagtgatgacacgtccaagacgggccacgtgactacctcccgaggtccgtaggttcaaggtcggcgtagggttcgggtcgtaggggacaggtacttccacctcctacacctactacgacgacgacgcctagactaggttctaggtaagttattttacgactttaattttacttacttgtaccaagtcgtaagtaattaacgttacgtcgtcccttaccgttactacggtttcggaccggagggtaccaaggtcgtaggatacgtaccgtaaacgcgtagtacggatcgctcctacg

SEQ ID NO: 68649 - DNA, 688 bp, Homo sapiens
  misc_feature: GYAE6OF01BXOVF.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgttagcagcgacttagcctggtaccagcagaacctggccaggcctcccgaggcctcctcatctatgatcgcactccgacgaacgggccactgactactcccgagcctaggttcaggtcggacgtagggtgggtcgtaggggacaggtacgttcacgttcctaccacctacgtaccgagccgacgtcccgtacggaccgtacgttacgtaaggtaacgtttagtttttacgtaactttaaatttttacgtttaaccgttagttaccgaaggttaccgttaaagtttaactaaacgtttaacccgttcggttaccccgtttacccgttaaccgtttaccggttttaccgggacccggttaaacgggggaaccctaacgggtccggttaagggaacgtaaccgttaaaccggaaaaccggtaacggttacgggtacgggtacctcggaaccctaccgttacg

SEQ ID NO: 68650 - DNA, 844 bp, Homo sapiens
  misc_feature: GYAE6OF01B55OI.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagcccaccctgtctgtgtcctcgaaggggaaancgcccaccctctcctgcgagggccagtcagagtgttagcagcgacttagcctggtaccagcagaaccgtggaccaggcctacccgaggccttcctcatcctatgatcgaccatacccaacggaacgggccacgttgaactactccccgaaggtcccgtaaggtttccagggtcgggaccgtaggggtcgggttcgtaggggaactacggtagtttcccaccgttctaccgaaccctagtcgaacgaccgtaccggcccttggaccgtaacggttaccgtaaggtaaacggtttactttttacggtaacctttaaagttttttaccgttaaccgtttcgggtttaacctaacggtaacccgtttaaaggttttaaacccgtttaaaaacgttaaaccccgggtttccgggttaccccccgttttaaaccccggtttaaccgtttaaaccccgggttttttacgggggaaacccccgggtttaaaacccggggggaaaacccgtttaaacgggggtcccgttttaaaccgggggggaaacttaaacccgtttaaaccccgggtaaaaaacccgggtttaacgggtttacccgggttaacggggtaccccgtttaacgggtaaccccttaacccgggtttaaacccg

SEQ ID NO: 68651 - DNA, 558 bp, Homo sapiens
  misc_feature: GYAE6OF01DFOL1.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaagagccaccctctcctgcagggccagtcagagtgtagcagcgacttagcctggtaccagcagaaacctggcctaggcctcccgaggcctcctcatctatgatgcatccacgacgggccatagactactcccagaccgtaggttcaaggtcggcgtagggttcgggtcgtgggaccaggtacgttcacgtctacacatcagcagccgtgcgagtcgagtaagtatttacgactaagttttattactgtacagtactaagttaattaataacgtcgtaccttaccgttactacgtttcggaccggtacggaccgagcgtaggacgtacgtaccgaaacgacgttggtacgtcgtcgcgtacgtacg

SEQ ID NO: 68652 - DNA, 615 bp, Homo sapiens
  misc_feature: GYAE6OF01CK3H0.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagacgcccaccctctcctgcgagggccagtcagagtgtagcagcgacttagcctaggtaccagacagaaacctggaccaggcctcccgaggcctcctcactctatgatcgacactaccgacgaacgggcccaacgtgactactccccgagtacccgaggttaccaggttcggacgtagggttggggtactaggggactaggtacgttctactcctacaccgactacacgcagcctagactagtacgtagtaagttatttacgactttaatttacttactgtacagtactaagtaacttaagtacgtacggtaccttaccgttactacgtttacggaccgtacgggaacctacggtacgtagggacgtaacgttaacgaaacgtacggttcggtacggtaccgtacaccgtaccctaacg

SEQ ID NO: 68653 - DNA, 714 bp, Homo sapiens
  misc_feature: GYAE6OF01AUMFB.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangcccacctctcctgcagggccagtcagagtgttagcagcgacttagcctggaccagcagaacctggaccaggcctcccgaggcctcctcatctatcgatcgacactaccaacgaacgggtcccaacttgaactacgtcccaaggtcctaaggtttccaggtcgggaccgtaggtcgggtcgtaggggaacctagggtacgtttccacccttctaccaaccgtactaccgacgccgaacgtcccgttaggaccgtaacgttccgttaaggtaaacgtttacgtttttacggaactttaaactttttaacgtttaacgttacgttccgtaaaggtaccttaaacgggttaactttaaacgtaacccgttcgggtaaccccgtttacccggttaaccgtttaccggtttttaccgggacccggtaaacccggggtaacctaacggtcggttacgggtaacgtaccgttaaccgaaaaccgttacggttcggtacggtaccctaacggtcccaaccgttaccg

SEQ ID NO: 68654 - DNA, 675 bp, Homo sapiens
  misc_feature: GYAE6OF01CMHI1.51.76.G10.1.454.CMB.1.raw
  modified_base (197)..(197): a, c, t, g, unknown or other
  misc_feature (197)..(197): n is a, c, g, or t
  modified_base (354)..(354): a, c, t, g, unknown or other
  misc_feature (354)..(354): n is a, c, g, or t
  modified_base (400)..(400): a, c, t, g, unknown or other
  misc_feature (400)..(400): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagtagtgatgacgcagtctccagccaccctgtctgtcgtctccgaggggaaanacgccaccctctcctggcgagggcctaggtcagtagtgtagcagcgacttagccgtaggtaccagcgaagaaaccgtggcccgacgggcctcccgaggcccttcctctactctagtgtactgaccaatccaacgaacgggcctaacgtgaacttacnccccgaagcccgtaaggtttcagggtcggacgtagtcggggtacgnggaactaggtacgttccacttccgacacctataccgagccgtacgcctgtacgacgttctaaggtaacttagttttacgaactttaattttacgttactttgtaacgtaagtacgtaagttaacgttaaacgttaccgttacggttacccttaccgttaccggttaccgttttacgggaccccggtaaggggtaacctacgggtacgttaagggaacgtaacgtaaccgtaaaacggtacgttacggacgggttacctacggtccgtaacctacg

SEQ ID NO: 68655 - DNA, 579 bp, Homo sapiens
  misc_feature: GYAE6OF01DJGXA.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcagaaacctggccaggctccaggctcctcatctatgatgcatccacgaacgggccactgactactcccagcctaggttcaggtcggcgaggtgggtccgtgggacaggtacgttcgaactctaccacctactacacgtacacgtccctgctagtctagtaagttattttcgacttaattttacttactgtaccagtactagttaataagttacgtcggtacccttaccgttacgttacgttttcgggaccgtacgggggaacctaaggtccgtagggacgtaactaccgtaaaacggtacgtggtacggctacggcctaccgtac

SEQ ID NO: 68656 - DNA, 650 bp, Homo sapiens
  misc_feature: GYAE6OF01DO9VU.51.76.G10.1.454.CMB.1.raw
  modified_base (388)..(388): a, c, t, g, unknown or other
  misc_feature (388)..(388): n is a, c, g, or t
  modified_base (459)..(459): a, c, t, g, unknown or other
  misc_feature (459)..(459): n is a, c, g, or t
  modified_base (489)..(489): a, c, t, g, unknown or other
  misc_feature (489)..(489): n is a, c, g, or t
  modified_base (635)..(635): a, c, t, g, unknown or other
  misc_feature (635)..(635): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaacgacgacccaccctcgtccctaggcgagggcccagtcaggtagtgttagcagcgtacttacgcctggtaccagtacaacggaacctggacccagggtcctacccgaggcctcctctatcctagtgactcgacactaccgaacgacgggtcctacgtagtactaccgtacccgagtacccgtaggttaccgngggtacggcgtaggggtcgggtacgagggtacaggtacgtttaccacttacctcgaccagtaccgacgacncgtacctcgactagttacgtagttaagttnttttacacgtttaattttaccttgtactacgagtaactagttaattaacgtacgttccgtaccttaccggtacttcggtttacggaccgtaacgggtacctaggtcggtagaacggtaactaaaccgaagtacgttcgaggtaccncgtaacgccgttacg

SEQ ID NO: 68657 - DNA, 566 bp, Homo sapiens
  misc_feature: GYAE6OF01BHWTG.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcaacgaaaccgtggccaggcctcccgaggcctcctcatctatgatgcactaccacgaacgggcccactaggatactacccagccgtaggttcgacggtggcgaggttcgggtcgtaggggacaggtagttccacgtctacgacctatcgagtcgacgtcctgccgtagtccgtagtaacgtattttcgactttaatttattaacgtgtctagactaagttataagttacgtcgtcctacgttactacgtttcggaccgtagggaccgaggtcgtaggatacgtacgaaacgtacgtagtcgactgacctctcg

SEQ ID NO: 68658 - DNA, 719 bp, Homo sapiens
  misc_feature: GYAE6OF01CR7IF.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagcccacctgtctgtcgtctcgaaggggaancgcccacctctcctgcgacgggccagtcagagtgtagcagcgacttgcctaggtaccagcaacgaaaccgtcggaccgacggcctacccgaggtcctcctatactactagtcgtatcgactacgtaccgaacgaacggccctagtacgactaccgtacccgaggtacccgttaggttccaagggttcgggaccgttagggttacgggttcgtacgggaacgtaggtacgtttaccacctttaccaccgtacctacgtacacggtaccacgtcccgttacggacgtacgttacgtaacggttaagttagttttacgtaactttaaacgttttacttacgttacgtacgtaacgttacgtaaacgttacgttaaacgtacgttaccggttaccctttaaccgttaccgtttaacggtttaccggacccggtacgggtaaccttaaggtacggttaaggaacgttaaccgtaaacgtaaaaccggttcgtacgggttacgaccgttacgaccgttacgttaccg

SEQ ID NO: 68659 - DNA, 637 bp, Homo sapiens
  misc_feature: GYAE6OF01A5I8S.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagacgcccaccctctcctgcgagggccagtcagagtgttagcagcgacttagccgtggtaccagcaagaacctggccaggcctcccgaggcctcctcatcctatgatgcatcccacgaacgggcccactgactactcccgagtcctaggttcaaggtggcgaggtcgggtcgtggggactaggtacgttccacttcctaccaccataccgagcacgcctgctagtccgtagaagttactttgactttaatttacttacgtgtactagtactaagttaattaacgtaacgttacggtacccttaccgttacgttaccgttttacgggacccgtaaacgggggtaacccgtaacggtccggttaaggggaacggtaacctaaacccggtaaaacccgttaacggttacgggtacggtaccgtacggtacccgaacccgttacg

SEQ ID NO: 68660 - DNA, 616 bp, Homo sapiens
  misc_feature: GYAE6OF01D3GIH.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgccacctctcctgcagggccagtcagagtgtagcagcgacttgcctaggtaccagacaagaaacctggccacggcctcccgaggcctcctcatctatgatcgcactaccaacgacggccacgtagactacgtcccagcctaggtcaggtcggacgtaggtcgggtacgtaggggactaggtacgttccactctaccaccactcgagcgacgccgtgcgtagtcgtagtaagttagttttagactttaattttaacttacgttataccgtagtacttaagttaattaaactaacgttaccggtacccgttacgttacgttaccggtttcggaccggtaacggggtaaccaacggtcggtaaggtacgtaacgttaaaccgaaacggtacgttacgggtacggacgtacgaccgtacgtacg

SEQ ID NO: 68661 - DNA, 638 bp, Homo sapiens
  misc_feature: GYAE6OF01E4HWV.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctctagcccaccctgtctgtgtctaccgaggggaaancgcccaccctctccctgccagggccagtcagagttgtagcagtcgacttagcctggtaccagcaagaaccgtggccaggcctccgaggcctctctatctatgatcgacataccacgtaaggccacgtgactactcccgagccgtaggttcgaggtcgggcgtaggttcgggtacctagggaacagtagttccaccgttcctacaacctatccgagccgagtccctagaccgtagtacgttaagtagttacttttacgactttaaattttacgttacgtagtcgtaagacgttaagttaacttaaacgttaaccgtcggttacccttaccgtaccgtttaccggttacgggtaccggtaaaccggggaaccttaacggcggtacggtaagtaccttaacgaaaccgtacgtcggtacggacttacggaaccctcgttacg

SEQ ID NO: 68662 - DNA, 833 bp, Homo sapiens
  misc_feature: GYAE6OF01CAHZ1.51.76.G10.1.454.CMB.1.raw
  modified_base (197)..(197): a, c, t, g, unknown or other
  misc_feature (197)..(197): n is a, c, g, or t
  modified_base (322)..(322): a, c, t, g, unknown or other
  misc_feature (322)..(322): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcgaggccagtcagagtgtagcagcgactagcctggtaccagcaagaacctggccaggcctccgaggcctcctcatctatgatgacatccgacgacggccacgtgactacncccagcctaggttacaggtcggactagggtcgggtcgtcgggaacctagggtacgtttcgaccttccgtaccctaaccctaacgtccgaacggaccgtaaccggtcccgttacggtaaccgtacggtttaccgtaagggttaaacggtttaacgttttttaccggtaaaccgttttaaacttttttaaacgttttaacccggtttcggtttaaacccgaacggtttaaccgttaaacggttttaaacgttaaaaccgttttaaacccgggtttaacccgggttaaccccgttttaacccccgggtttaaaccgttttaaccccgggttttttacccgggggaaaccccggggttaaacccggggggttaaaccccgtaaaacgggggttaccggtttaaacgggggtaacgttaaaacccggtttaaaccccggtaaaaaaccgggttaccggtttacggggttaccggttacccgggtaaccggtaaccccgtttaaccgttaaacccgg

SEQ ID NO: 68663 - DNA, 640 bp, Homo sapiens
  misc_feature: GYAE6OF01AE5QG.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctntcctgcagggccagtcagagtgttagcagcgacttagcctggtaccagcagaacctggccagctccgaggcctcctcatctatgatgcatcccgaacgaacgggccctagtgaactaccgtcccagtccgtaggttcgaggtcggtactagggtcgggtcgtagggactacggtacgtttcacctccgtccaacctacgtcgacgcgacgccttcgactagttctaggtaagttagttttacgactttaacgttttacttacgttacgtactacgtacgtaagttaacttaacgttaccgtacggttacccttacccggttacttaaccggtttcggaacccggtaggggtaaccctaagggtccgtagggtaaccggtaactaaccgtaaacgttacgttacgggtacgtacgtccgtacccgtacgttaccg

SEQ ID NO: 68664 - DNA, 705 bp, Homo sapiens
  misc_feature: GYAE6OF01BIGV4.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccctacctgtctgtgtctccgagggaancgccaccctctcctgcgagggccagtcagtagtcgttagcagcgtacttagccgtaggaccagcaaacgtaaccgtcggaccacggcctcccgaggcctccgtcactctagtgattcgactacaccacgaacgggccataggtactacgcccgacgtccgtaaggttcgaggtcggacgtgggttcgggtcgtacggggactaggtacgttcctaccttactaccactactacgacgccgacgtctacgctacgtactaggtaagtttctttagtaactttacgttttaacgttacgttacgttacgaacgttacttaacgttaacgttaacgtaaccgtttcggttaaccccttaacggtttaccgttacggttttaccgggaaccggttaaccggggtaaaccgttaaacgggtccggtaagggttaaaccggtaacgttaaacccggtaaaacggttacgttaacgggtaccgttacggtaaccggtaacccgtaaccggtttacc

SEQ ID NO: 68665 - DNA, 658 bp, Homo sapiens
  misc_feature: GYAE6OF01DNPJM.51.76.G10.1.454.CMB.1.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaacngcccaccctctcctgcgagggccagtcaggagttgtagcaggcgacttagcctggtaccagcagaacctggccagcctccgagctcctnactctangatgcactccacgaacggcctagtgaactactcccgaagtccgtaaggttcgaggttcgggactacgggttcgggtacgtgggaacgtagtacggtttaccacgtcttaccacctaactcgacgccgtacgccctacggtacaacggttcgtaaggtaacgttacgttttacgtaaccgtttaaatttacgtttacgttacgtacgttaacgtacgtaaggttaaacttaacgttaaccgttaccggtacctttaaccgttaccgttacggttttacggacccggtaacggggtacctaacggtcgtaggaacgtaccgtaacgaaacggttacgtcgggtacacggtacaccgtaccgttaac

SEQ ID NO: 68666 - DNA, 788 bp, Homo sapiens
  misc_feature: GYAE6OF01BGC3N.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagacgccaccctctcctgcagggccagtcagagtgttagcagcgtacttacgcctggtaccagacaagaacctggccaggcctcccaggcctcctcacttctaagtgacttcgacctatacccaacggtaacgggcccaacgtagaacttacctcccgaacgccgtaaggtttcacggttcggacgtagggttcgggtacgtagggggtaactagggtaccgttttaccaaccgttccctaccgtaaccctacgttacccgaacggacctacccggtacccgttcggaccgttaacggttacccgttaaggtaaacgtttacggtttttacgtaacgttttaatttttaacgtttacgttaagttaccgaacgttaacgttaacgtttaaacgttaaacgtttaacccgtttacggttacccctttaacccggtttaaccgttaaccggtttttaccggggaacccggttaacgggggtaaaccccgtaacgggttaccggtaacgggtaacggtaaaccggttaaaccgtaaaaccggttaaccgttacgggtaccggttaccggtacggttacccctaacgttaacccgg

SEQ ID NO: 68667 - DNA, 642 bp, Homo sapiens
  misc_feature: GYAE6OF01BZVW9.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgttagcagcgacttagcctaggtaccagcaacgaacctggccaggcctccgaggcctcctcatctatgatgcatcccagaacggccaactgatactcccgagtccgaggttcaggtcggcgtaggtcgggtcgtggggactaggtacgtttccaaccgttctaccaaccgtactaccgaacggaccgaaccgtcccgtcgtaccgtacggttcgttaaggaagttagttttagtactttaaattttattaccgttgtactaagtacgtaagttaataacgttaacgtacgtacccgttacccgttaccttaccgttttaccgggaccgtaacgggtaacccgtaacggtcgtagggaagtacgtaaccgaaacgtacgttacggtacggtaccgtacgtcccgtaaccgtacg

SEQ ID NO: 68668 - DNA, 612 bp, Homo sapiens
  misc_feature: GYAE6OF01C4LB6.51.76.G10.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaanagccacctctcctgcagggccagtcagagtgttagcagcgacttagcctggtaccngacaacgaaacctggccaggcctcccgaggcctcctcattctatgatgcatccaacgacggccagtgactactcccgagcctaggttacagggtcggcgtaggtcgggtcgtgggactagtcgttcaacgtctacgactatcagcacgtccgtgactagtacgtagtagttatttacgtacttaattttacttacgttgtacgtagtacgtaagttaattaaacgttaaccgtacggtaccctttaccggtacttaccggttttacgggaccgtaaacggggtaccaacggtcggtagggtaacgtaacgttaacgaaacggtacgttgggtaacggtccgtacgtaccgtaccgttacg

SEQ ID NO: 68669 - DNA, 550 bp, Homo sapiens
  misc_feature: GYAE6OF01B6EHC.51.76.G10.1.454.CMB.1.raw
  modified_base (197)..(197): a, c, t, g, unknown or other
  misc_feature (197)..(197): n is a, c, g, or t
  modified_base (372)..(372): a, c, t, g, unknown or other
  misc_feature (372)..(372): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcaagaaacctggccaggcctcccaggcctcctcatctatgatgcatccacgaagggccactgatactcccagcctaggttcagtggctaggtgggtctgggacagtacgttcactcncaccatcagcacgcctgcagtctagtaagttattttgacttaatttacttactgtacagtctaagttataactacgttcgccttaccgtacttacgtttcgggaccgtacggggacctaaggtcgtagggagtacgtaaccgaaacgtacgttggtacggtactcgacctaccgtacg

SEQ ID NO: 68670 - DNA, 694 bp, Homo sapiens
  misc_feature: GYAE6OF01EXD0F.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgcgagggccagtcagagtgttagcagcgacttagcctaggtaccagcaacgaaaccgtggcccagggcctcccgaggtccctcctcattcctatgactcgcctacgtcccgaacgaacgggcccaacgtgaacttaccgtccccgaacggtcccgtaaggtttccgaagggttcgggaccgtagggttcggggtccgtaggggaactaagggtacgtttccaccgttcctaccaacctataccgacgcgacgtcctggaccgtagtctaggtaacgttagttttacgactttaattttacttacgtcgtacagtactaagttataacttacgtccggtacccttaccgttaccgttacggtttcgggacccggtaacggggaacccttaagggtcgttaaggggaacgttaaacgtaacccggtaaaacggtaccggttacgggtaccggttaccgttacggaccccgttaacgtacccg

SEQ ID NO: 68671 - DNA, 505 bp, Homo sapiens
  misc_feature: GYAE6OF01BWJ8D.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcagtgggtctgggacagagttcactctcaccatcagcagcctgcagtctagaagtatttgactaatttattactgtcagctagtataatactgtcctcgtactacgtttggaccgtagggaccaggcgtaggacgtactacgaaacgactggtacgactcgctacgtacg

SEQ ID NO: 68672 - DNA, 783 bp, Homo sapiens
  misc_feature: GYAE6OF01AMU4Q.51.76.G10.1.454.CMB.1.raw
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagcctaccctgtctgtgtctccgaggggaaancncccaccctctcctgccgagggccagtcagngtgtagcagcgacttacgccgtgtaccagtcaacgaacctcggccacggcctacccgaggtcctccgtacacttctatcgatcggacacgtacccacggtaacgggccctaacgtgtaacgtacctaccccgaacgtaccgtacggtttacgaacgggttcggacgtaacggggtttcgggttccgggtaacggggaacggtaaaccggttacggtttacccgaacccgtttaccgtaccccgaacccgttaacgttacccggaacgtaccggtaacggtcccccgtaggtacccgtaacggttcgttaaacggttaacgtttaacgttttacgtaaccgttttaaagttttacgttttaaccgttagttacccaacgggttacttaaaggtttaaccgtaacgtttaaacccgttacccggtacccttttaacccgggttactttaccgggtttacgggtaacccggtaacgggtaaccgtaacgggtacgtagggtaactaccggtaaccgtaaacgtacggtacgtacggtacacgtacccgtctaacg

SEQ ID NO: 68673 - DNA, 686 bp, Homo sapiens
  misc_feature: GYAE6OF01EOP0Y.51.76.G10.1.454.CMB.1.raw
  modified_base (204)..(204): a, c, t, g, unknown or other
  misc_feature (204)..(204): n is a, c, g, or t
tcagcgatcgtatacacgaccggtgctcgatttagtcactcatacgaggggaggaacgtgctcagttaggacccagacggaaccatggaacgccccagaccgcagcttctcttcctccttgcctactctggctcccagactaccactggagaagtagtgatgacgcagtctccagccaccctgtctgtgtctccgaaggggaancgcccacctctccgtgcagggtccagtcagagtgtacgcagcgacttagcctaggtaccaagccaagtaaaccctggacccagggcctcccgaggacctcctacagtctatcggactgaccatccgacgaacgggcccaacgtgtaactactccccgaggaccctaaggggtttccaagggttcggaccgtaagggttcgggttacctacggggactaacgggacgtttccaacttcctaaccgtaccctaagttccgacgaccgtacgtaccctagtcgtaagttaccgtagttaagttactttttagaaccgtttaaattttacgttaacgttcggttacctaaggtaccgttaacgtaacttaaacgttaaccgtcggtacccgttaccgttaacgttaccgtttacggaacccgtaggggaacctaggacgtaggagtactacgaaacgttactgtacggtacctacgccgtactacg

SEQ ID NO: 68674 - DNA, 560 bp, Homo sapiens
  misc_feature: GYAE6OF01EC76U.51.76.G10.1.454.CMB.1.raw
  modified_base (197)..(197): a, c, t, g, unknown or other
  misc_feature (197)..(197): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctacagggccagtcagagtgttagcagcgacttagcctggtaccagcagaaacctggccaggctcccaggctcctcatctatgatgcatccacaagggccactgatatcccagccaggttcagtggcaggtgggtctgggacagtagtcactcncaccatcagcacgcctgctagtctacgaagtattttgacttaattttattactgtctagctaagttaataattacgtcggtaccttccgttaactacgtttcggaccgtaacggggtacctaaggtaccgtagggtaagtaacgtaccgaaaaccgtaacgtcggtacggtactacggcctaaccgtcgtttaccg

SEQ ID NO: 68675 - DNA, 573 bp, Homo sapiens
  misc_feature: GYAE6OF01EQ29C.51.76.G10.1.454.CMB.1.raw
  modified_base (318)..(318): a, c, t, g, unknown or other
  misc_feature (318)..(318): n is a, c, g, or t
  modified_base (395)..(395): a, c, t, g, unknown or other
  misc_feature (395)..(395): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggcctcccaggctcctcatctatgatgcatccagaacgggccatgatacncccagcctaggtcaggtgcaggtgggtctgggacagtagttcactctcacatcagcagcctgctagtctaggaattnttttacgattaattttatacttgtacagtacgagtcgtagtctaagttccggtcccttcccgtacgacttccgtacccgttaccgggaccgtaaacggggtacctaaccggtacgtaacggggtaaacgaaaacggttaaaaccggacggttacggtacgggtacgtcggtaaccccg

SEQ ID NO: 68676 - DNA, 852 bp, Homo sapiens
  misc_feature: GYAE6OF01CVHUU.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtcctccgaggggaaancgcccaccctctcctgcagggccagtcagagtgtagcagcgacttagcctaggtaccagacaagaaacctgggcccaaggcctacccgaggtcctccgtcaattcctaattgaactcggacctaacttcccgaacgaaacggggcccaacgttaggaacttaaccgtccccgaaggtcccgtaagggtttccaaggggtttcgggaccgtaaggggttcggggttccgtaggggggaaccctagggtaaccggtttaccaaccgtttcccgtacccgaacctaacgttaccgtaacggtaccgaaccggtcccgttacggtaccgtaacggtttaccgttaaggttaaacgttaacgtttttacggtaacgtttaaaactttttaacgtttaacgttacggttaaccgtaacggttaaccgtaaggtttaaacgtttaaaacgttaaaccggtttaccgggttaaccccgtttaacccgggtttaaccgtttaacccggttttttacggggaaccccggttaaacggggggtaaaccccgttaaacgggtaccggttaaggggtaaacggtaaaccgttaaacccggaaaaaccggttaaccggttaacgggttacgggtaccgttaaccggtaacccgtaaacccgttaaccgg

SEQ ID NO: 68677 - DNA, 572 bp, Homo sapiens
  misc_feature: GYAE6OF01E472J.51.76.G10.1.454.CMB.1.raw
  modified_base (196)..(196): a, c, t, g, unknown or other
  misc_feature (196)..(196): n is a, c, g, or t
  modified_base (367)..(367): a, c, t, g, unknown or other
  misc_feature (367)..(367): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttagcagcgacttagcctggtaccagcagaacctggccaggctcccaggcctcctcatctatgatgcatccacaacgggccactgactatcccagcctaggttcagtggcagtgggtctgggacagagttcactctcacancagcagcctgcagtctagaagtagttttgactaattttacttactgttactagtactaagtattaaacgttaacgtcggtcccttaccgttaccgttacgttttacgggacccgtaacgggggtaaccctaagggtccgtagggaacgtaacgtaccgaaaacgtaaccgtacgggttaggaccgtcggtaccgtaaccgtaccg

SEQ ID NO: 68678 - DNA, 737 bp, Homo sapiens
  misc_feature: GYAE6OF01BKSTN.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgattttagtcactcatacagggggagggaactgctcagttaggacccagacggaaccatggaagccccagcgcgacgcttctcttcctcctgctactctggctcccagataccactggagaagtagtgatgacgcagtctccagccaccctgtctgtgtctccgaggggaancgccacctctcctgcacgggccagtcagagtgtagcagcgtactagccgtggtaccaggtacctaaggtaaaccgtcggaccaacgggcctacccggaaggtcccttaccctcattactagtaggtatcgactactcccaacgtaacgggtccaacgtaggtactaccgtacccgagtccgtaggtttcagggttcggcgtagggttcgggtacgtagggtaactacggtacgttccaacgttcctacaacctactcgacgtcgtacgtcctacgtaccgtaggttactaggttaacgttacgttttacgaactttaaagttttacgttaacgtcggttaacgaagttaccgtaaaggttaacgtaaaccgttaacgttacgggttaccctttacggttaacccgtttaccggggtttacggaacccggtaaacgggggtaacccgtaagggtaccgttaagggtaacgtaaccgttaaacggtaaaccggttacggttacggttaccgggtacctacgtaccgtaacccgttaccg

SEQ ID NO: 68679 - DNA, 540 bp, Homo sapiens
  misc_feature: GYAE6OF01BS4F9.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcaggtggcaggtgggtctggggacaggagttcactctcaccatcagcagcctgctagtctagtaagtatttgacttaatttattacttgtacagtctaagttaataataacgtcggtaccttaccgtactacgtttcggaccgtacggggtacctaaggcgtaggacgtataaccgaaacgtacgtacggtacggactcgcctaccgtacg

SEQ ID NO: 68680 - DNA, 636 bp, Homo sapiens
  misc_feature: GYAE6OF01CEZUT.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcgagggccagtcagtgtaaagttgcagcgacttagccgtggtaccagacacgaaccgtggaccaggcctcccgaggccttcctactatctatcgatcgacactccaacgacgggccagtgactactcccagccgtaggttcaggtcggcgtagggttcgggtcgtggggactaggtacgttccaccgttcctaccaacctacgtcacgccacgtcctagacgtacgtcgtagtaagttatttagtactttaagttttacttacgtgttacgtacgtcgtaagttaagttaaacgttaccgttacggtcccgttaccgttaccgttacggttttaccggaccggtacgggtaaccgtaacggtcgtaggaacgtacgtaacgaaaccgggtacgttcggtaggacctacgccgtaaccgttcg

SEQ ID NO: 68681 - DNA, 771 bp, Homo sapiens
  misc_feature: GYAE6OF01B0352.51.76.G10.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtgtctccgaggggaancgccaccctctcctgcagggccagtcagagtgttagcaggcgacttagcctggtaccagcagaacctggccaggctccaggcctccncatctatgatgctatcccaacgaacgggccactgactactcccgagccgtaggttcaggtgggacctagggtcgggtcctaggggactagggtacgtttccgaacccgttccttaccgaacctacgtaccgaaccggtaccgaacggtcccgttacggaccgttacggtttacccggttaaggtaaacggttaagtttttttacggaacttttaaaagtttttaacgttttacgtttacggttaccgtaacggtaccgttaaggtttaaacgtttaaaacgtttaaaccggttacgggttacccccgtttaacccgggtttaccgttaacccggtttttaccggggtaaccccgggtaaaccgggggtaaacccgttaaacggggtaccggttaaggggtaaacggttaaccgttaaacccggtaaaaaccgggttaaccgttacgggttaccggtaccgtttaccggaacccgtaaccgttaacccg

SEQ ID NO: 68682 - DNA, 702 bp, Homo sapiens
  misc_feature: GYAE6OF01DPV09.51.76.G10.1.454.CMB.1.raw
  modified_base (198)..(198): a, c, t, g, unknown or other
  misc_feature (198)..(198): n is a, c, g, or t
  modified_base (458)..(458): a, c, t, g, unknown or other
  misc_feature (458)..(458): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagccacctgtctgtcgtctccgaggggaaancgcccaccctctcctgcacgggccagtcagtagtgttagcagccgtacttagcctggtaccagacacgaacctggccaggcctccgagcctcctctatctatgactgcactccaacggacggccatgactacctccacgtccgtaggttccaggtcggacgtagggtcgggtcgtaggggactaggtacgttccacttacctaccgacctataccgacgacgtacgtcccgttgacgtacgttacgttaagtaacgtttnttttacggaacttttaaagtttttaccgttacgttacgttaccgtacggtaacttaaatttaaacgttaacgttaaccgttccggttaacccctttacggttaccgtttaccggtttaccggggaacccggtaacggggtaaccctaacgggtaccggttaaagggtacgtaaaccgttaaacccggaaacgttaaccggtttcggggaaccgttaccgttaaccgacccgtaacggtttaccg

SEQ ID NO: 68683 - DNA, 531 bp, Homo sapiens
  misc_feature: GYAE6OF01A9NC2.51.76.G10.1.454.CMB.1.raw
  modified_base (197)..(197): a, c, t, g, unknown or other
  misc_feature (197)..(197): n is a, c, g, or t
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggctccaggcctcctcatctatgatgcatccacgaacgggccatgatactcccagcctaggttcagtggctaggtggtctgggacagagttcactcncacactcagcacgcctgctacgtctagaagtnttttagacttaatttacttactgtacgagtctaagtataactacgtcgtaccttaccgtacttacgtttcggaccgtacgggaccaggtcgtaggagtactacgaaacgtacgtcggtacggctcgcctcgtac

SEQ ID NO: 68684 - DNA, 655 bp, Homo sapiens
  misc_feature: GYAE6OF01CKBMR.51.76.G10.1.454.CMB.1.raw
  modified_base (196)..(196): a, c, t, g, unknown or other
  misc_feature (196)..(196): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagtagtgtagcagcgacttagcctggtaccagacaagaaacctggccaggcctcccaggcctcctcatcctatgatgcactccgaacgacgggccactgactacacccagtccgtaggttcaggtcggcgtagggtggtcgtacgganagtacgttcactctacacctatccgagtccacgtcctgacgtacgtactaggtaacgttattttcgtactttaattttacgtttagtaccgttacgtaacgtaacgttaagttaacttaaacttaccgggttaccgttacccgtttacccggtttacgttaaccggttttccgggaacccggttaaccggggtaaccgtaacgggttaccgtaaggggtaacggtaaccgttaaaccgtaaaccggtaaccgttgggtaccggtctacggtaccgtaacgttacg

SEQ ID NO: 68685 - DNA, 560 bp, Homo sapiens
  misc_feature: GYAE6OF01CDHUK.51.76.G10.1.454.CMB.1.raw
  modified_base (427)..(427): a, c, t, g, unknown or other
  misc_feature (427)..(427): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcagggccagtcagagtgtagcagcgacttagcctggtaccagcagaacctggccaggctcccaggctcctcatctatgatgcatcccaacgaacgggccctacgtaggactactccccgagtccgtaggttcaggtgggactagggttcgggtcgtgggaactaggtagtttccacttcacaccatccagcacgccgtgctagtcgtagaagtntttgacttaatttattactgtacagtacgataataatacgtcgtacctccgtattacggtttggaccgtagggtaacctaggtcgtaggaacgtactaccgtaaacgacgtggtacgatcgtaccacgttacg

SEQ ID NO: 68686 - DNA, 583 bp, Homo sapiens
  misc_feature: GYAE6OF01D63ET.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagagccaccctctcctgcagggccagtcagagtgttagcagcgacttagcctggtaccagcagaacctggccaggctccagctcctcatctatgatcgcactccacgaacgggccactgactactcccagcctaggtcgaggtcggacaggtcggtcgtgggacagtacgtttcactctacaccactacgagccacgacctcgacgtagtacgtagtaacgtagttttcgacttaattttacttacgttcgtactaacgacgtaagttaattaaactacgtcgtacccgttaccgtacgttacgtttcggaccggtacggggaaccaaggtcgtagggaacgtacgtaaccgaaacggtaaccgtggtacggacctgccctaccgtacg

SEQ ID NO: 68687 - DNA, 668 bp, Homo sapiens
  misc_feature: GYAE6OF01ACPXB.51.76.G10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagngtgtagcagcgtacttagcctaggtaccagcaagaacctggaccaggcctcccgaggcctcctacactctagtgatcgcactcccgaacgaacgggcccaatagatacctcccgagtcctaggttccaggttcggacgtagggtcgggtccgtaggggaacaggtacgtttcaccgttcaccacctactacgacgccgacgtcctagacgtacgtcgtagaagtttatttacgactttaattttacgttacgtgttaccgacgtacgttaagttaacttaaacgttaaccgtacggttaccccttacccggttaccgttaccggttttcgggacccgggttaaacggggaacccgtaaggtcggtaagggtaacgtaaccgttaaaccgaaaaccggttacgttacgggtacggtaccgtacgtcccgtaaccgttaccgg

SEQ ID NO: 68688 - DNA, 713 bp, Homo sapiens
  misc_feature: GYAE6OF01DUXW0.51.76.G10.1.454.CMB.1.raw
  modified_base (196)..(196): a, c, t, g, unknown or other
  misc_feature (196)..(196): n is a, c, g, or t
  modified_base (334)..(334): a, c, t, g, unknown or other
  misc_feature (334)..(334): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgtagcagcgacttagcctggtaccagcaacgaaaccgtggaccaggcctcccgaggcctcctcactctagtgatgctactccaacgaacgggccctactgactacnccccagcctaggttcaggtggcgtagggtcgggtcgtgggaactaggtacgttccaaccgttcctacctaaccagtccgaacgccgtacgcccttgacgtacgttcgtagtaagtttacttttagaactttaagtttttaacttacgttacgtaccgtagtaaccgttaaagtttaactaaacgtttaccgttaccggttaccccgtttaccccggtttaccgtttaaccggttttccggggtaacccggtaaccgggggtaaaccccgtaacgggtaccggttaacggggaaaggttaccgttaaaaacccggtaaaacgggttaacccgttagggttaacccgggtccttacccggaacccgttaacccgttaaacg

SEQ ID NO: 68689 - DNA, 704 bp, Homo sapiens
  misc_feature: GYAE6OF01BDA1S.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtcctccgaggggaanacgcccaccctctcctgcagggccagtcagagtgttagcagcgacttagcctggtaccagcagaacctggccaggcctccgaggcctcctcatctatgatgcataccacgaacgggccactgactactcccaggccaggttcaggtcggactagggtcgggtctgggactaggtacgttcaacctctaccacctataccagccgagtcccgtagcctacgttctaggtaacgttagttttagacttaaagtttttacttaccgtttgttacctaggaaccttaagttaacttaaacgttaaccgttacggtaccccgtttacccgtttaaccgttaccgggttttaacccgggacccggttaaacggggggtaaacccctaaacgggttccggttaaagggggtaaaccgttaaaccggttaaacccgttaaaaacccggggttaaccgtttacggggttaacccggggtacctttaccccgggtacttaacccccgtttaaacgg

SEQ ID NO: 68690 - DNA, 501 bp, Homo sapiens
  misc_feature: GYAE6OF01AUVJG.51.76.G10.1.454.CMB.1.raw
  modified_base (196)..(196): a, c, t, g, unknown or other
  misc_feature (196)..(196): n is a, c, g, or t
  modified_base (496)..(496): a, c, t, g, unknown or other
  misc_feature (496)..(496): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccaggtcagagtgttagcagcgacttagcctggtaccagcagaacctggccaggctcccaggctcctcatctatgatgcatccacaagggccatgatactccagccaggttcagtggcagtgggtctggacagagttcactctcaccatcagcagcctgcagtcgtagagtacttttgacttaatttatacttgtcagtcaagttataatactcgtccttcgtactcgttcggacctagggacctaggcgtaggactatacgaagtacgtgtagactcgcnctacg

SEQ ID NO: 68691 - DNA, 712 bp, Homo sapiens
  misc_feature: GYAE6OF01C799Z.51.76.G10.1.454.CMB.1.raw
  modified_base (199)..(199): a, c, t, g, unknown or other
  misc_feature (199)..(199): n is a, c, g, or t
  modified_base (264)..(264): a, c, t, g, unknown or other
  misc_feature (264)..(264): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagactaccactggagaagtagtgatgacgcagtctccacgcccacctgtctgtgtcctacgaaggggaancgcccaccctctccgtgccgacgggccagtcagtaggtgtagcagcgacttagccgtaggtaccngcaagaacctggaccgaggcctcccgaggtcctccctcgtattccgtatgatcgaccactacccgaacggtaccgggcctactacgtaactaaccgtcccgaaggtaccccgttaaggttaccgaagggtcgggtacgtacggggtttacggggtaccgtagggggtaaccctaagggtttaccgttaccctaccgttccctaaccgaaccgtacgtaccgaggtcccgacgtccgttacgacgtacgtacgtaagtacgtttagtttacgtaatttaacttttacttacgtagtaccgtaagtacgttaattaacgttaaacgttaccggtaccgttaccccgttaccggttacgttacggtttcggaacccggtacgggtaaccgtacggtacgaggtacgtaactaaccggaacgttagtcggtacgcgttacgcccgtcgtacg

SEQ ID NO: 68692 - DNA, 649 bp, Homo sapiens
  misc_feature: GYAE6OF01CSBZS.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgtagcagcgacttagcctggtaccagcaagaaacctggccaggcctcccgaggcctcctcatctatgatcgcactcccaacgaacgggccacgtagatactcccagcccgtaggttcaggtggcgagggtgggtcgtgggaacaggtacgtttcacgttcctacacctatccgagccacgtccctggacctagtaccgtaggtaacgttatttttagactttaaacttttatttacgttagtacgtagtaacttaagttaaactaaacgttacgttacggtacccttaccgttacttacggtttacggacccggtaacggggtaacctaacgggtccgtagggtaacggtaaaccgttaaccggtaaaaaccggttacgttacgggtaccggtactacccggaccctacccgttaaccgg

SEQ ID NO: 68693 - DNA, 835 bp, Homo sapiens
  misc_feature: GYAE6OF01CM161.51.76.G10.1.454.CMB.1.raw
tcagcgatcgtatacacgaccggtgctcgatttagtcactcatacagggggaggaacgtgcctcacgttagggaccctacgaacggaaccattcggaacgtcccgagcgcagcttctcttacctctgctactctggctccgagtacgtccacgtggacgtaaggttcgttgtacttggaccgtcgaaggttctccagtcctaccgttgtctgtgtctcggaggggaagacgggccacctcgtccgtgggcacggcagtcacgtgtgtagcacgcgacttcgctagtaccagctacgtaacctcggccaggtcctccgcgacgtcctctacggtcgtagtagctcggctacgtaccaacgaacgggtcctaccgttaggtacgtaactcccggagtaccggttcgtcgtaacggttcggaccgtacgggttcggtaccgttggggaacgtacggttaccgttacgtaaccttccgtaaccgtacctacgttaacgacgggtaacctaccgggtacccttaacgaacccggttcgttacccggttaaggttaccggtttaacgttttcgggtaaacctttaacgttttaccgttaacccgttacggttacggtaaaccgtccgtaaaggtttacccgaaaaccgtttaccgggtaccgttaaccgtttaccgttaacctttcggggtttaaccgggacccgggtaaacgggtacccttaaaaggggttacccgttaacggggtaaccgttaaacggtaccgtaaaacccgggtttacggggttcgggttaacccggggtaccttaacccgggtacccgtttaaaccccgggttccgg

SEQ ID NO: 68694 - DNA, 587 bp, Homo sapiens
  misc_feature: GYAE6OF01CKIAO.51.76.G10.1.454.CMB.1.raw
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
  modified_base (514)..(514): a, c, t, g, unknown or other
  misc_feature (514)..(514): n is a, c, g, or t
  modified_base (574)..(574): a, c, t, g, unknown or other
  misc_feature (574)..(574): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagccaccctgtctgtgtcctcgaggggaaanacgcccacctctcctgcgagggccagtcagagtgttagcagcgacttgccgtggtaccagcaagaacctggccaggcctccaggcctcctnatctatgatcgcactccgaacgacgggccatgatactcccagcctaggttcgaggtggacgtagggtgggtcgtagggaactaggtacgttcaacctcgtccgtaaccacgttccaacgtccgtacggtccctagaccgtagttaccgtaggtaacgttattttcgaactttaaagtttcttaacgtgtacagtactagttaactaatacgtcgtacctaccgtnttacgtttcggaccgtagggaccaggtctagggactactaacgaaacgtgtacgtacggntacgctccttacg

SEQ ID NO: 68695 - DNA, 717 bp, Homo sapiens
  misc_feature: GYAE6OF01C9ATA.51.76.G10.1.454.CMB.1.raw
  modified_base (195)..(195): a, c, t, g, unknown or other
  misc_feature (195)..(195): n is a, c, g, or t
  modified_base (337)..(337): a, c, t, g, unknown or other
  misc_feature (337)..(337): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgccaccctctcctgcgagggccagtcagagtgttagcagcgtacttagcctggtaccagcagaaccgtggaccaggcctcccgaggtcctccgtctactctatgatcgcactccgaacgacgggcctacgtagactaccncccgacgacctaggttccgaggtcggcgtaggtcgggtacgtacgggactaggtacgttaccacttcctaccaacctacgtaccacggccgtacgtccgtacgaccgtaggttcctaaggttaagtttactttttacggtaacccttttaaagttttttacgtttaccgttacggttaccgtaacgtacgttaaacgtttaaagtttaaccgttaacgttcccgggttacccctttaccggttaaccgttttccggttttaccgggaacccgggtaacggggtaacccgtaacgggtacggttaagggaaccgttaaccgtaaaccgtaaaccgggtacgttcggggttacggcccgtttacgcccgtaaccgttaccgg

SEQ ID NO: 68696 - DNA, 764 bp, Homo sapiens
  misc_feature: GYAE6OF01A8IJJ.51.76.G10.1.454.CMB.1.raw
  modified_base (210)..(210): a, c, t, g, unknown or other
  misc_feature (210)..(210): n is a, c, g, or t
tcagcgatcgtatacacgaccggtgctcgatttagtcactcatacaggggaggaactgcgtcagttaggacccagacggaacccatggaagcccctagcgcagcttctcgttcctcctgctactcctggctcccagataccactcggagaagtacgtgactcgacgtcagtctcccaggccaccctgtcctgtgtcctccgaggggaaanagccaccctctcctgctagggccagtcagagtagttagctagcgacttagcctggtaccaagacagaaaccctggcccaggcctcccgagctccgtcacttctagtgacgtcgcactccacgaacgggcccacgtgacgtactcccgagccgtaggttcacgttcggcctaggtcgggtccgttacggggaactagggtacgtttccgaaccgttctaccgaaccgtagtacacggtaccgtaagtcccgttagacctaggtacctaaggtaacgttacgttttttacgtaccctttaaacgttttttacttaacccgtttacggttaccgtaacgggtaaccgttaaacggtttaaacgttaaaccgttaaccgttaccggggttaaccccctttacccggttaaccgttaaccgggtttttacggggacccgtaaaccgggggtaaaccccttaacggtcccgttaacggggtaacgttaaccgttaacccggtaaaacccgttacccggttacggtacccggtaccttacggtaccctaaaccggttaacc

SEQ ID NO: 68697 - DNA, 729 bp, Homo sapiens
  misc_feature: GYAE6OF01AKHQU.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacagggggaggaactgctcagttaggacccagacggaaccatggaagccccagcgcagcttcctcttcctcctgcctactctggctcccagactaccactggagaagtgtgatgacgcagtctccagccaccctgcctgtagtcctcgaaggggaancgcccaccctctcctgcacgggccctagtccagtagttcgtagcgagtctacttaggcccttggtaccagtaccgaacgtaaaccctgggacccaacggtcctaccccgagggtccccttccctactacgttaccttagtacgtaacgtccggacctaccgttcccaaaccgggaccggtacccctatcggtaacctcctacccggacgtaccgtaacgttcgaagggtcgacgtaggggtcggtacagggtaccaggtcttaccgtctccgtaccaccgtactacgtacgtacgaccgtccgtacgtcgtaacggtacgtaagttaacgttagttttaccgaactttaacgtttacgtttacgttacgtaaccgtagtaaccgttaagttaagttaaccgtacgttacccgttaccttaaccgttacggttaccgtttacgggacgtaacccggtacgtaacggtcgttaggtacgtaaccgtagtaaaccgtcgtaccgttacggacgttccgtacctaccgtacgg

SEQ ID NO: 68698 - DNA, 712 bp, Homo sapiens
  misc_feature: GYAE6OF01AVXQF.51.76.G10.1.454.CMB.1.raw
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccacctctcctgcgagggccagtcagagtgtagcagcgacttagcctggtaccagcagaacctggccaggctccgagctcctcatctangatgcatccaacgaacgggccacgtgacttactaccccgagcccgtaacgggttcaagggtcggcgtaagggttcgggggtccttagggggaactagggtacggtttccaaccttccgtacccaacccgtaactaccgacgtaccgaacggtcccgttagaccgtaacggttaccgtacggtaaaggtttactttttacggacctttaaagtttttactttaacgttacggttacctaaggtaccgtaagtttaaacgttaaaacgtttaacgtaccggttcccttacccggtttaacccttaaccgtttttcgggacccggtacggggggtaaaccctaacgggtaccgttagggtacggtaaacgtaccgtaaaaccggaacgttacgggttacggtacccgtacgtaccgtaccgttaacccg

SEQ ID NO: 68699 - DNA, 790 bp, Homo sapiens
  misc_feature: GYAE6OF01A33YU.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgcagggccagtcagagtgtagcagcgacttagcctggtaccagcaagaaacctggccaggcctcccgaggctcctcatctatgatgcatccacgaacgggccactgactactacccagccaggttccaggttggcgtaggtcgggtcgtaggggaactaggtacgtttccaccttccctaccgtaaccctaacgttccgaacggtacccgaacggttcccgtaggtaccctaacggttaccgttaacggtaaagtttaacgttttttacggaaccgttttaaacgtttttaactttaaccgtttacggttaccgtaacggttaaccgtaaaaggtttaacctttaaaacgtttaaacccgtttacccggggttaccccctttaaccccggttttaaacgtttaccccggtttttttaccggggaaccccgggtaaaccggggggttaaaaccccaaacgggttacccgggttaagggtaaacggttaaaccgttaacccggtaaaaacccggtaaaccgggtttacggttaccgggttacccgttacccggtaacccgtaaccccgtttaaccggg

SEQ ID NO: 68700 - DNA, 620 bp, Homo sapiens
  misc_feature: GYAE6OF01CE9BG.51.76.G10.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcagggccagtcagagtgtagcagcgacttgcctggtaccagacaacggaaacctggcccaggcctacccgaggtcctccnatctagtgatgacagtccaagaacggcctactgatacctcccgagtcctaggttcaggtcggactagggttcggtaccgtaggggtacaggttacgttccaaccttccgtacaacctacgttcgacgtcacgtccgtgaccgtagtcgttaagtacgttgttttacgacttttaaacgtttcgttactcgtacgaacgtctaagttaacgtacgtaccgttcgtacccttaccgttacgttaacggtttcggaaccggtacgggaccagggtcgttaggactaacgtaccgaaacggtcgtaggtaccgatacggtcctacgtacg

SEQ ID NO: 68701 - DNA, 763 bp, Homo sapiens
  misc_feature: GYAE6OF01CGJDK.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangcccaccctctcctgcgagggccagtcagagtgtagcagcgacttagcctggtaccagacaacggaacctggaccacggcctcccgaggtcctcccgtacacgttctacgtgtactcgacctacgtacccaacggaacgggcctacgtagaacttacctaccccgagtacccgtaggttccgaggtacggcgtagggttcgggcgtagggacaggtacgtcgactctacaccgtactacgacgtccgaacgtcccgtaggtcctaacggttaccgttaacggttaagtttacgtttttaacggtaacttttaaactttttaactttacgtttacgttaaccgtaacggttacttaaacggtttaacttaaaccgtttaacccggtaccggtttaacccgtttacccgtttaccgtttaaccgggttttaccgggaccccggggtaaaccggggtaaacctaaccggggtaaccggttaagggtaacggtaaaccgttaaaccggaaaaacccggttacgggttaccggttacgggtacgttaacccgtaccgttaacccgttaaccg

SEQ ID NO: 68702 - DNA, 593 bp, Homo sapiens
  misc_feature: GYAE6OF01B9Z9O.51.76.G10.1.454.CMB.1.raw
  modified_base (356)..(356): a, c, t, g, unknown or other
  misc_feature (356)..(356): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggctcccaggcctcctcatctatggatgacatcccaacgaacgggccacgtgatactcccagcctagttcagtcggcaggtgggtcngggactagtagttcacgtctcaccatcagcagcctgcagtctagaattgtttgacttaatttattcgtcgtacgagtactaagtaataacgtaacgttcggtacccttaccgtacttaccgtttcgggacccggtaaacggggtaaccctaagggtaccggtagggaaacgtaacggttaacctaaaaaccgggtacgttacggggttcggtaccgtcggtacccgtaccgttaacg

SEQ ID NO: 68703 - DNA, 574 bp, Homo sapiens
  misc_feature: GYAE6OF01BO62I.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcaggggccagtcagagtgttagcagcgacttagcctggtaccagcagaacctggccaggcctcccaggcctcctcatctatgatcgctatccaacgacgggccactgatactccagcctaggttcagtggcgaggtcgggtcgtgggactaggtacgttcactctaccactatcgacgcgacgctgctagtcgtagtaagttattttgacttaatttacttacgttgtactagacgtaagttaataacgttaacgttcggtacccttaccggttaccttacgtttccgggaccggtacgggacctaaggtcgtaggaatacgtaacgtaaaccggtacgttggtacggactacgcctactacg

SEQ ID NO: 68704 - DNA, 561 bp, Homo sapiens
  misc_feature: GYAE6OF01E5GM9.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcaagaaacctggccaggctcccagacctcctcatctatgatgcatccacgaacgggccactgatactacccagcctaggttcaggtcggcaggtgggtcgtaggggacaggtagttcactctacaccatcagccagtcctgcagtcgtagaagttatttcgactttaatttacttactgtcagctaagtaataactacgtcggtacccttacgtacttcgtttcgggacccgtaacggggaccaaggtcgtaggaacggtaccgtaacgaaaccgtacgttggtacggtactcgtcctaccgtacg

SEQ ID NO: 68705 - DNA, 842 bp, Homo sapiens
  misc_feature: GYAE6OF01BYZ4G.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcgagggccagtcagagtgtagcagcgtacttgcctggtaccagcaagaaccgtggccaggtcctacccgaggtccctcctacacttcgtatggactcgactacgtacccgaacgaacgggccctaacgtgaacttacctaccccgaggacccgtagggtttacaacgggttgggaccgtaggggttcggggtacgttagggggaacctaaggggttacgtttccgaacccgtttcccgtaaccgtaacccggtaattacccgtaacggaccgtaccggtaccccgttaggtaccgtaacggttacgtaacggttaacgttttagttttttaacggaaccttttaaacgtttttaacgtttaaccgtttacggttacgtaacggtaaccttaaagggtttaacttaaaacgggtttaacccggttaccgggttaacccgtttaccccggtttaaccgtttaaccgggttttttaccggggaaaccccgggttaacggggggtaaacccgtaaacggggttcccggttaaggggaaccgtaaaccggtttaaacccggtaaaaaccgggttaccggtttaccggggttaccgggttaccggttaaccggtaaccccgtaacccgttaccggg

SEQ ID NO: 68706 - DNA, 568 bp, Homo sapiens
  misc_feature: GYAE6OF01DIEBI.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacgaagggccactgactactcccagcctaggttcaggtggcaggtgggtctgggacagagttcactctcaccatcagcacgcctgcagtctagtaagtattttgactaatttatttactgtacagtactaagttaataacgttaacgtcggtacccttaccgttacgttaccgttttacgggaccgtaacggggtacccgaaggtcgtagggtaacgtaacgtaaccgaaacggtaacgttacggttacggactcgaccgtaccgtacg

SEQ ID NO: 68707 - DNA, 822 bp, Homo sapiens
  misc_feature: GYAE6OF01CZKSG.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtcctccgaaggggaanacgcccaccctctccgtgcgacgggccagtcagtagtgtagcagcgtacgttacgccgtaggtaccagaccaacggtaaacccgtcggacccgacggtccctaccccgagggtccctcccgtactaacgttaccgttaagtcgtacgttaccgacctaacctacccgaacggtaaccgggacccctaacgtacggtaactaaccgtacccgaacggtaccggtaccgggttaccgtaacgggtacgggtaccggtaggggttccgggttacggtacggggaacgtaacggttaccggttacccgtaccttaccgtcccaaaccgtacgtaccgacggtaccgtaccggtccgtacggtaccgtacggtttacgtaaggttaacgttttacttttacgtaaacttttaaacgtttacgttttaacgtacggttaaccgaaggttaccgttaaagtttaaccttaaacgttaaccgtacccggttacccgtttaaccgtaccgtttacggtttaccgggaaccggttaaccggggtaaccaacgggttacgtagggtaaacgtaccgttaaaccgaaaaccgggtacgttacgggtaccggtacgtaccggaaccctcgttaaccg

SEQ ID NO: 68708 - DNA, 697 bp, Homo sapiens
  misc_feature: GYAE6OF01BYLLP.51.76.G10.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (683)..(683): a, c, t, g, unknown or other
  misc_feature (683)..(683): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagtagtgatgacgcagtctccagcccacctgtctgtgtctacgaaggggaanacgccctaccctntccngcgaggccagtcaagngtgtagcagtcgattagctaggtaccagtcaacgaaccgtggaccaggcctacccgaggtcctcctacacttacgtatgaactcgctacaccaacggaacggtccaacgtcgtaactcctaccacggtacccgtaaggttactaacggcggtctaacggggttcgggttacgacggggaataggtacgttacactcctaccaaccttagccgaagtccaacggttccctagacgtaggttacgtaaggtaaacgtttgtttacgaagttttaaactttagttaacctggtaaccgtaacgcgttaaaccggttaaataaccgttaaccggtaccggttaccccttaccgttaacgtttaaccggttacggaaccgggttaccggggtaaaccaagggttcccgttaagggaaacttaactaaccccggaaaagttacgtcgttaccggaacgtnaaccccggtatacg

SEQ ID NO: 68709 - DNA, 599 bp, Homo sapiens
  misc_feature: GYAE6OF01BB6KU.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcagaaacctggccaggctcccaggcctcctcatctatgatgcatccacgaacgggccacgtgactactcccagcctaggttcagtcggcaggtgggtctagggacaggtacgttcactcgtacacctatcgagcacgcctgacgtagtctagaagttattttcgacttaatttacttactgtcagtctagttaataagtacgtacggtcccttaccgttactaccggttttacgggacccgtaacgggggtaaccctaacgggtccgttagggaacgtaacgttaaacccgaaaacccggtaacgttacgggttacggtacccttcggacccgtacccgtacgg

SEQ ID NO: 68710 - DNA, 639 bp, Homo sapiens
  misc_feature: GYAE6OF01A60AN.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcaggggccagtcagagtgttagcagcgtacttagcctggtaccagcaagaaccgtggccaggcctaccgaggcctcctcatctatgatcgcactccaacgaacgggccacgtagactacctacccgagtccgtaaggttccagggtcggacgtagggttcgggtcgtaggggactaggtacgtttcaccgtctaccacctactcgacgcgtacgcctgacctagtaccgtaggtaagtttagttttacgtactttaattttacttacgttgtacgtagtactaagttaattaacgttaccgttcgtacccttaccgttacgttacggtttaccgggaccggtaaacgggaccgtaacggtcggtaggtaacggtacgtaaaccgtaaacggtacgttcggtacggtaccgtacgtaccctaccgttacg

SEQ ID NO: 68711 - DNA, 569 bp, Homo sapiens
  misc_feature: GYAE6OF01EKL40.51.76.G10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagngtgtagcagcgacttagcctggtaccagcagaaacctggccaggctcccaggctcctcatctatgatgcatccacaacgggccactgactactcccagcctaaggttcaggtggcaggtcgggtctgggactagacgttcacgtctacaccgtatcgagcacgcctgactagtctagaagtagtttagactaagtttacttacttcgtctagtctaagtaattaattaaccgtcgtaccctaccgttactaccgttttcgggacccgtaacggggaacccaaggtctagggaagtacgtaaccgaaaacgtacgtacggtcggacgtcgaccgaccgttacg

SEQ ID NO: 68712 - DNA, 643 bp, Homo sapiens
  misc_feature: GYAE6OF01EJ7W2.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctacgaggggaaancgcccaccctctcctgcagggccagtcagagtgttagcagcgacttagcctggtaccagcagaacctggccaggctccgaggctcctcatctatgatgcatccaacgaacgggccacgtgaatactcccagcctaggttccaggtcgcgaggtgggtcgtagggacaggtcgttcacttcctacaccgtattccgaacgcgacgtcccgttgacgtaggttctaaggtaacgtttagtttttacgaacttttaagttttacttacgtttacgttaccaggtaactaaggtttaaattaacgttaaacgtttccggtaccctttacccgttaaccgttaccgttttacgggacccgtaacggggtaaccctaagtccggttagggaacgtaacgtaaccggtaaaaccgtaacgttcggttacgggacctacgggcctaccgtaacg

SEQ ID NO: 68713 - DNA, 791 bp, Homo sapiens
  misc_feature: GYAE6OF01CR12R.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtcctccagccaccctgtctgtgtctccgaggggaancgccaccctctcctgcgagggccagtcgagagtgtagcaggcgacttacgcctggtaccagcaacgaaaccgtcggaccagggcctcccgaggcctccctacacgttcctaagtgacttcggacctaacttacccgaacggaaccggggtccctaacgttagacttaaccgtaccccgacgtaccccgtaggtttaccgaacgggttcgggaccgtagggttcggggttccgtagggggaaccctaggttaacggtttccctaacgttccctaaccctaccctaacgttaccaaccggtcctaaccggtacccgttcggacccgttaaggttacccgttaaggtaaacgtttagtttttacgaacttttaaactttttaacgttttaacgtaccgttacgtaacgttaaccgttaaacgtttaaacgttaaaacctttaccggttacccggttaaccccgtttaaccccggttaactttacccgggtttcgggaaccccggtaaacgggggtaccaacgggttaccgtagggtacgtaaacgttaaacccgaaacggtacggttacggtacggtctaaccggccgtccgttaacg

SEQ ID NO: 68714 - DNA, 667 bp, Homo sapiens
  misc_feature: GYAE6OF01DVUDI.51.76.G10.1.454.CMB.1.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctcgaggggaanagccaccctctcctgcagggccagtcagtagtgtagcagcgtacttagcctaggtaccagacagaacctggacccaggcctcccaggtctcctcatctangatgcactaccaacgacgggcctaactgactactcccgagtcccgtaggttcaggttcggcgtagggttcgggtcgtggggaacgaggtacgttccaccttcctaccgacctataccgacggacctacgtccctggactacggttactacggtaaagtttatttttacgaacctttaaagtttttactttacgttagttcctaaggtacctaacgggtaccgtaagtaccgttaaggtttcccggtacccttcccgtagtaaccttcccgtaccccggttcggaacccgggtaaacgggtaaccacgggtaacggtaacgggaaagtaaaacgtaaaccggtaacgttcgggtaccggtgttaccgaaccccg

SEQ ID NO: 68715 - DNA, 583 bp, Homo sapiens
  misc_feature: GYAE6OF01BMF96.51.76.G10.1.454.CMB.1.raw
  modified_base (197)..(197): a, c, t, g, unknown or other
  misc_feature (197)..(197): n is a, c, g, or t
  modified_base (325)..(325): a, c, t, g, unknown or other
  misc_feature (325)..(325): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcaagaaaccgtggccaggcctcccgaggcctcctcatctatgatgcatccagaacggccacgtgatacnccagcctagttcaggtgactaggtgggtctagggactaggtacgttcacttcctacacctatcagcacgcctgctacgtcgtagtaagttagttttcgactttaattttattacttcgtacgtagtactaagtaacttaacgtaacgtcggtaccttaccgtacgttacgtttcggaccggtacgggaacctacggtcgtaggacgtacgtaaccgtaaaccgtacgtacggtacggacgtacgaccgtaccgttacg

SEQ ID NO: 68716 - DNA, 677 bp, Homo sapiens
  misc_feature: GYAE6OF01DUHHO.51.76.G10.1.454.CMB.1.raw
  modified_base (194)..(194): a, c, t, g, unknown or other
  misc_feature (194)..(194): n is a, c, g, or t
  modified_base (666)..(666): a, c, t, g, unknown or other
  misc_feature (666)..(666): n is a, c, g, or t
  modified_base (672)..(672): a, c, t, g, unknown or other
  misc_feature (672)..(672): n is a, c, g, or t
tcagcgatcgtatacacgaccggtgctcgatttagtcactcatacagggggaggaactgctcagttaggacccagacggaaccatggaagcccagcgcagcttctcttcctcctgctactctggctcccagataccactggagaagtagtgatgacgcagtctccagccacctgtctgtcgtctccgagggaanacgccacctctcctgcgacggccagtcagtagtgttagcgagcgtactacgccgtcggtaccagacaacgaaccgtcggaccgacggtcctacccgacggtcctccgtactaacttcctagtacggtattcgacctactacccgaacgaaccgggtacctaacgtacgtaacttaccgtacccgtacggtaccgtacggttacgaacgggttcggaccggttagggtcgggtacggtacgggtaacgtacggttacggtttacctacttacctacccgaacctacgtacgacgaccgtaacgtcccgtacgacgtacgttacgttacgttaagtttacgttttacgtactttaattttacttacgttgtactacgtaactaagttaacttaacgtacgtccgttacctacgtacgttacgttcggacggacggtacaggtcgtagacgtacacgaaacgcgttcgacgtacncgtacncttcg

SEQ ID NO: 68717 - DNA, 652 bp, Homo sapiens
  misc_feature: GYAE6OF01DKS3P.51.76.G10.1.454.CMB.1.raw
  modified_base (203)..(203): a, c, t, g, unknown or other
  misc_feature (203)..(203): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagcccaccctgtcctgtcgtctaccgaggggaaacncgccaccctctctgcagggccagtcagtagttgtagcagcgacttacgccgtaggtaccagacacgaaaccgtggaccaggcctacccgaggtcctccctctatccttaatggaatcgacactaccgaaccaacggggaccacgtgaactactacccgagtcctacggttccgaaggttcggaccgtaggttacgggtccgtacggggaactaggtacgttactaccgtctaccaacttactacgagaccaacgtcccgtacgacgtaaggtctaagtaacgttatttacggtacttaaatttacgttactagtcaagctaagttaagtaaacttaccgttacggtaccttaccgtacgttaccgtttaccggacggtacggtaaccgaagtccgtaggacgtacgtaacgaaaccgtacggtgtacggacgtacgtctaaccgttacg

SEQ ID NO: 68718 - DNA, 793 bp, Homo sapiens
  misc_feature: GYAE6OF01BE2Z6.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagtagtgtagcagcgacttagcctggtaccagcacgaacctggccaggcctacccgaggcctcctacactctatgagtcgcacgtccaacgacgggccagtgtaacttacgtcccaagccgtacggtttcacggttcgggacgtacgggtttcggggtaccgtgggggaaccctaagggtcgtttacccgaacccgttcgtaaccccaacccgtaacgtccggtaacgaccggtaaccggtcccggttaacgtacccggttaaacggtttaccgttaaacgggttaacggtttttaacggttttttacggaaaccctttttaaagttttttaccggtttaaccggtttacggttaaccgtaacggttaacgttaaacggtttaaacttaaaacggtttaacccgggttaccggtttaaccccgttacccggttttaaccgtttaaccggttttaccggggaacccggtaaccgggggtaaaccctacggggtcgttaaggggaacgttaacgtaaaccggtaaaacggttacggttacggtacggtaccgttacgacccggtaactaccgg

SEQ ID NO: 68719 - DNA, 726 bp, Homo sapiens
  misc_feature: GYAE6OF01CUONK.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtcgtccgaggggaaanacgcccaccctctcctgcagggccagtcagagtgttagcaggcgacttagcccgtaggtaacccagaccgaacggaaacccgttgggcccaagggccctacccgacgggtcccctccgtacaacttcgtaagtgactcgactactaccgaacggaacggcccaacgtagactactcccgagccgtaggtcagtggactgggtggtcgtgggaactaggtacttacgaccttaccgtaccactactaccgacgtacgacgtccgtcgtacgtacggtacgtaggttaacgttacgttttacgtacgtttaaacttttacgttacgtttgtaactagtaaccgttaagttaaacgttaaacgttaccgttaccggttaccccgttaaccggttaccgttaccggttttaccgggaaccgggtaaccgggtaaacccgtaacggtaaccgttaacgggtaaacgttaaccgtaaaacgttaccgtaacgggtaccgttacggtaccgtaaccgtacccgtccgtttaccg

SEQ ID NO: 68720 - DNA, 642 bp, Homo sapiens
  misc_feature: GYAE6OF01AKML4.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagcgcccaccctctcctgcagggccagtcagagtgttagcagcgtacttagcctggtaccagcacgaaccgtggccaggcctcccgaggtcctcctcactcctagtgatcgactactaccaacgaacgggccacgtgactacctcccgagtcctaggttcaggtggcgtagggttcgggtacgtaggggaactagggtacgtttccgaccttccgtaccgtaacctacgtccgaacgccgacggtccgttacgaccgtacggttacgttaaggtaacgtttacgttttacgtactttaaattttacgttacgttacgtacgtacgtacgttaagttaactaacgttacgttccggtaccttacccgttacttacggtttacggaccgtacgggaacctacggtcgtaggacgtacgtacgaacgtactggtacgactcgctaccgtcg

SEQ ID NO: 68721 - DNA, 695 bp, Homo sapiens
  misc_feature: GYAE6OF01APCCJ.51.76.G10.1.454.CMB.1.raw
  modified_base (197)..(197): a, c, t, g, unknown or other
  misc_feature (197)..(197): n is a, c, g, or t
  modified_base (690)..(690): a, c, t, g, unknown or other
  misc_feature (690)..(690): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccacctctcctgcgagggccagtcagagtgtagcagcgtacttacgccgttaggtaccagaccgaagtaaaccccgttgggacccacgggtccctacccggacgggtccctccctactaattccgtactggtaactcggacctacgttacccgaaccggaacgggtccctaacgttcggtaacttaccttaccccggaagtcccgttaacgggttcgaacggttggggacccgtaggggttcgggttcgtagggaccaggttaccgttcgacctcgtaccaacgtactcacggacctacgtccgttacgcgtagttccgtaaggtaacgttcttttacgacctttaagttttacttacgtacggttaccaggtataacgttaaagtaacgtaccgtacgtcccgttacttacgttacggtttccggacggtaaccgggactacggtgtagacgttacgaactaaccggatacgggtcgacctcgtcccgtntaccg

SEQ ID NO: 68722 - DNA, 634 bp, Homo sapiens
  misc_feature: GYAE6OF01CQVM9.51.76.G10.1.454.CMB.1.raw
  modified_base (218)..(218): a, c, t, g, unknown or other
  misc_feature (218)..(218): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatcgacgctagtctccacgcccaccctgtctgtgtctaccgaggggaaacacgcccaccctctccngcagggccaggtcagagtagttagcagcgattagaccgtaggtaccagacgaagaacctggaccacggcctacccgaggtcctaccgtacacttctatagactcgactactacccgaacgaaacgggcccaacgtgtaactactacccgacgtccgaggttacaggtcggacgtaggtcggcgttaggactaggtagttaccacgttccaccgtacctacgtaccgacgtctacgcctgtactagtacgtagtaacgttatttacgacttaacgtttacttaccgttagtaccgtagtaacctaagtacgttaacgtaacgtcgtacccttacgtacttacgtttacggaccgtacggtaacgtacggccgttaggactacgaccgtaaagtcgtacgtcgactcgacgtactacg

SEQ ID NO: 68723 - DNA, 646 bp, Homo sapiens
  misc_feature: GYAE6OF01CAUF7.51.76.G10.1.454.CMB.1.raw
  modified_base (197)..(197): a, c, t, g, unknown or other
  misc_feature (197)..(197): n is a, c, g, or t
  modified_base (635)..(635): a, c, t, g, unknown or other
  misc_feature (635)..(635): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcgagggccagtcagtagtgtagcgagcgtacttgcctaggtaccagcaagaaccgtcggccaggcctcccgagcctcctcatctatgatcgcacgtaccaacgtacgggcctacgtgaacttccacccgagcccgtaggttcaggtcgacgtggtcgggtcgtagggacaggtacgttccacgttctaccgtaccagtaccgacgactaccgtccgtacgacttaagtccgttaaggtaacgtttacgttttagaaccttttaaattttactttacgttacgtcgtaaggttaccttaagttaaacgtaacgtttaaccgtccggttacccgttaacggttaccttacggtttaccgggaccgtacggggtaaacctacggtgtaggacgtactaacgaaaccgtagttcggtacgagtccnccgtaacgtcg

SEQ ID NO: 68724 - DNA, 672 bp, Homo sapiens
  misc_feature: GYAE6OF01B5R1E.51.76.G10.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
tcagcgatcgtatacacgaccggtgctcgatttagtcactcatacagggggaggaactgctcagttaggacccagacggaaccatggaagccccagcgcagcttctctacctcctgctactctggctcccagataccactggagaagtagtgatgacgcagtctccagccaccctgtctgtgtctccgaggggaaancgccaccctctcctgcagggccagtcagngtgtagcagcgacttagcctggtaccagcagaaacctggaccaggcctacccgaggcctcctcactctatcgatgcactccaagaacggccacgtgactactcccgagccgtaggttacaggtggctaggtcgggtctgggaactaggtacgttccgaaccttctaccaacccgtactaccgtaacggccaacggtccccgttaggaccgttaacggttccgtaaggttaaacgtttacgttttttacgaaaccgttttaaattttaacgttttaaccgttcgttaacgaacgttaccgtaaagtttaacgtaacgttaaaccgttccggtacccgttaccgtaccgtttacgttttacgggacccgtaacggggtaaccctaaggtccgtaggaacgtacgtaaccgtaaacgtacgttggacggtacctacgccgtaccgtacg

SEQ ID NO: 68725 - DNA, 627 bp, Homo sapiens
  misc_feature: GYAE6OF01CZJH4.51.76.G10.1.454.CMB.1.raw
  modified_base (197)..(197): a, c, t, g, unknown or other
  misc_feature (197)..(197): n is a, c, g, or t
  modified_base (334)..(334): a, c, t, g, unknown or other
  misc_feature (334)..(334): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagccgtggtaccagacacgaaaccgtggcccaggcctcccgaggcctcctcatctatgatgcactccaacgaacgggccacgtagacttacncccagccgtaggttcaggtggcgtaggtcgggtcgtggggacaggtagtttacaccttcgtaccacctacgtacgacgtccgacgcccgtgctacggttcgtaggtaacgttagttttacgtacttaattttacttacttcgttacgaacggtactaagttaacttaaagttaaccgtcggttacccgttaaccgtacttacgttttacgggaccggtaacggggtaccgtaacggtcgtagggaagtaacgtaacgtaaaccgtacgtacgtacggacgtcgtacacgtacg

SEQ ID NO: 68726 - DNA, 717 bp, Homo sapiens
  misc_feature: GYAE6OF01A6AW7.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcacgggccagtcagagtgttagcagcgacttagcctaggtaccagcaagaaaccgtggccaggctcccgaggcctcctcatctatgatgcactaccgacgaacgggccactacgatactcccgagtcctaggttcgaggtcggaccgtaggtcggggtcgtacggggactaggtaacgtttccgtaaccgttacctacccgtaacccacttaccgacggtccgaacggtcccttggacgtacgttcgttaaggtaacggtttattttacggtaactttaaacgttttacgttacgtttaggttaccgacgtaacgttaagttaaacgttaaacgttaaacccgttcgggttaccccttacccggttaccgtttaaccggttttacggggacccggtaaaccgggggtaacctaacgggttaccggttaaggggaacggttaaccttaaaccggaaaaccggttaaccgttgggttaccgggaccttacggaccgtaacccgtacg

SEQ ID NO: 68727 - DNA, 674 bp, Homo sapiens
  misc_feature: GYAE6OF01CSBDZ.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtcgtcgtccgaggggaanacgccctacccgtctccgtgcgacgggccagtcgagagtgtagcagtcgtacttacgccgtaggtaccagacaacggaaccgtcggaccctacggcctcccgaggtcctcctacgacttcgtacgtagacttcggcctaacgtacccgaacggtaacgggccctacgtacgaccgtaaccgtcccgagtccgtagggtttccgagggttcggacgtagggttcgggtacgtaggggaacctagggtaaccgtttccaccgttaccgtaccgaccttacgtcgacggtaccgtacgtccgtaggaccttaaggttccgttaagttaacggtttaatttcggaactttaacgttttctacgtgtactacgtactaagttacttaactcggtccgacttaccgtatacggttcgacgacggtacaggtacgtaggactacgtaaccgaacgtacgtggtacgtactacgactccgtcg

SEQ ID NO: 68728 - DNA, 685 bp, Homo sapiens
  misc_feature: GYAE6OF01EC1DE.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaanagccaccctctcctgcagggccaggtcagagtgttagcagcgacttagcctggtaccagcaagaaacctggccaggcctcccgaggcctcctcatctatgatgcatccaacgaacgggccactgactactcccgagccgtaggttcgagtggctagggtgggtctggggacaggtagttccacttcctacaacctatccgaacgccagtcccgtgaccgtagtcgtagtaagttagttttcgacgtttaagttttactttacgttgttacgaacgtccgtaacggttaaccgtaaaccgtaacgttccgggttaccgttccgtttaccgggtttaccggggaccggggtaaacgggggtaaacccggtaaaggggttacgggaaacggttaaccgttaaaacccggtaaaaccgggttaaaccggttgggttaacgggttacccggttaaccgggaacccttaacccggttagtttcccggtttaccgg

SEQ ID NO: 68729 - DNA, 713 bp, Homo sapiens
  misc_feature: GYAE6OF01CTIA4.51.76.G10.1.454.CMB.1.raw
  modified_base (295)..(295): a, c, t, g, unknown or other
  misc_feature (295)..(295): n is a, c, g, or t
  modified_base (329)..(329): a, c, t, g, unknown or other
  misc_feature (329)..(329): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtcctcgaaggggaaagcgcccaccctctcctgcgagggccagtcagagtgttagcagcgacttagcctggaccagccaagaaccgtggaccaggcctacccgaggcctcctntactctagtgactgacactccaacgacggcctangataccgtccagtccgtaggttcacggttggacgtagggtcgggtctaggggaacctaggtacggtttaccacctttacccgtacaacccgtataccgaacgtccgaacggtccctacggaccgtaggttaccgttaaggtaaggtttaacgttttacggaaaccgtttaaagttttactttaacgttacgttaccgtaacgttacgtaagtttaaacttaaacggttaaccgttaccggtaccctttacccgttacgttaaccggttttaccgggacccggtaaacggggtaaccctaacgggtacggtaacggtaacggtaccgtaaacgtaaaaccggtacgttaacgggtcggtaccggacgttaccgtaacccgttacg

SEQ ID NO: 68730 - DNA, 626 bp, Homo sapiens
  misc_feature: GYAE6OF01A3XRP.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccagcagaacctggccaggcctcccaggcctcctcatctatgatgcatccgacgaagggcccactgactactcccgagcctaggtcagtggcgtaggtggggtctggggacaggtacgttcaccgttctacccacctagtcgacgccacggtccctggactacggttcgtagtaagttagttttacgactttaattttacttacgtgtaccgaagtacgtaagttaattaaacgtaccgttacggtccccttaccggtaccttacgttttaccggacccggtaacggggtacccgtaaggtccgtagggaacgtaacctaaccggtaaaacccgtacggttacggtacggtacgttaccgccgtaacccgttacg

SEQ ID NO: 68731 - DNA, 598 bp, Homo sapiens
  misc_feature: GYAE6OF01BFKBK.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccacctctcctgcagggccagtcagagtgttagcagcgacttagcctggtaccagcaagaacctggccaggcctccgagcctctcgatctatgatcgcagtccagaacggccagtgtactactccagccgtaaggttcacgggttggacgtagggttcgggtacgtaggggactaggtacgtttccaacgttcctaccaactacgtccgacgcctacgtcctacgtcgagtacgtaggtaagttgttttagactttaatttacttactacgtcagtccaagttacgttaactaacgtcgtacctccgttacttaccgtttacggaccggtagggtaacctacggtacgtaggacgtaacgaacgaaacgtaacgtcggacgttcgactacgtaccgtacg

SEQ ID NO: 68732 - DNA, 608 bp, Homo sapiens
  misc_feature: GYAE6OF01BPRNE.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagacgccaccctctcctgcagggccagtcagagtgttagcagcgacttagcctggtaccagcaacggaaaccctggaccaggacctccccgaggcctcctactatctatgatcgcactcccaacgacgggcccacgtgaataccgtcccagcctaggtcgaggtggcgtaggtcgggttcgagggaacaggtacgttcactccgtaccacctataccgagaccgacgtcccgtgacgtacgttccgtaggtaacttagttttagacttttaactttattaccgttgtaccagtaccgaagttaactaagtaccgtcggtaccctaccgttacgttacgttcggacgtacgggaccagtcgtaggtaacgtacgtacgtaaacgtacgttacggacgtaccgtcgactccgtacg

SEQ ID NO: 68733 - DNA, 513 bp, Homo sapiens
  misc_feature: GYAE6OF01A5FYI.51.76.G10.1.454.CMB.1.raw
  modified_base (196)..(196): a, c, t, g, unknown or other
  misc_feature (196)..(196): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggcaggctcccgaggctcctcatctatgatgcatccacaacgggccactcgactactccccagcctacggttcagtggccgaggtgggtctgggacagagttcactctacacatcagcagcctgcagtcngagtattgactaatttntactgtacagtatagttactagtaactcgtacctcgtactacgtttggaccgacgggaccaacgtgtaggagataccaaagactggacgtacacgccgactacg

SEQ ID NO: 68734 - DNA, 581 bp, Homo sapiens
  misc_feature: GYAE6OF01DGNTZ.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgtagcttctcttcctcctgctactctggctcccagataccactggagaagtagtgatgacgcagtctccagccaccctgtctgtgtctcgaaggggaancgccacctctcctgcgagggccagtcagagtgttagcagcgacttagcctggtaccagcaagaaccgtggaccaggcctccgaggcctcctcatctatgatgcatccacgtacggccagtgactactccagcctaggttcaggtcggacgtaggtgggtacgtgggactaggtcgttacacgttctaccacctatacgacgcacgtcctgacgtacgtactagtaacgttcgtttagtacttaatttagtttacgtcgtacagtactaagttaactaacgttacggtacgttcccttacgttacgttcgtttacggacccggtaagggacctaggcgtaggagtactaaccgaacgtacgtggtacgtactcgactctacgttcg

SEQ ID NO: 68735 - DNA, 754 bp, Homo sapiens
  misc_feature: GYAE6OF01DBO09.51.76.G10.1.454.CMB.1.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtctccgaggggaanacgccaccctctcctgcacgggccagtcagngttgtagcagcgtacttagccgttaggaccagacaacgaacctggaccacgggtcctacccgacggtcctcctactacttctagtggtactcgactactacccgaacggaacgggtaccaacgttgacttaaccgcccgaacgtccgtaacggttacacgggtcgacggtagggtcgggtacggtacgggtactaacggtcgttacctaccgtacctaccaaccgtacgtaccgagaccgacgtcccgtacgacgtacggttacgttaacgtaacgttttaggtttaactaccgtttaaattttacgttaccgttacggtactagtacggttaaattaacttaaacgttaaccggtcccggttaacctttaccggtttaaccgtttaccggttttaccgggaacccgggttacggggtaacctaacgggttacggtaaccgggtaacggtaaaccgttaaacccggttaaaaccgggtacggtttaacggtaccgggtaacctacccgtaccgtacccgttttaccgg

SEQ ID NO: 68736 - DNA, 703 bp, Homo sapiens
  misc_feature: GYAE6OF01CMLDN.51.76.G10.1.454.CMB.1.raw
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
  modified_base (320)..(320): a, c, t, g, unknown or other
  misc_feature (320)..(320): n is a, c, g, or t
  modified_base (543)..(543): a, c, t, g, unknown or other
  misc_feature (543)..(543): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggaagaagtagtgatgacgcagtctcacgccacctgtctgtgtctccgaaggggaanacgcccaccctctccngcgacgggccaggtcgaggtagttgtagcaggcgtaagttacgccgtagtaccgagaacaacggaaacctcggaccgacggtacctacccgacggtcctaccctanacttacctagtagtatcgacacctaccgaacgacggacctagtagtactaccgtcccgaagtccgtaggttacgacggtggtacggtagggtcggttacgaggaactagtacgtttcaccgttctaccgaacctagaccgtacgaccgacggtacctcggtaacacggttacgtaggttaacgttaagtttttaccgaagtttaatttttaacgtaacgtttntaacgacggttacttaaagttaacgttaaaccgttaccggtcgtttaaccccgttaccgttaacgttaccggtttaacggacccgggtaaacggtacaacggtaggtacgtaacgtaaactaacgtaaacggacgtgttacggacttacgcccttatacg

SEQ ID NO: 68737 - DNA, 742 bp, Homo sapiens
  misc_feature: GYAE6OF01CWHRX.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagtagtgatgacgcagtctccagccaccctgtctgtgtctccgaaggggaanacgccaccctctcctgcgagggccagtcagagtgtagcagcgacttagcctaggtacagacacggaaacctggccagggcctacccgagggccttaccgtctaattccgtaatgtactcgaccctatacccaacggaaacgggcccaatgactaccgtcccgagtaccgtaggttacgaaggttcgggacgtacgggttgggtacggtagggaacagggttacttccgtactccgtaccgtacacgtacacggccacgtacctggtacctaaggttccgtaagtaaacgtttacgttttacgaacttttaatttttacgttaacgtagttaccgaaaggtacctaaagttttaagtaaaacctttaaccgtccgggtacccctttaacggtaacccgttttaccggttacgggtaccccggaaccggggtaaaaccgtacgggttaccggtaagggtaaacgttaccggttaaaaaccggtaaaaccgggttaaccggtttacggggtacgggtaccgttaacccggtccgaaacccgtttaccgg

SEQ ID NO: 68738 - DNA, 699 bp, Homo sapiens
  misc_feature: GYAE6OF01AVRTT.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggcctcccaggcctcctcagtctatgatgcactaccacgaacgggcccactggaactactcccaagcccgtaggttaccaggttcggaccgtaggttcggggtcgtaggggacctaaggtacgttcgacctcctaccgaacctacgtccgaacggtccgtacgtcccgttgacctacggtcgttaaggtaacgttacgtttttacgactttaacgttttaactttacgttcgtacgacgtacctaagttaacttaaacgttaaccgtacgggttacccctttaaccggtaaccctttacggttttacgggaccggttaacggggtaaaccccgtaacggtaccggttaagggaacggtaaaccgttaaccggtaaaaacccggttacgtacgggttacgggtaccctacggtaaccctacccgttaaccggg

SEQ ID NO: 68739 - DNA, 742 bp, Homo sapiens
  misc_feature: GYAE6OF01DVCLR.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtgtgatgacgcagtctccagcccacctgtctgtcgtcctacggaaggggaaacncgccctaccctctcctggaccgacgggccagtcaggtagttgtacgcgacggtcgtacttacggccgtcggtaaccagacgaacgaaaccgtcggaccacggcctacccgcggtccttccactacttactagtacgtattcgactaaccgtacccgaacggaaccggaccctaactacgtaaccgtacctcccgaacggtaccgttaacggttcgaagggtccggaggtttaaggggtccgggttacggtacggtaacggtaagttaccggttacctaacccgttccgtacctaaccgtacgtacgaacgtccgaccgtcttaacggctacggttacgtaggtaactttatttcgaaacttttaatttaccgtcgttaacgtaccgtaagttaccgtaaattaaacgttaaacccgttaccggttcgttacccgttaaccgttacgtttacccggtaggacccgggttaacggacgtaacgtccggtaagtaccgaattaaccggaaacgttggcgttaacggactccggaactacgttcg

SEQ ID NO: 68740 - DNA, 824 bp, Homo sapiens
  misc_feature: GYAE6OF01BVNQO.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggctcccagataccactggagaagtagtgatgacgcagtctcagccaccctgtctgtgtctcgaggggaancgccaccctctcctgcgacggccagtcagtagtgttagcagcgtacttagccgtggtacccagccaacggaaaccctgggacccaggggtccctaccccgtagggcccttaccccgtacgtacttacccgtaagttcggaacttcgacccgtaacgttacccgaaaccggtaaccggggtcccctaaaacgttacggtaaactttaaccgttaccccgaaacggtacccgttaacgggtttaccggaaacgggttcggggaccgttaaagggggtttccgggggtttaccggtaggggggtaaacctaacgggtttaccgtttaccaaaccggttcccttaaccgaaccgtacgtacccgtaacggaccgtacggttaccgtcgtaccgtacgttacgtaacgggttaagttacttttaacgactttaaagtttacgtttaccgttagtaccgtaacgtacgtagttaaacttaacgtaaccgttccggtacccgttaccggttaaccgttaccggttttacgggaccgggtaacgggtaaccgtaacggtaccgtaggtaacggtaaccgtaacccggtaaaacgtacggttacggtacggttaccggtacaaccgtaaccgttaccg

SEQ ID NO: 68741 - DNA, 655 bp, Homo sapiens
  misc_feature: GYAE6OF01B9L4K.51.76.G10.1.454.CMB.1.raw
  modified_base (232)..(232): a, c, t, g, unknown or other
  misc_feature (232)..(232): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagttgatgacgcagtctccacgccaccctgtctgtcgtcgtcgaagggaagcgcctaccctctcctgacgacggccagtcgagngtgtacgcagacgtacgtcgtccgtacggaaccagacgaacgaaccgtccggaccgtacggccttacccgaggtccctcctactataccgtatagacgtcgaccacgtaccgaacggacgggtccacgtgaccttaccgccgaggtccgtaggttcgaggtcggacgtaggtcggttacgagggtaccacggtcgtacctacctcgtaaccacgtactacgacgacgacgtcgtaccgcgtacgttacgtagttaagtttacgtttacgtaacttagtttaacttacttacgtactaagtacgtaagtacttaacgtacgtacggtaccgttacgtacgtaccgtttacggaccggtacgacggtacgtcggtacggaacgtacgtacgtaacgtaccgtagtacgtagaccgtctacttccg

SEQ ID NO: 68742 - DNA, 719 bp, Homo sapiens
  misc_feature: GYAE6OF01C12PF.51.76.G10.1.454.CMB.1.raw
  modified_base (195)..(195): a, c, t, g, unknown or other
  misc_feature (195)..(195): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacagggggaggaactgctcagttaggacccagacggaaccatggaagcccagcgcagcttctcttcctcctgctactctggctccagataccactggagaagtagtgatgacgcagtctccagccaccctgtctgtgtctccgaggggaaanacgccaccctctcctgcagggccagtcagagtgtagcagcgacttagcctggtaaccagacaacggaaaccgtggaccgaggcctcccgaggcctcctcatctatgatcgcactccaacgaacgggccactagactactcccagacctaggttcaggtcggcgaggtcgggtacgngggacaggtacgtttccaacttctaccaccgtactacgacgaccgtacgcccgtaggtacctagttaccgtagtaacgtttattttacggaactttaaatttttacttaaccgttgttacgtaacggtacgttaacgggttaaacggtttcgttaccgtaaaccgtttccggtttaccccggttaaccggggtttcccgggtaaaaccccgggtaaacggggtaaacccggtaaaggggttaaccgggtaaaaaacgttaaccccggtaaaaaccgggttacggttaccgggttaacggccgttaacggtaccccgtaacttaaccgttccgtttagtttaacccccg

SEQ ID NO: 68743 - DNA, 677 bp, Homo sapiens
  misc_feature: GYAE6OF01DO267.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccacgtggagaagtagtgatgacgcagtctccagccacctgtctgtgtctcgaggggaaanacgccaccctctcctgcgagggccagtcagtagtgtagcagcgtacttagcctaggtaccagtacaacgaaaccgtcggacccgaggcctacccgacggtcctaccgtctattacctagtacgatcgactaacctaccgaacggaacgggtacctacgtagactaacctcccgacgtaccgtacggtttacgagggtacggacgtagggtcgggttaccgtcgggaactaggtacgttccaacttccgactacctacgtaccacgacctacggtcctagacgtacgttacgtaggtaacgttagttttacgtactttaacttttacgttacgtacgttacgtacgtaacttaagttaacttaacgttaccgtccgtacccgttacgttaccgttacgtttacgggaccgtaccgggtaactacgggtacgtacggactacgtaaacggaacgtaacgtggtacgacgtaacgccgtagtacg

SEQ ID NO: 68744 - DNA, 537 bp, Homo sapiens
  misc_feature: GYAE6OF01D77MK.51.76.G10.1.454.CMB.1.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagcccaccctctcctgcagggccagtcagagtgttagcagcgacttagcctggtaccagcagaaacctggccaggctccagctcncatctatgatgcatccacaaggccactgatactccagccagttcagtgcagtgggtctgggacagagttcactctcaccatcagcagcctagcagttctagtaacgttattttgacttaattttatttacttgtacagtctaagttaattaattactacggtcccttaccgttaccttacgttttcggaccgtacggggtacctaaggtcgtaggagtactacgaaacgtacgtggtacggactcggtcacctacg

SEQ ID NO: 68745 - DNA, 621 bp, Homo sapiens
  misc_feature: GYAE6OF01ETDJX.51.76.G10.1.454.CMB.1.raw
  modified_base (289)..(289): a, c, t, g, unknown or other
  misc_feature (289)..(289): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaagacgccaccctctcctgcagggccagtcagagtgttagcagcgacttagcctggtaccagcaagaaacctggccaggcctcccgaggcctcctnatctatgatgctactaccaacgaacgggcccactacgatacgtacccgagacctacggttcaggtcggcgtagggtcgggtcgtagggacaggtacgttcactcgtacaccactcacgcacgtcccgtgcagtcgtagtaagttattttagacttaaattttacttacttcgtactagacttaagtaattaaacgtacgttacggtaccccttaccgtttaacgttaccgtttacgggacccgtacggggtaaccgtaacggtcgttaagggaacgtaacgtaaccgtaaaccgtaacgttcggtacggtaccttacggacccgtacctacg

SEQ ID NO: 68746 - DNA, 593 bp, Homo sapiens
  misc_feature: GYAE6OF01BYE3T.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaancgccaccctctcctgcagggccagtcagagtgttagcagcgacttagcctggtaccagcaagaaacctggccaggcctcccgaggcctcctcatctatgatgcatccacgaacgggccactgactactcccagccaggttcagtggctaggtcgggtctgggacagtacgttcaccgtctacaccgatacgacgcgacgtcctagctagtctacggtaagttacttttagactttaagtttactttacttggtacacgtactaagttacttaaacgttacgttcggtacccttaccgttaccttccgtttcggaccggtacggggtaacctaggtcggttaggaacgtaacgtacgaaaacgtacgttacggtacggtactcggtacctaccgtacg

SEQ ID NO: 68747 - DNA, 653 bp, Homo sapiens
  misc_feature: GYAE6OF01BGKUA.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgcagggccagtcagagtgttagcagcgacttagcctggtaccagcagaacctggccaggcctcccgaggcctcctcattctatgatgcatccgaacgacgggcccagtgactactcccaagcctaggttcaggtcggctaggtgggtctggggactaggtacgtttcacgttcctactaacctatacgacgccgacgtcccgttggactacggttacgtaggtaacgttacttttacgtactttaagttttactttacgttcgttacagtactaagttaacttaaacgttaccgttacggtacccttacccggttaccttacggttttacgggacccggtaaacggggtaacccgtaaacggtcggttagggaacgtaacgtaacccgtaaaacgggtaacgttgggttacgggtcgttaaccggccctaacccgtaccg

SEQ ID NO: 68748 - DNA, 756 bp, Homo sapiens
  misc_feature: GYAE6OF01CZ5Z4.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcgaggggccagtcagagttgttagcagcgacgttagccgtggtaccagcaacgaaaccgtggccacggcctcccgaggcctccgtcatctatgatcgctactccacgacggcctacgtgactactcccgagccgtaggttcgacggtcggaccgtagggtcgggttcgtggggaacctagggtaacgttccaaccgttcctaccgaccgtaatccgaacggcctaacggtccccttagggtacctaacggttaccgttaaggttaaacgtttacgtttttacggtaacctttttaaagttttttaaccgtttactcgggtttactaacggttacgtttaaaaggtttaaccgtttaaacgttaaccggttcccgggttaaccccgtttaccggttaccgttttaacgggttttaccggggacccgggtaaacgggggtaacccaacgggttacgtacggggtaaacgttaaacgttaaacccggtaaaaccggttaaccggttacggggacggttaccctaaccggtcctaacccgtttaacg

SEQ ID NO: 68749 - DNA, 753 bp, Homo sapiens
  misc_feature: GYAE6OF01DYNXK.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcagggccagtcagagtgtagcagcgacttagcctggtaccagacaagaacctggccaggctacccgaggctcctcatctatcgaagtcgacactccgaacgaacgggccacgtagactaacctcccgacgtaccgtaggtttccgaaggtggaccgtaagggtttcggggtaccgtagggggaactaacgggttacgttaccgaacctttccgtaaccgtaacccgtaactacgaaccggaccgtaacggtcccttacggccgtaacggttaccgtttaaggtaaacgggtttacttttttacggaactttaaattttttaacgttaacgtttacggttacgtaacgggtaacttaaaggtttaaacttaaacgttaaacccgttcgggttaaccccttaaccggttaaccgtttaccggtttttaacccgggaacccgggtaaaccggggtaacctaacgggtccggttaagggaacggtaaaccgtaaccgtaaacggtaacgttcgggtacgtacgtacggtacctacggttaacc

SEQ ID NO: 68750 - DNA, 638 bp, Homo sapiens
  misc_feature: GYAE6OF01CG3I9.51.76.G10.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (293)..(293): a, c, t, g, unknown or other
  misc_feature (293)..(293): n is a, c, g, or t
  modified_base (621)..(621): a, c, t, g, unknown or other
  misc_feature (621)..(621): n is a, c, g, or t
tcagcgatcgtatacacgaccggtgctcgatttagtcactcatacagggggaggaacgtgctcagttaggacccagacggaaccatggaagccccagcgcagcttcctcttcctcctgctactctggctcccagataccactggagaagtagtgatgacgcagtcctccagcccacccttgtcctgtgtcctcgaggggaaacncgccacccgtctcctgcagggccagtcagngtgtagcagcgtactagcctgtaccagcaacgaacctggccaggcctccgaggctaccncatctatgatcgcactccaacgacgggccagtgataccgacccgacgtccgtagttcgaggttggactagggtgggtaccggtgggactagggtactttccaccgttctaccaaccgtactaccgaacgtccgacgtcccgtgacgtggtccgtaggtaagttacgttttaagacttttaattttagtaacttggtaactaggtaacttaaggttaaacttaacgtaacttccggttacccttaccgttacgtttaaccggtttcggacggtaacgggaacctagtcgtaggaaactcgtaaaccgaaagtcccggttaggtaccgtntaccggcctaaccgtcg

SEQ ID NO: 68751 - DNA, 704 bp, Homo sapiens
  misc_feature: GYAE6OF01B8L4S.51.76.G10.1.454.CMB.1.raw
  modified_base (288)..(288): a, c, t, g, unknown or other
  misc_feature (288)..(288): n is a, c, g, or t
  modified_base (524)..(524): a, c, t, g, unknown or other
  misc_feature (524)..(524): n is a, c, g, or t
  modified_base (549)..(549): a, c, t, g, unknown or other
  misc_feature (549)..(549): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtcgtcctacggaaggggaaacacgcccaccctctccgtgccgacgggtccaggtacgagtagtgtagcagtcgtacttacggcctaggtaccagaccaacgtaaccgnggaccacggcctcccgacggcctacctacacttccgtagtcgactcgaccctacgtacccgaacggtaaccggacctaacgtacgaacttacccgacccgaagtacccgtaggttaccgagggttcgacggtaacgggtcggggtcgacgggtaactaacgggtacgttccacctaccgtaacaccgtcgacgaccggctaccgcgttacgactcggttaacgtggaaacgttttnttagtaacctttaatttacctcgtntaaccgttagtaactaattaacgtaacgtaccgtccggttacttaccggttatacccgggttggaaccccggtacgggaacctagggccttaagggaaacctacgtaaaccggtaaacgtcgggtcggtaacgtcctacacccgttagttacccg

SEQ ID NO: 68752 - DNA, 531 bp, Homo sapiens
  misc_feature: GYAE6OF01BZ26Z.51.76.G10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (351)..(351): a, c, t, g, unknown or other
  misc_feature (351)..(351): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcaggggaaangccaccctntcctgccagggccagtcagagtgttagcagcgacttagcctggtaccagcagaacctggccaggcctcccaggctcctcatctatgatgcactccacgaacgggcccatgatactcccagcctaaggttcagtggcgaggtgggtcngggacagagttcactctcacatcacgcagcctgcgacgtaccgtagaagtattttgacttaatttattactgtcagtcgtagtactaattaactcgacccttacgtactacgtttcggcgtacgggaccaggtcgtaggagtacacgtaaacgacgttggtcgactcgccgtaccgtacg

SEQ ID NO: 68753 - DNA, 670 bp, Homo sapiens
  misc_feature: GYAE6OF01CVW5D.51.76.G10.1.454.CMB.1.raw
  modified_base (196)..(196): a, c, t, g, unknown or other
  misc_feature (196)..(196): n is a, c, g, or t
  modified_base (358)..(358): a, c, t, g, unknown or other
  misc_feature (358)..(358): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaaggggaanacgcccaccctctcctgcgagggccagtcagagtgtagcagcgacttgcctgtacagcagaacctgccaggcctccgaggcctctacatctatgatgacatcccacgaacgggccacgtgatactcccagccgtaggttcaggtcggctaggtcgggtacgnggggacaggtacgttcgaacttccaccacctacgtactacgctacgtcctgtacgtaacggttccgtaggtaacgttacgtttttaggaacctttaagttttaacttttaacgtcgttaccgagtaaccgtaagtttaacttaaacgttaaccggttacggtaccctttacccggttacgtttaaccggtttttaccgggaccccggtaaacgggggtaccctaaacgggtaccgtagggaacggtaaacttaaaccggtaaaacgtaacggtacgggttacgggacgtttaccggaccgtaccgttaaccg

SEQ ID NO: 68754 - DNA, 565 bp, Homo sapiens
  misc_feature: GYAE6OF01ANO99.51.76.G10.1.454.CMB.1.raw
  modified_base (195)..(195): a, c, t, g, unknown or other
  misc_feature (195)..(195): n is a, c, g, or t
  modified_base (439)..(439): a, c, t, g, unknown or other
  misc_feature (439)..(439): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctcctgcagggccagtcagagtgttagcagcgacttagcctggtaccagcagaacctggccaggcctcccaggcctcctcatctatgatcgcactccgaacgaagggcccatgactactcccagccgtaggttcaggtcggactagggtcgggtcgtggggactaggtacgttcactcctacacctatcagcagcctgcagtcgtagagttagtttagacttaatttattacgtntacgtagtactaagtaataactaacgtcgtacctaccgttactacgtttcggaccgtacggggacctaacggtcgtagggagtacgtaccgaaacgtaacgtggtacgaccgtcgccgtacgtacg

SEQ ID NO: 68755 - DNA, 722 bp, Homo sapiens
  misc_feature: GYAE6OF01DA2E9.51.76.G10.1.454.CMB.1.raw
  modified_base (459)..(459): a, c, t, g, unknown or other
  misc_feature (459)..(459): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccaccctgtctgtgtctccgaggggaaagacgccaccctctccgtgccgagggccagtcagtagtgtagcagcgtacttacgccgtaggtaccagacgaacgtaaaccgtcggaccgacggcctaccccgacggtccctcctactactcctaagtcgtatcgactacgacccgaacgaacgggtcccacgtacgtaactaccgtacccacggtaccgtacggtttaccgaaggtcgggacgtacgggttcgggtaccgtaggaacgtagtacgttccgaccttcgtacaccngtacacgtccgacgtccgtgacgtacgtacgtagaacgttagtttagtaacgtttaattttacgtacgttcgtaaccgtaaggttactaaggttaaacgttaacgttaaccggtaccgttcccgtttaccggttaaccttacgggtttaccgggacccgggaacgggtaaccgtaaacgggtccggttaaggaacgttacgtaacccggttaaaacggacccggttaggtccgggaacgttcctaacccgtaccgtttacccg

SEQ ID NO: 68756 - DNA, 580 bp, Homo sapiens
  misc_feature: GYAE6OF01B0IFF.51.76.G10.1.454.CMB.1.raw
  modified_base (197)..(197): a, c, t, g, unknown or other
  misc_feature (197)..(197): n is a, c, g, or t
  modified_base (376)..(376): a, c, t, g, unknown or other
  misc_feature (376)..(376): n is a, c, g, or t
  modified_base (435)..(435): a, c, t, g, unknown or other
  misc_feature (435)..(435): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggcctcccaggcctcctcatctatgatgcatccaagaacgggccatgatactcccagccgtaggttcaggtggctaggtcgggtctggggactaggtacgttcacttcncacatcagcacgcctgctagtctaggtaattagttttgactttaattttacttacgttnttacgtagtacgtaagttaataaagttaaccgtcggtacccttaccggttacgttaccgttttcgggaccgtaacgggacctaaggtcgtagggacgtaacttaccgaaacggtacgttcggtacggacgtcgaccgtacctacg

SEQ ID NO: 68757 - DNA, 577 bp, Homo sapiens
  misc_feature: GYAE6OF01A9HAR.51.76.G10.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (473)..(473): a, c, t, g, unknown or other
  misc_feature (473)..(473): n is a, c, g, or t
tcagcgatcgtatacacgaccggtgctcgatttagtcactcatacagggggtagggaactgctccagttacggacccgagaccggaaccattggaagccccagcgcagcttctcttcctcctgctactctggctcccgagtataccactggagaagtagttcgatgacgcagttactccagccacctgtctgtgtctcgaggggaancggccacctcncctggccaggccagtcagngtgttagcagtcgacttagcctggtaccagcagaacctggcctacggcctcccgaggtcctaccgtcgacttcgtagtggacgtcgacctaatacccgacgaacggggccaacgtgaatactccagccgtaggttcaggtgacgaggtcgggtcngggacnggtacgttacactctacactatacagctacgctagctagtctagacttagtttcacttatttactacgtgtacanctaagtactaatacgtcgtccttaccgacttcgttcgaccgtacggactaacgcgtaggatacgtacgtaaacggtacgtacggtacgtcgtcgccctacgtcg

SEQ ID NO: 68758 - DNA, 548 bp, Homo sapiens
  misc_feature: GYAE6OF01B1HZG.51.76.G10.1.454.CMB.1.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcaggggaaangccacctctcctgcagggccagtcagagtgtagcagcgacttagcctggtaccagcagaaacctggccaggcctccaggctcctnatctatgatgcatccacaagggcccactgatactcccagccaggttcaggtggcagtgggctggggacagacgttcactctacaccatcagcagcctgcaagtctagaagtattttgactaattttattactgtcagctagtataatacgtcgtacctccgtactacgtttcggaccgtaaggggaacccaaggtccgtagggaacgtacgtaaccgaaaacggtaaccgttgggtacggtaccgttacggacccgtaaccccttaag

SEQ ID NO: 68759 - DNA, 847 bp, Homo sapiens
  misc_feature: GYAE6OF01EG48L.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagactaccactggagaagtagtgatgacgcagtctccacgccacctgtctgtcgtcgtaccgaagggaaacgcgcccaccctctcctgcgacggccagtacgagtagtgttacgcgacgtacgtacgttacgccgtacggtaccaggacaacggtaaacccgtcggacccgtacggcctacccgacggccttccctactacttactagtacgtacttccgaccgtacgtacccgaacggtaacgggccctaaccggtagtaaccgttaccgtaccccgaaggtcccgtaacgggtttaccgaacgggtacgggtaccggtacgggttcgggttaccgtacggggtaaccttacggtaaccgttttacccgaaccgtttccccgaaccgtaacccgtaaccgttaccggaaccggtaccgtaccggttacccggttacggtaccgttaacgttaacgttaacggtttaaacgtttaacgttttacggtaacttttaaacgttttaacgtttaacgttacgtaccgtaacgtaacgtttaacgttaaccgttaacggttaaccgtaccgggttacccgttacccggtttaacgttaaccggtttacgggaacccggttaaccgggaaacgtaacgggtacggttaacgggtaacgtaaaccgtaaccggtaaaccgtacggttacggtaccggtaacgttctaacccgttaccgttaacg

SEQ ID NO: 68760 - DNA, 758 bp, Homo sapiens
  misc_feature: GYAE6OF01B4KFE.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgccagggccaggtcagagtgttagcagcgacttagcctggtaccaggcaaggaaacctggccagggcctcccgaggcctcctcatctatgatgcatccacgaagggccacgtgactactcccagccgtaaggtttcgaggtggccgtagggtgggtacctcgggggaactacggtacggtttaccaaccgttccctacgaacccgtacttaccgaacgtccgtacggtcccccgttagggtccctaacggtttacgttaaggtaaacggttttaacgttttttacggaaacctttttaaagtttttaacccgtttaacggtttacggttaccgtaaggtaccgttaaaggtttaaacttaaaaccgtttaaaccggttcgggttaacccccgtttaccgttaaaccgttacccgggtttttacggggaaccccggttaaacggggggaaaccccgtaaggttccgggtaagggaacgggttaaacttaaacccggaaaacggtaccgggttcggttacgggacgttaccggacccgtaaccgtacg

SEQ ID NO: 68761 - DNA, 661 bp, Homo sapiens
  misc_feature: GYAE6OF01CY3XL.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgcagggcccagtcagagtgttagcagcgacttagcctggtaccagcaacgaaacctggaccaggcctcccgaggcctcctacattctatgatcgcactccaacgaacggccatcgactactcccgagtcctaggttcaggtcggctagggttcgggtctgggacgagtacgtttccacttcctacaccatccacgccacgcctcgactacgtcctagtaacgttattttcgacttaaattttacttaccgtgttaccaaggtaacctaattaaacgttaaacgttaacccgttggacccctttaccggttacgtttaccggttttccgggaaccgggtacgggggtaaaccctaagggtccggttaagggaacggtaaacgttaaaccggaaaaaccggttaccggtttggggtaccggtaccgtaccggacccctaaacgtttccg

SEQ ID NO: 68762 - DNA, 595 bp, Homo sapiens
  misc_feature: GYAE6OF01CKEI8.51.76.G10.1.454.CMB.1.raw
  modified_base (184)..(184): a, c, t, g, unknown or other
  misc_feature (184)..(184): n is a, c, g, or t
  modified_base (202)..(202): a, c, t, g, unknown or other
  misc_feature (202)..(202): n is a, c, g, or t
  modified_base (455)..(455): a, c, t, g, unknown or other
  misc_feature (455)..(455): n is a, c, g, or t
  modified_base (482)..(482): a, c, t, g, unknown or other
  misc_feature (482)..(482): n is a, c, g, or t
  modified_base (499)..(499): a, c, t, g, unknown or other
  misc_feature (499)..(499): n is a, c, g, or t
tcagcgatcgtatacacgaccggtgctcgatttagtcactcatacaggggggaggaactgctcagttaggacccagacggaaccatggaagccccagcgcagtcttctcttcctcctgctactctggctcccagactaccactggaagaagtagtgatgacgcagtctcagccacctgtctgtntcgtaccgaaggggaaanacgccaccctctcctgctacgggcagtcagagtgtagcagcgattagcctggtacagacaagaaacgtgaccaggcctccgagcctcctcactctatgaactcgacactaccaacggaacgggcctaacgtgaactacctcccgaagtcccgtaaggttccgaaggtcggacgtaggtcggtcgtagggacaggtacttcgactcgtacaccataccgagacctaggcctggacgaaggtactcggtaaagtntttacggacttaatttacgtatcgtanataactaagtaattaanacgtcgtcctacctacgttacgttcgggactagggacctaaagtcgtaagaacgtaactaaccgaaagtaactgggtacgagtacacgtacttacg

SEQ ID NO: 68763 - DNA, 590 bp, Homo sapiens
  misc_feature: GYAE6OF01A5XWW.51.76.G10.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcaagaacctggaccaggcctcccgaggcctccncatctatgatgcatccacgaggcccatagactactccagccgtagtcagtggcaggtcgggtctgggacagtagttcacgtctacacatcagcacgcctcgctacgttctagtagttacgttttagacttaattttacttacttcgtacgtacgtactaagttaacttaagtaacgttcgtacccttacgttacttacggttttacggaccggtacggggtaacctaacgggtacgttaggtaacgtacgttaacgaaaaccggttacgttacggtacggtacctacgtacccgtaacgtacg

SEQ ID NO: 68764 - DNA, 748 bp, Homo sapiens
  misc_feature: GYAE6OF01CLJIL.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagagccaccctctcctgcagggccagtcagagtgttagcagcgacttagcctaggtaccaggcagaaacctggaccaggctcccgaggcctcctcatctatgatgacataccacgaacgggccaactgtaactacctaccccgagacccgtacggttaccgaaggtcgggaccgtaagggttcggggttaccgtaggggaactaggtacgtttccacttcctaccaacctactacacgacgacgccgtgacacgtacgtaggtaagttacgtttttacggtaacttaacgttttaactttaacgttacgtacgtaacgtaaccgttaaaggttaaacttaaaacgttaaaccgttaccgggttaccccgttacccggtttaaccgttaaccggttttttaccgggaaccccgggtaaacggggggtaaaccccgtaaacgggtaccgttaaggggtaacggttaaacgtaaacccgtaaaaacccggttaaaccggttacggggtttaacggtaccggttaaccggtaacccgtaaacccgttaaacccggg

SEQ ID NO: 68765 - DNA, 793 bp, Homo sapiens
  misc_feature: GYAE6OF01DZDPW.51.76.G10.1.454.CMB.1.raw
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccacgccacccttgtctgtcgtcctacggaaggggaancgccctacctcctccnggcgcgggccagtcgagtgttgtacgcaggccgtacgttacggccgtacggtaccacgaccgaacggaacccgtcggaccgaaccgggtccctacccggacggtcctcccgtacaccgttacgtatcgaactccgacctaaccgtaccgaaacggtaaccgggtacctacggtacgtaaacgttcccgaacccccggtagtacccggtaacggttccggaagtccgggtaccgggttagggtccggttcgggacggtaactacgggttactacgtaccttccgacctaactactacgacgcgtaccgtcgtacgtacgtacgttactacggttaagtttacgtttacggtaacttttaacgtttaacgttacgttacgttacgtaacggttaacttaagttaacgttaacgttaccggttacccgttaaccggttaacccgttaccggtttacggtttaccggggaaccggttaaccgggaaacgttacggttacgggtaaggttaaacggtaacgtaaaaccggtaacggttacggttaacgggcggttaaccgtacgtcccgtaccgttaccg

SEQ ID NO: 68766 - DNA, 605 bp, Homo sapiens
  misc_feature: GYAE6OF01CP7MT.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagcccaccctctcctgcagggccagtcagagtgtagcagcgacttgcctggtaccagcagaaacctggccaggcctccgaggctcctcatctatgatgcatccaagacgggccactgatactcccagacctaggttacaggtggacctaggtcgggtacgtgggacaggtagttcacgttcacctaccatcagccacgcctgcgtagtacgtgtaagtattttcgacttagtttactttattcgtactacgtacgaacgtacggtaaaacctacgtcggtcccttaccggttacggtaccggtttaccggaccggtaacggggaaccgtaaggggtaacggaaagttaaccgaaaacggtaacgttacgggtacggtacgtacggacctaaccgtgttccgttaccg

SEQ ID NO: 68767 - DNA, 849 bp, Homo sapiens
  misc_feature: GYAE6OF01B0JAF.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctcgaggggaaancgccaccttctcctgcagggtccagtcagagttcgtagcagcgacttagcctggtaccagcagaaacctggccaggctcccgaggcctcctctactctagtcgatcgacactacccgaacgaaacggggccctaactcggtaataaccgttccccgaacggtccccgaaagggttttccaaacggggttggggacctaaggggtttcggggtcgttacggggggaaccctaaggggtaacggtttaccgtaacttcccgtaacctaaccgaacttccggaagacctacgggtacccttggaccgtaacggttaccgttaacggaaacggttttacgtttttagggaaacccgttttaaatttttaacggtttaaacccgtttcggttaaccgttaacggacgttaaacgggtttaaactttaaaaaccgtttaaccggttaccggggttaacccttttacccccgggtttaacgttttaaccgggtttttacccggggaccggtaaaccggggggtaaacccccttaaaaggggttccccggtttaggggaaaaccgggttaacgtttaaaccccgggaaaaaccgggttaaaccgggtttaccggttaacgggtaaccttacccggggttaaccctaaacccggtttaacccg

SEQ ID NO: 68768 - DNA, 649 bp, Homo sapiens
  misc_feature: GYAE6OF01C41FU.51.76.G10.1.454.CMB.1.raw
  modified_base (91)..(91): a, c, t, g, unknown or other
  misc_feature (91)..(91): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
tcagcgatcgtatacacgaccggtgctcgatttagtcactcatacgagggggaggaactgctcagttaggacccagacggaaccatggaancccagcgcagcttctcttcctcctgctactctggctacccagataccactggaagaagtagtgatgacgcagtctccagccacctgtctgtgtctaccgaaggggaaancgcctacctctccnggcacgggccagtcagtagtgtagcagcgtacttagccgttaggaccagacagaacctggaccaggctccgagtctcctnatctangtagtcacactaccgaacgtaacggccagtacgacttacgcccgagtccgtaggttaccgaggtacggacgtagggtacgggtcgaggtaacacgtacgttcaaccttcctacaacctagtaccgaacgtacgacgtaccgtgacgtaacgtacttagggtaaacgtttcttttacgaactttaagttttacgtttaacgtggtactacgaacgtaagttaacttaactacggtctacccgttacgtacgttacgttaccgggaccgaacggggtaccaagtacggtacgggaaacttaacgtaacccgtaaaggtacgttacggacgacgttaccgacgtacttacgg

SEQ ID NO: 68769 - DNA, 856 bp, Homo sapiens
  misc_feature: GYAE6OF01EMUZU.51.76.G10.1.454.CMB.1.raw
  modified_base (202)..(202): a, c, t, g, unknown or other
  misc_feature (202)..(202): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccacgtggagaagtagtgatgacgcagtctccagcccaccctgtctgtcgtctcgaaggggaaancgcccaccctctcctgcgagggccagtcagtagtgttagcagcgtacttacgccgtaggtaccagaccaagaaacccgtggaccgacgtcctacccgaggccttcctctacttctactgactcgacctacctacccgaacggaacgggccctacgtacgtacttaccgtacccgaacggtacccgttaacgggttaccgtacggtcgggtacggtacgggtttcgggttacccgggtagggaaccgtaacggggttacgtttaccgaaccgtttcccgtaaccctaccgtaactacccggacgaccgttacggtacccgttcggaaccgtacgtttaaccgtaggttaaacggttttacgtttttaaccggtaactttttaaagttttttaacgtttacccggttaacggttaacgtaacgttaacgtttaaacgtttaaacttaaaccgtttaaccgggtttccggttaacccccttttacgggttaacccttttaccgggttttaccgggaacccggggttaaccgggtaaaccccgttaggttaacccgggttaagggtaaacccggttaaacgtaaaacccggtaaaacgggtttacccggtagggttaacccgggccctttaaccgtaacccggttacccgttaaccgg

SEQ ID NO: 68770 - DNA, 612 bp, Homo sapiens
  misc_feature: GYAE6OF01BZWA6.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgtagcagcgacttagcctggtaccagcagaacctggaccaggcctcccgaggcctcctcatctatgatgcactccaacgaacggccatgactactcccgagccgtaggttcaggtcggctagggtcgggtcgtacggggactaggtacgtttccacgttcctaccaacctagtccgaacgccgtaacgtcccgtgacgtacgttctaggtaagtttacttttgaactttaattttacttacttagtactaggtactaagttaataacgttacgtcgtacccttacgtacgttacgtttacgggaccgtaacggggtacctaaggtcgttagggaacgtactaacggaaacgtacggttcgtacggtacctacgcctacgtacg

SEQ ID NO: 68771 - DNA, 546 bp, Homo sapiens
  misc_feature: GYAE6OF01D7MDP.51.76.G10.1.454.CMB.1.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctccaggctcctnatctatgatgcatccacgaaggccactgatactcccagcctaggttcagtggcgaggttcggtcgtgggacagtacgttcacgtctacgacatccagacacgtcctgcgagtctagtaagttattttgacttaagttttacttacgttcgtactacgtactaagtaacttaactaaccgtcgtacctaccgtacttacgtttcggaccgtagggaccagtcgtaggacgacgtaacgaacgaacgtcgtaggactgccgtcgtacg

SEQ ID NO: 68772 - DNA, 697 bp, Homo sapiens
  misc_feature: GYAE6OF01C87M3.51.76.G10.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccngacagaaacctggcccaggcctcccgaggctcctcatctangatgcactccacgacgggccacgtgactactcccagccgtaggttccaaggtggaccgtagggtcgggtcgtaggggtaccaggtacgttcaacgttcctacaccgtataccgacgtcacgcccgttagctaacggttcctaggtaacggttactttttcgaacctttaagttttaacttttaacttcggttacgtacgtacgttaacgttaaacttaaacgttaaaccgttcgggtaccccgtttacccggttaaccgttaccggtttttaccgggacccggttaaccgggggtaaccctaaacggggtccgttaaggggtaacggtaaacgtaaacccggtaaaaccggtaaaccgttaccgggttacgggaccgttaacggtcccgtaacccgttaacg

SEQ ID NO: 68773 - DNA, 664 bp, Homo sapiens
  misc_feature: GYAE6OF01C6R6Q.51.76.G10.1.454.CMB.1.raw
  modified_base (195)..(195): a, c, t, g, unknown or other
  misc_feature (195)..(195): n is a, c, g, or t
  modified_base (291)..(291): a, c, t, g, unknown or other
  misc_feature (291)..(291): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgccaccctctcctgcagggccagtcagagtgtagcagcgacttagcctggaccagacaacggaacctggaccaggcctcccgaggtcctccctnacttctaatcgactcgacctaactcccgaacggaacgggccctaacgttagaacttaccgcccccgaaggtcccgtaaggtttccgaggttcgggctaggggttcgggtctaggggaactagggtactttccaacgttccgtaccacctacgtcgaacgcctacgtcctacgtactacgtacgttagtaacggtttattttacgtactttaattttacgttacgtgttaccagtacctaagttaacgttaaacttcgtaccgtaccgtttaccgttaccgttacgtttcggaccggtacgggtacaacgggtcgtaagggactaacgtaacgtaaacggttacgtacgggtacgacgtccaccgtaacggtcc

SEQ ID NO: 68774 - DNA, 700 bp, Homo sapiens
  misc_feature: GYAE6OF01D54K0.51.76.G10.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgagggaanacgccaccctctcctgcgacggccagtcagagtgttagcagcgacttagccgtggtaccagacaacgaaccgtggaccaggcctacccgaggcctcctctatcgtatggatcgccactacccaacggaacgggtccaacgtgtaactacctacccgacgtaccgtaggttccgtaggtcgggacgtaggggttcgggtacggtacggggactaggttacgttccgtaccttcctaccgaccctaactccgaacgacgtaccgtacccgttgaccgtaagttacgttaaggtaacgttttacgttttacggtaacttttaagtttttaacttaccgttaggtaccgtagtaaccgttaatttaaacgttaacgtaccgttcccgtacccgtttacccgttacgtttaccggtttaaccgggacccggtaaacggggaccgtaagtcggttagggaacgtacgtaaacgaaacgtaacggttggtacgacgttacgacctacgtaccg

SEQ ID NO: 68775 - DNA, 707 bp, Homo sapiens
  misc_feature: GYAE6OF01AUE7Y.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtgtgatgacgcagtctccagccaccctgtctgtcgtctccgaaggggaaacncgccctaccctctccgtgcgacgggccagtcagtagtgtagcagcgtacgttagccgtggtaaccagcaacgaaccgtggccaggcctacccgaggtcctcctctactctagtgactcgctactaccgacgtaacggcctagtactactaccgccgaacggtccgtaacggtaccgaggtccgggtacgtacgggttcgggtactacggggactacgggtacgtttcctaaccgttccgtaccgtactacgtacgacgtaccgtacgtccgtcgtaacgtacgtacgtacggtaacgtttacgtttacgtaaccttaagtttacgttacggtacgttaacgtacgtaacgttaacgttaacgtaacgttaaccggttaccgttaccggtttaacccgttaacgttaccggtttacggaaccggttaacgggtaaccgtaggtccggtaggtaacggtacgtaacgtaaccgtacggtcggtacggtccggtactaccgtcgttaacg

SEQ ID NO: 68776 - DNA, 554 bp, Homo sapiens
  misc_feature: GYAE6OF01COQZU.51.76.G10.1.454.CMB.1.raw
  modified_base (197)..(197): a, c, t, g, unknown or other
  misc_feature (197)..(197): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaacctggccaggctcccaggcctcctcatctatgatgcatccacaagggccacgtgatactcccagccaggttcaggtgcaggtgggtctgggacnggtacttcactcncacctatcagcgagcctgctagtctagaagtattttgacttaatttacttactgttacagtctaagttaataactacgtcggtcccttaccgttacgttacgttttcgggaccgtaacggggaccctaaggtccgtaggaacgtactaaccgaaagtacgtaggtcggtacgtcgccgtacgtacg

SEQ ID NO: 68777 - DNA, 535 bp, Homo sapiens
  misc_feature: GYAE6OF01E44QP.51.76.G10.1.454.CMB.1.raw
  modified_base (198)..(198): a, c, t, g, unknown or other
  misc_feature (198)..(198): n is a, c, g, or t
  modified_base (327)..(327): a, c, t, g, unknown or other
  misc_feature (327)..(327): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
  modified_base (479)..(479): a, c, t, g, unknown or other
  misc_feature (479)..(479): n is a, c, g, or t
  modified_base (508)..(508): a, c, t, g, unknown or other
  misc_feature (508)..(508): n is a, c, g, or t
  modified_base (528)..(528): a, c, t, g, unknown or other
  misc_feature (528)..(528): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagccaccctctcctgcagggccagtcagagtgttagcagcgacttagcctggtaccagcaacgaaacctggccaggcctcccaggcctcctcatctatgatgcactccacgaacgggccacttgatacncccagccgaggttccaggtcggcgtaggtgggtcgtagggactagacgttcactctacacctatccgagcacggcctagcgtagtctagtaagtnttttagactttaatttattcgtntcacgctaggcgtagtactagttcgtccctccgntctcctacgtccgacgacgacacgtacgngaaagaactaacgatggtcngtgaccc

SEQ ID NO: 68778 - DNA, 609 bp, Homo sapiens
  misc_feature: GYAE6OF01C3UUX.51.76.G10.1.454.CMB.1.raw
  modified_base (196)..(196): a, c, t, g, unknown or other
  misc_feature (196)..(196): n is a, c, g, or t
  modified_base (337)..(337): a, c, t, g, unknown or other
  misc_feature (337)..(337): n is a, c, g, or t
  modified_base (451)..(451): a, c, t, g, unknown or other
  misc_feature (451)..(451): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgccaccctctccctgcagggccagtcagagtgtagcagcgacttagcctggtaccagcaacgaaaccgtggccagggcctcccgaggcctcctctatctatgatcgcactaccgaacgacgggccctacgtgtataccncccgagccgtaggtttcaggttcggcgtagggttcgggtcgtgggaacaggtacgttaccacttccgtacacctacgtcgacgcacgtcctcgcgtacgttacgtagttaagtnttttagtactttaagttttacttacgtgtactagtacgtaagttaagtaacgtacgtcggtacccttaccgttacttaccgtttcgggaccgtacggggacctacggtcgtaggaagtacaaccgtaaacgtacgtggtacggtctcgtccgtctacg

SEQ ID NO: 68779 - DNA, 623 bp, Homo sapiens
  misc_feature: GYAE6OF01BTKYX.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcacagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggctcccaggcctcctcatctatgatgcactccacgaacgggcctacgtgatactcccacgccgaggttcgaggtggctaggtgggtcgtgggactaggcgttcacgtctcacctatcagcacgtcctgctagtctagtaagtgtttacgacttaagtttattacgttacgtacgtagtacgttaagttaacgttaaacgttaacgttccggttacccttaccgttaccgttaccggttttacgggtacccggtacggggggtaaccctaacgggtccgttaagggtacgtaaccgtaaccggaaaaccggtaacgttcgggtacgggttaccgtacgtacccggtaccttaacgg

SEQ ID NO: 68780 - DNA, 736 bp, Homo sapiens
  misc_feature: GYAE6OF01A0FPK.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggcctcccgaggcctcctcatctatgactgcactccacgaacgggccactgactactcccagcctaggttcaggtggacaggtcgggtctggggacaggtacgtttccgacttccgtaccaacctacgtaccgtacggaccgtacggacccttacggtaccgtaaggttacccgttaggtaaacgtttacgtttttacgggtaacctttaaacgtttttaacgtttacgtttacggttaccgtaacggtacgttaacgtttaaacgttaaaccgtttaaccgttaccgggttacccctttacccggtttaccctttaaccgggtttttaccgggaacccggttaaccgggggtaaacccgtaaacgggttccggttaacggggtaacggttaaccgttaaacccggtaaaaccgttaaccgggttacggttacgggtaccgttcggtaacccgtaacccgttacccgg

SEQ ID NO: 68781 - DNA, 779 bp, Homo sapiens
  misc_feature: GYAE6OF01BVMY1.51.76.G10.1.454.CMB.1.raw
  modified_base (200)..(200): a, c, t, g, unknown or other
  misc_feature (200)..(200): n is a, c, g, or t
  modified_base (771)..(771): a, c, t, g, unknown or other
  misc_feature (771)..(771): n is a, c, g, or t
  modified_base (779)..(779): a, c, t, g, unknown or other
  misc_feature (779)..(779): n is a, c, g, or t
tcagcgatcgtatacacgaccggtgctcgatttagtcactcatacagggggaggaactgctcagttaggacccagacggaaccatggaagcccagcgcagcttctcttcctcctgctactctggctcccagactaccacgtggagaagtagtgatgacgcagtcctccagccacctgtctgtgtcctccggaaggggaanacgccctaccctcgtcctggcacgggccagtcaggtagtgtaagcagcgtacttgccgtagtacagacaagaaccgtgaccacggcctacccacggtccctcctactacgttactacgttacgacttcgacctacgtacccgaaccgacgggtccacgttacgacctaccgtcccgacgtaccgtaggttaccgagggtccggacgtacgggtttacgggtaccggttaggggaacccgtaaagggtccgttttaacccgtaaccgttcccgtaacccgtaaccgtttacgcccggtaaacccgtccgtaaccgttcccggtaggtaacccgtaacgggttaaccgttaagggttaaacgtttttacgtttacggtaaactttttaaacgttttaccgtttagtttaccgaacgtaagttaacgtttaaagggttaaaccttaacgttaaccggttccggtaccctttaaccgggtactttaaccgttcgggaacccggtagggttaaccaggttccggtaaggaactacggtaaacccgtaaaggtcgtacggtacggacttaccgttanacccgttn

SEQ ID NO: 68782 - DNA, 623 bp, Homo sapiens
  misc_feature: GYAE6OF01CAK8C.51.76.G10.1.454.CMB.1.raw
  modified_base (197)..(197): a, c, t, g, unknown or other
  misc_feature (197)..(197): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcaggggccagtcagagtgttagcagcgacttagcctggtaccagcagaacctggccaggctcccaggctcctcatctatgatgcatccacgaacgggccactgactactcccagcctaggttcaggtcggacgtaggtcgggtcnggggaacngtagttcactctccacatacagtcagtacctgacacgtctagaaggttattttcgacttaattttatttcgtcgtactacgactaagttactaaacttaccgtacggtacccttaccgttacttacggttttaccgggaccgggtaacggggtaaccgaacggtaccggttaagggtaacgtaacgtaacccggtaaaaaccgtacggtttaccggggtacggtacccgttaccggtaacccgttaacccgttaacccg

SEQ ID NO: 68783 - DNA, 719 bp, Homo sapiens
  misc_feature: GYAE6OF01EGMOO.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccaccctctcctgcagggccagtcagagtgttagcagcgtacttagcctggtaccagcaacgaacctggaccaggcctacccgaggtcctcctcactctagtgatcgcactccgaacgacgggccagtgactactcccgagtccgtaggttcaggtcggacgtagggttcggggtacgtaggggactagggtacgtttccaaccgttcctaccacctacgtacgacgaccgacgtccgtacggacgtacggttacgttaacggtaacgtttacgtttttacgtaacttttaaagttttaacgtttaacgttacgttaccgtaacggtacgttaagttaacgttaaacgttaaccgttacggttaccccgttacccggttaaccgtttaccggttttaccgggacccggtaaccggggtaaacccgtaacgggtacggttaagggtaacggtaaccgttaaaccggtaaaaccggttaacgttacgggtacggtaccgtacgtacccgtaaccgttaaccgg

SEQ ID NO: 68784 - DNA, 563 bp, Homo sapiens
  misc_feature: GYAE6OF01CTMYA.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgacttagcctggtaccagcagaaacctggaccaggcctcccgaggcctcctcatctatgatgcactccacgaagggccacgtgactactcccgagccaggttcaggtggcaggtgggtctgggacaggtacgttcactctacacatcagcacgcctgctagtctagtaagtatttagtactaatttacttactcgtactagtactagtaataaacgtacgtacggtccttaccgttacttacgtttcggaccgacgggtacctaacggtcgtaggacggtacgtaaccgaaacgaacgttcggtacggtcgtacgccgtaccgtacg

SEQ ID NO: 68785 - DNA, 743 bp, Homo sapiens
  misc_feature: GYAE6OF01BWYAA.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagcgccaccctctcctgcgagggccagtcagagtgttagcagcgtactagcctaggtaccagcaacgtaaacccgtggacccaggccctacccgaggtccctcccgtactactccttaagtcgaacgttcgacctactacccgaacgaacgggccctactgaactacctcccgagcccgtaggttacagggtcggaccgtagggtcggggtacgtaggggaacgtaggtacgttacctaccgttcctaccgtaaccctacgtccacggtaccaccggtccgtacggtaccgtacggttaccgtaaggttaacgtttacgttttacgtaactttaaattttacgtttacgttacgttactacgtacgttaagttaacgttaacgttaaccgtaccggttaccctttacccgttaacgttaccggttttaccgggaaccggtaccgggtaaaccgtaacgggtaccggttaagggtaaccgtaacggttaacccggtaaaccggtaacggttacgggttacggtaaccgtcgaaccccgtaacgttaccg

SEQ ID NO: 68786 - DNA, 669 bp, Homo sapiens
  misc_feature: GYAE6OF01B9M3N.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacgagggggaggaactgctcagttaggacccagacggaaccatggaagccccagcgcagcttctcttcctcctgtctacctctggctcccagataccactggagaagtagtcgatgacgcagtctccagccacctgtctgtgtctccgaggggaanacgcccacctctcctgcagggccagtcagagtgttacgcagcgtacttacgcctggtaccagtcgaacgaaccctcggaccgaggcctccgaggtcctcctagactcttagtcgtacgtcggactactacccgaagtaaccgggccctacgtagactaccgtcccgacgaccgtaggtacaggtcggactagggtacgggtactacggggactacggtacgttccacgttccgtaccaacgtacgtaccgacgacgacgtccgtacgtaccgtagttaccgtagtaacggttagttttacgaactttaactttagttacgtagtactacgtacgtaacggtaacttaacgtacgttccgtaccgttaccgtacgttacggtttaccgaccggtaccggtaaccgtagtccggtaggacgtactaaccggtaaaccgtacgttacgggacgtaccgtcgacgtaccgtacg

SEQ ID NO: 68787 - DNA, 599 bp, Homo sapiens
  misc_feature: GYAE6OF01DGSO2.51.76.G10.1.454.CMB.1.raw
  modified_base (198)..(198): a, c, t, g, unknown or other
  misc_feature (198)..(198): n is a, c, g, or t
  modified_base (465)..(465): a, c, t, g, unknown or other
  misc_feature (465)..(465): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgcagggccagtcagagtgtagcagcgacttagccgtggtaccagacacgaaacctggccaggcctcccgaggcctcctcactctatgatcgacactccgaacgaacgggcccaacgtgaactacctcccgaagccgtaggttcaggtcgggacgtaggttcgggtcgtgggaactaggtacgtttcacgttctaccgacatcagcacgcctgctagtctagtaattgtttagacttaattttacttacgtntactagtactaagtaattaagtaaccgtcgtacccttaccggttacttaccgtttcggacccgtaacgggaccctaaggtcgtagggaactactaaccggaaacgtaacgttggacgtactcgacctacgtacg

SEQ ID NO: 68788 - DNA, 767 bp, Homo sapiens
  misc_feature: GYAE6OF01EP7Z2.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcgagggccagtcaggtagtgttagcagcgtacttacgccgtggtaccagaccgaacggtaaaccctggaccacgggcctcccgaggtcctccgtctatctaatgtactcgacactacccgaacggaacgggcctacgtacgaacttaccgtacccacgtccgtaggttccagggttcggacgtagggttcgggtacgtaggggaaccacggttacgttacccgaacttcctacctaaccctaacgtcccgtaacggaccgtaccggtccgtacgtaccgtaacggttacgttaaggtaaacgtttagtttttaacgtaaccgttttaaagttttaacgtttacgttacgtacgtaagtaccgttaaaggttaaccttaaacgttaacccggttccggttaccccttaccggtttaaccgtttaccggtttacggggaaccccggtaacggggtaaccgtaacgggtccggttaagggaacgtaacgttaaacccgggaaaaccgttaacggttcgggttaacggtacccgttacggtaacccgtaaccgttacg

SEQ ID NO: 68789 - DNA, 787 bp, Homo sapiens
  misc_feature: GYAE6OF01DDZZC.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgccaccctctcctgcagggccagtcagagtgttagcagcgacttagcctaggtacccagacaacgaaaccttcggaccgacgggcctacccgacggtcctcctcattcctatggatgacctactacccgaacgaacgggcctacgtagtaactaccgtcccaaggtaccgtaggtttccgaacgggttcgggaccgtaggggttcggggtacgtagggggtaacctaggtaccgttcctaacgttccctacaccctacgccgaacggccgtacggcccgttcggtaccgtaacggttaccgttaaggttaacggtttaacgtttttacggtaacttttaaacgttttttaacttttaaccgttcggtttaaccgtaacgttaaccgttaaaggttttaaacttaaacgtttaaccggttaccggttaccccgttttaacccgtttaccggtttaccgggtttttacccgggaacccgggttaaaccgggggtaaccctaaacgggtccggttaacgggtaacggtaacgtaaccggtaaaaccggttacgtacgggttcggaacccgtaccggaccgtaccgttaaccg

SEQ ID NO: 68790 - DNA, 708 bp, Homo sapiens
  misc_feature: GYAE6OF01B6XIB.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgcccaccctctcctgcacgggccagtcagagtgttagcagcgacttggcctaggtaccagacaacgaacctggcccacgggcctcccgaggcctccgtcatctatcgatgaccactcccaacgacggggcccacgtgtactacctcccgaagcccgttagggttcaggtcgggacgtagggttcgggtacgtaggggacaaggtacgtttacctaacgtccttaccgaacctacgtaccgaacgtaccgtacggtcccttacggtaccgtacgtaccgttacggtaaacgtttacgttttacgtaacctttaaatttttaccgtttaacgtttacggttaaccgtagtacgtaaggttaacttaaacgtaacgtttaccggtacccgtttacccgttaccgttacgggttttaccgggaccggttaccggggtaaccgtaacggaccgttaggaacgtaacgtaaccgtaaacggtaaacggttcggtacggtacgtacgactcccgtacg

SEQ ID NO: 68791 - DNA, 551 bp, Homo sapiens
  misc_feature: GYAE6OF01A08EV.51.76.G10.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
tcagcgatcgtatacacgaccggtgctcgatttagtcactcatacaggggaggaactgctcagttaggacccagacggaaccatggaagcccccagcgcagcttctcttcctcctgctactctggctcccagataccactggagaagtagtgatgacgcagtctccagccaccctgtctgtgtctccgaggggaaancgccaccctctcctgcagggccagtcagngtgttagcagcgacttagcctggtaccagcaagaacctggccaggctcccgaggcctcctcatctatgatgcatccaacgaacgggcccacgtgactactcccgagcctaggttcaggtggcaggtcgggtctggggactaggtacgttcacgttcctcaacctactcagcacgcctgctagtctagagtatttgacttaatttatacttgtctagtctaagttaataactacgtcgtccttaccgtactacgtttcggaccgtacgggaccaaggtcgtaggatacgtaccgaaacgtacgtacggtcggactcgcctccgtac

SEQ ID NO: 68792 - DNA, 681 bp, Homo sapiens
  misc_feature: GYAE6OF01C4629.51.76.G10.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtcgtctccgaaggggaanacgcccacctctcctgcaggggcagtcaagngtgtagcagcgacttagcctaggtaccagcgaacgaaaccgtcggaccacggcctccccgaggtcctcccgtactcttaccgtattaggtactcgcctaactaccgaacgaaacggggtccctaacgttggaactacctaccccgtagcccgttaaggttcctacgggttacggccgtagggttcgggtaccgaggggaactacggtacgttccaccttccgtacaactacgtcgaacggccacgtcccgtgtaccgtacggtcttaaggaactttagtttcgaaccttttaattttacttaacggttgtaaccagttaccgtaaattacgttaagttaccgccgttaccttaccggttacttacgtttcgggaacgaccggggttaccaacgtcgggttagaacgtacgaaccgaaagttcggtacgtacgtactcccgaactcgttacc

SEQ ID NO: 68793 - DNA, 705 bp, Homo sapiens
  misc_feature: GYAE6OF01A6OCC.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgcccaccctctcctgcgagggccagtcaggagtgttacgcgagcgtacttacgccgttacggtacagcaacggaaaccctgggacccaggcctcccgaggcctccgtcactctatgatgcactaccacgaacgggacctagtacgtaactactcccgaacgtccgtacggttcgacgggttcgggacgtaggggtttcgggttcggtacggggtaacgtaggtacggttttaccaccttccgtaccctaaccgacttccgacgtaccgacgccgtcggaccgtagttaccgttaggtaacgtttagttttacggtaactttaaagttttacgttacgttacgtacgttacgaacgttaacgttaaattaacgttaaccgttaccggtacccttaacggttaccgttaaccgtttcgggacccggttaagggaaccgtaacggtccggttaggaacgtagtaaaccgaaaccgttacggtcggtacggagtaccgaccgtaacgtacg

SEQ ID NO: 68794 - DNA, 630 bp, Homo sapiens
  misc_feature: GYAE6OF01DYZPR.51.76.G10.1.454.CMB.1.raw
  modified_base (197)..(197): a, c, t, g, unknown or other
  misc_feature (197)..(197): n is a, c, g, or t
  modified_base (326)..(326): a, c, t, g, unknown or other
  misc_feature (326)..(326): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaggtagtgatgacgcagtctccagccaccctgtctgtgtctccgaggggaaanacgcccaccctctcctgcgagggccagtcagagtgtagcagcgacttgcctaggtaccagcagaacctggccaggctcccgaggctcctcatctatgatgctactccacgaacgggcctactgactacncccgagccgtaggttcgaggtcggacgtaggttcgggtcgtaggggacagtacgttcacgtctaccaccatacgacgcagtcctgcacgttcagtagtagtttcgtaacttaattttactttacgtacgttacgacgtacgtaagttaactttaaacgttaccgtacggttacccttacccggttaacgttaccggttttaccgggaccgtaacggggtaaccgtaacggtacgttaggaacggttaacctaaccgtaaaaccggtacgttacggtacggtaccgtacgtcccgtaaccgtacg

SEQ ID NO: 68795 - DNA, 887 bp, Homo sapiens
  misc_feature: GYAE6OF01AIX1V.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccacctctcctgcagggccagtcagagtgttagcagcgacttagcctagaccagcaacgaacctggccaggcctacccgaggtcctcctcatcctagtgtatcgcacgtcccagtaacgggcctacgtgactactcccgagccgtaggtttcaggtcggacgtaggtcgggtcgtaggggaacctagggtacggtttccaaccgttcctaccgacctagtaccgacgccgacgtccctacgtacgtacggttaccgtaacgtaacgttacgtttttacgaacgttttaaacttttaaccggttttaccttacggttaaccgtaacggttaaccgttaaaggtttaaacgtttaaaacccgtttaaccgggttacccgggtttaacccccgtttaacccccgggtttaaccggttttaaacccccgggttttttaccgggggtaaaccccccgggtttaaaaccggggggggttaaaacccccgtttaaaaccgggggggtacccccgggttttaaaggggggtaaaaacccgggtttaacccgggttttaaaaaacccccccgggaaaaaaccccggtttttaaaacccccgggggtttacggggggtttaaacccccgggttaaaccccccggttttaccccggggttaaaacccccgttaaaccccccggggtttttaaacccccgg

SEQ ID NO: 68796 - DNA, 633 bp, Homo sapiens
  misc_feature: GYAE6OF01EGWIL.51.76.G10.1.454.CMB.1.raw
  modified_base (330)..(330): a, c, t, g, unknown or other
  misc_feature (330)..(330): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgtacttagccttggtaccagacaacgaaacctggccaggcctcccgaggcctcctcatctatgatgctactaccacgaacgggccactgatacncccgagccgtaggttcaggtcggcgtagggtcgggtcgtagggactagtacgttcacttctaccaccatcacgcacgtcctgactacgtcgtacgaagttacgttttagaactttaagttttacttacgttgttaccgagtacttaaagtttaattaaacgttaaccggtcggttacccttaccggttaaccttacggtttccggaccgtaacggggaacctaacggtcgttagggaacgttaactaaaccggtaaaaccggtacgttacggtacggtacgttacgacccgtacccgttaacg

SEQ ID NO: 68797 - DNA, 664 bp, Homo sapiens
  misc_feature: GYAE6OF01E18DD.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttacgcctggtaccagcaagaaacctggacccaggcctcccaggcctcctcatctatgactgacatccaacgaacgggccaacgtgaacttacacccgacgcccgtaaggtttccagggttcggactaggggtttcggggtacctgggggaactagggtaacgtttccaccttaccgttaccaacctaacgttccaacgtccgaacgtccctggacctaggttaccgtagtaagtttagtttttacgacttaaagtttttaacttaccgttagtaccgtaagtccgttaaagttaacttaaacgtaacgttccggttaccccttaccggttacctttaacgtttcgggacccgtaaggggaccctaagggtccgtaggactacgtaacgaaaccggtaacgtggtcggacctgcccctacgttacg

SEQ ID NO: 68798 - DNA, 579 bp, Homo sapiens
  misc_feature: GYAE6OF01A4H5O.51.76.G10.1.454.CMB.1.raw
  modified_base (197)..(197): a, c, t, g, unknown or other
  misc_feature (197)..(197): n is a, c, g, or t
  modified_base (357)..(357): a, c, t, g, unknown or other
  misc_feature (357)..(357): n is a, c, g, or t
  modified_base (458)..(458): a, c, t, g, unknown or other
  misc_feature (458)..(458): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcgaagaacctggaccgaggctcccgaggcctcctcatctatgatgacactccaacgacgggcctacgtagactacgtcccagtcctaggttccaggttcggngtacgggtcggtcgtacgggactaggacgttcaacgtctaccaccactcgacgtccgacgtcctcgacgacgtcgtagtaacgtattttgactttaatttnttactgtacacgtactaatattaagttactcggttcctaccgttacgtacgtttcggaccgtacgggaccaaggtcgtaggactaacgtacgaaacgacgtacgtcgactcgtctactacg

SEQ ID NO: 68799 - DNA, 625 bp, Homo sapiens
  misc_feature: GYAE6OF01AZJFO.51.76.G10.1.454.CMB.1.raw
  modified_base (197)..(197): a, c, t, g, unknown or other
  misc_feature (197)..(197): n is a, c, g, or t
  modified_base (474)..(474): a, c, t, g, unknown or other
  misc_feature (474)..(474): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccagcaacgaaacctggccaggcctacccgaggcctcctcatctatgatcgcactccgaacgaacgggccacgtagaacttaccgtaccccgagtcccgtaagggtttccaagggttcgggaccgtaggggtcggggttacgtcggggaactagggtacgtttccaacgttccctacaaccctatccgacggcaccggtcctcggctagtctaggtaagttnttttacgacttaatttatactgtacctagctaagttataatacgtcggtcccttacgtacttcgtttacgggaccgtaacgggtaccaacgggtgtaagggacgtactaacgaaaccgtacgtgggtcgaccgttacgccgtaccgttacg

SEQ ID NO: 68800 - DNA, 699 bp, Homo sapiens
  misc_feature: GYAE6OF01D1RDV.51.76.G10.1.454.CMB.1.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggcctcccagactaccactggaagaagtagtgatgacgcagtcctccacgcccacctgtctgtgtcctacgaaggggaacncgccctaccctctcctgcgagggccagtcagngtgtagcagtcgtacgttacgccgtacggtaccacggacaaacggtaacccgtcgggacccgacggtccctacccgacggtcctccgtactacgttctatacggtacttccgactaacctaccgaacggtaaccgggcctaacgtagtaacctaccgtcccgaacggtccgtacggttaccgaggtcggtacggtcgggtacgggtcgtacggggaacgtagggttactaccgacttaccacgacctacgtccgacgcctacggaccttggccgttaaggttcgtaagttacgtttagtttaacgtacttttaagttttacgttacgtacgtagtaacgtataagttaacttaacggttaccgttccggactttaccggtacttacggttcgggaccggtacgaaccgtagcggttaggactaaccgacgtaacggttcgtagggctactacgccgtatacg

SEQ ID NO: 68801 - DNA, 592 bp, Homo sapiens
  misc_feature: GYAE6OF01EU4MT.51.76.G10.1.454.CMB.1.raw
  modified_base (197)..(197): a, c, t, g, unknown or other
  misc_feature (197)..(197): n is a, c, g, or t
  modified_base (453)..(453): a, c, t, g, unknown or other
  misc_feature (453)..(453): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgtacttacgcctggtaccaggccaagaaacctggccaggcctcccgaggcctcctcatctatgatcgcactccaacgaacgggcccactgaactactcccgacgccgacggttcaggtggcgaggtggtacgtgggacaggtagttcgactctaccacatcacgcacgcctcgctacgttgtaggtaagtttatttcgtacttaatttattacgtntacgagtactaagttaataagtacgttacgtacccttaccgttacgttacggtttcggaccggtacggggaaccagggtcgtaggtaacgacgtaaacgtaaacgtacgttaggtacggaccgtacgtccacgttaacg

SEQ ID NO: 68802 - DNA, 588 bp, Homo sapiens
  misc_feature: GYAE6OF01B4NHL.51.76.G10.1.454.CMB.1.raw
  modified_base (360)..(360): a, c, t, g, unknown or other
  misc_feature (360)..(360): n is a, c, g, or t
  modified_base (458)..(458): a, c, t, g, unknown or other
  misc_feature (458)..(458): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgtacttagcctggtaccagcagaacctggccaggctccagctctcatctatgatgctatccgaacgaacgggccacgtgactactcccgagccgtaggttcaggtcggacgtaggttcgggngtacgggacaggtagttccgactcgtaccacctactcgacgcgacgtcctgctacgtctagtaagtattttagatttaatttattactgtacgacgtntaagtaattaacgttacgtcggtacccttacgttaccgttacggtttcggacccggtaaggggaccctaaggtccgtagggacgacgttaaccgaaaccgtacgtcggtacggactcgaccgtacgtacg

SEQ ID NO: 68803 - DNA, 756 bp, Homo sapiens
  misc_feature: GYAE6OF01DW4H2.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacaggggaggaactgctcagttaggacccagacggaaccatggaacgccccagcgcagcttctcttcctcctgctactctggctcccagactaccactggagaagtagtgatgacgcagtctccagccaccctgtctgtgtctacgaggggaaacncgcccacctctccgtgcgacgggccagtcagagttgtagcagcgtacgttacgccgtaggtaccagaccaacggaaaccgtggacccgacggtcctacccgaggtccttacctacgtacttctagtcgtactcggacctacgtacccgaacggaacgggtacctacgttagtaactaccgtacccgaggtacccgtaggttccgaagggtcggacgtagggttgggtacgtagggactaggtacttacaccttactaccaactacgtaccgacggtaccgacgtccgttacggaccgttaacggttacgttaaggtaacgtttacgtttttacgtaacttttaaagtttttaacgttacgtttacgtacgtaacgttaacgttaaacgtttaacgtttaaccgttaaccgttcccggttaacctttaacccggtttaccgtttaccggttttaccgggaccggtaaacgggtaaccgtaaggtaccggtagggtaaacgtaactaaaccggtaaacgtacggttacgtacggtacctacggtaccgtaaccgttacg

SEQ ID NO: 68804 - DNA, 786 bp, Homo sapiens
  misc_feature: GYAE6OF01A8533.51.76.G10.1.454.CMB.1.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggctcccagataccactggagaagtagtgatgacgcagtctccagcccaccctgtctgtcgtctaccgaaggggaacacgccctaccctctcctgcgacgggccagtcgagtagtgtacgcgagcgtacgttacgccgtagaccagacgaacgaaccgtggaccgacggccncccgaggtcctcctacnttctagtgactcgacctacgacccaacggacgggcctaacgtgtaactaccgtcccgagccgttaacggtcgtaggtggcgtagggttcgggtacgtaggggactagtacgttcctacctccgtaccaccgtacgtaccgacgaccgtcgtccgtacgtaccgtacggtacgttaaggttaaccgtttagttttacggtaactttttaaacgtttacgtttaaccgttacggttacgtaacgttaaccgttaaacgtttaaacgttaacccgttaaccggttacccgttaccccgttaaccgttaaccgttttacccgggttaacgggttaaaccccggtaacggggttaaccggttaaaccgggtccggtaaagggtacccggttaaaaccgttacccggttaaaaacccgggttaaccgttacggggttacccggttaaccgttaaccgtacccgttaacccggttaccgg

SEQ ID NO: 68805 - DNA, 657 bp, Homo sapiens
  misc_feature: GYAE6OF01AHV8K.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaanacgcccaccctctcctggcacggggcctagtcagtagtcgttagcgagcgacttagccgtggtaccagcaagaaaccctggaccgaggcctcccaggcctccgtcactctatgatgcactccgaacgaacgggcctaacgtgactacgtccacggcctaggttcaggtcggccgtagggttcgggtcgtggacgtaggtacgtttccacgtcctacgaacctcgtccagtccagtccctggtaacctgttccgtaaggtaactttgtttacgactttaattttacgtactttgtactacgtgttaagttaacttataaccgttcgtacccgttacgtaccgtttaccggtttacggaccgggtaaacggtaccgtaagggtccgttagggaagtaaccctaaccggtaaaacgggttcgttagggtaccggtacctcggaaccccgttacgttaaccgg

SEQ ID NO: 68806 - DNA, 754 bp, Homo sapiens
  misc_feature: GYAE6OF01EC0BS.51.76.G10.1.454.CMB.1.raw
  modified_base (195)..(195): a, c, t, g, unknown or other
  misc_feature (195)..(195): n is a, c, g, or t
  modified_base (338)..(338): a, c, t, g, unknown or other
  misc_feature (338)..(338): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgccaccctctcctgcagggccagtcagagtgttagcagcgacttagcctggtaccaggcaacgaaaccgtggacccaggcctcccgaggcctcctacatctatgatcgactactaccgaacgaacgggccactagacttacncccgagcctaaggttcaagttcgggacgtaggtcgggttacgtagggactaggtagtttccacgttccgttaccacctaactaccgaacggtaccgtacgtacccgtacggaccgtaaggttacgttaaggttaaacggttacgttttttaaggtaacctttaaagtttttaactttaacgtttagttaccgtaacgtaacgttaaacgttaaacgttaaacgtttaaaccgttaccgggttaacccgtttaacccggttaaccgttaaccgggtttttaccgggaaccccgggttaaaccgggggtaaacccgtaacggtaccggttaacgggtaacggtaaacgtaaacccggtaaaaaccggaacggttacgggttacgggtaccggttacgtaacccgtaacccgttaacgg

SEQ ID NO: 68807 - DNA, 648 bp, Homo sapiens
  misc_feature: GYAE6OF01AJKJH.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcacgggccagtcagagtgtagcagcgacttagcctggtaccagcaacgaaaccgtggaccacggcctcccgaggtcctccgtcagttcctatgatcgcactaccgaacgaacgggcccacgtgactactacccaggtcccgtaggttccgaggtcggaccgtagggttcgggtcgtaggggactaggtcgttaccactccgtaccgaaccctgtccaagccgagcccgtagacctacggttaccgttagaacgtttagtttttacgaacgtttaattttacttacgttcgtacgtacgtacgttaagttaacttaacttaaccgtccgtacccgtttacccgtacgtttaccgtttcgggaccggaacgggtacctaaggtcgtaggaacgtacctaacgaaacggtacgtggtacgtagcgtaccgtaccgttacg

SEQ ID NO: 68808 - DNA, 546 bp, Homo sapiens
  misc_feature: GYAE6OF01BB07K.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggcctcccgaggcctcctcatctatgatgcatcccaacgaacgggcccactgactactcccagccaggttcaggttggctaggtcgggtcgtgggaacagtagttccactctacacctatcagccacgcctgcgacgtcgtagtaagttatttgtacttaatttattactgtacagtactaagttataactaacgtcgtccttaccgtacttacgtttggccgacgggaccaggtcgtaggacgataaccgaaacgtacgtggtacgactgccacgtac

SEQ ID NO: 68809 - DNA, 696 bp, Homo sapiens
  misc_feature: GYAE6OF01DTPYQ.51.76.G10.1.454.CMB.1.raw
  modified_base (197)..(197): a, c, t, g, unknown or other
  misc_feature (197)..(197): n is a, c, g, or t
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagacagaaacctggccaggcctcccgaggcctcctnacttctatgatgacactaccagaacggcctaagtcgactactcccagcctaggttcaggtggcgtaggttgggtccgngggaactagtacgtcgtactccgtacaccgtaatccgacgtaccgacgtcccgtcgccgtaaggttcgtaggtaacgtttatttttacggaatttaaacgtttttaagttaccttagggttacagggtaaccttaacggttaaacctttaaacgttaaacccgttccggttaacccgttacccgttaaccgttaaccggtttttaccgggaacccgggtttaccgggggaacccttaaacgggtccggttaagggaacggttaaccgtaaacccggaaaacgttaccgttagggtccgttaccggaccgtacccgtaacccgttaccg

SEQ ID NO: 68810 - DNA, 619 bp, Homo sapiens
  misc_feature: GYAE6OF01DNLAL.51.76.G10.1.454.CMB.1.raw
  modified_base (443)..(443): a, c, t, g, unknown or other
  misc_feature (443)..(443): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgtagcagcgacttagcctggtaccagacaagaaacctggaccaggcctcccaggcctcctcatctatgatgcactccgaacgaacgggaccacgtagactacctcccgagcctaggttcaggtggcgtagggtggtacgtgggacaggtcgttacactctacactatacacgcacgtcctgctacgtctagtacgtatttgacttaatttacttntacgtctagtacgtaattaactaagttacgtacggtacccttaacccggtacttaaccggttttccgggaacccgggtaaccggggtaacctaacgggtaccgtaagggtaacgtaaacgtaaaccgtaaaaccggtaaccgttcgggtacggccttacggaccctacgttaaccg

SEQ ID NO: 68811 - DNA, 544 bp, Homo sapiens
  misc_feature: GYAE6OF01CEFP1.51.76.G10.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (317)..(317): a, c, t, g, unknown or other
  misc_feature (317)..(317): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggggaaanagcccaccctcncctgcagggccagtcagagtgttagtagcgacttagcctggtaccagcagaaacctggccaggctccaggcctctcatctangatgcatccanaaggccatgatacnccagccaggtcagtggcaggtgggtctgggacagagttcatctacacatcagacagcctgcagtctagaagtatttgattaatttattactgttacaagctaagtaataataacgtcggtacctaccgtacttacgttttacggaccgtacggggaacctaaaggcgttagggaagtaacctaacgaaaaccgtaagtaggtcggactacgaccaacccagttaccg

SEQ ID NO: 68812 - DNA, 752 bp, Homo sapiens
  misc_feature: GYAE6OF01C7M8U.51.76.G10.1.454.CMB.1.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (416)..(416): a, c, t, g, unknown or other
  misc_feature (416)..(416): n is a, c, g, or t
tcagcgatcgtatacacgaccggtgctcgatttagtcactcatacagggggaggaactgctcagttaggacccagacggaaccatggaagccccagcgcagtcttctcttcctcctgctactctggctcccagataccacgtggagaagtagtgatgacgcagtctccacgcccaccctgtctgtcgtctaccggaaggggaaacncgccctaccctctccncggcgaggcctagtcagtgttgtagcacgtcgtaccgttagccgttaggtactcaggacaaacgtaaccgtggacccgacggccctacccgacggtccttcctacacttcgtagtcgactcgacctaacgtacccgaacgtaacgggcccctagtacgtaacttaccgacccacggtacccgttaggttaccgngggttacggcggtacggggtcgggtacggtacggggtaactacgttaacggttccacccgtaactacccgaactacgtaccagaccaccggttccgtacgtaccgtagttaccgtaataaggtttacgtttacgtaaacttttactttacgtttacgacgtttacaacggtgttttaaaccttaaacgttaaccgtaccggttaccccggttaacctttccgttaaacccgggttcggttacgggaaaaccccggttaaggggtaccaccgttgggtaaacgaacggttaccttaaacgggaaacgttcgtcgggtacgaccctaaggttacctcg

SEQ ID NO: 68813 - DNA, 742 bp, Homo sapiens
  misc_feature: GYAE6OF01AOZ6R.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagcgcccaccctctccgtgcgacgggccagtcagtagtgttagcagcgacttacgcctaggtaccagacaacggaaccgtggccgaggtccctacccgaggtcccttcccgtctacttaccgtatgaacgtcgacctaccgtacccgaacggaaccgggccctacgtacggtaacttaccgttcccgacgtcccgtaaggttacgaacggttcggacgtacggggttcggggttaccggtagggaacgtacgggtcgtttacccgaccgttacctaccaaccgtatacccgaacggccgtaacggtcccgtacggtacgtacggttaccgtaaggttaagtttacgtttttacgaaacttttaatttttaaccgttacgtttacgtaccgtacggtaaactaagttaaacgtttaaacgttaccggttaccgttacccctttaaccggttacgtttaaccggtttcgggaacccggtaacggggacccgtaaggtcggtaggtaacgactaaccgtaaacgtacgttgggacacgtcgtaccgacgtcg

SEQ ID NO: 68814 - DNA, 556 bp, Homo sapiens
  misc_feature: GYAE6OF01ELW3V.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggcctcccaggcctcctcatctatgatgcatccacgaacgggccactgatactcccagcctaggttcagtggcgaggtgggtctgggacaggtgttcactctcaccatcagcagcctgcagtctagtaagttattttagactttaattttattacttgtacagtcgtaattaattaagtacgtcggtcccttaccgtacttaccgtttcggaccggtaacggggtaaccaaggtcgtagggacgtactaacgaaacgtaacgttggtacggtctcgacctaccgtacg

SEQ ID NO: 68815 - DNA, 658 bp, Homo sapiens
  misc_feature: GYAE6OF01BTRTS.51.76.G10.1.454.CMB.1.raw
  modified_base (204)..(204): a, c, t, g, unknown or other
  misc_feature (204)..(204): n is a, c, g, or t
  modified_base (515)..(515): a, c, t, g, unknown or other
  misc_feature (515)..(515): n is a, c, g, or t
  modified_base (590)..(590): a, c, t, g, unknown or other
  misc_feature (590)..(590): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgctagtcctccacgcccaccctgtctgtgtcctccgaaggggaaancgcccaccctctcctgcgagggccagtcagtagtgtagcagtcgacttcgccgtaggtaccagacaacgaaccgtggaccacggcctacccgacggcctacctctacttcgtatcggtatcgacctactacccgaacgaaccgggcctaacgtgaacttaccgcccgaaggtccgtaggttacgaaggtcggacgtagggtggggtacctgggactaggtacttaccgactcctacacctacgtcgacggtcacggtcctagtactagtaccgagttaagttacttttagaactttaaagttctttaacgngtaacagtcttaaagttagtaacttaccgtcgttacccgttaccgtacgttagttaccggacgggaaccggtaanacggtacgtagggaaactacggtaacgaaacccgttagttacggcgtaacctcggacctacgttaacg

SEQ ID NO: 68816 - DNA, 838 bp, Homo sapiens
  misc_feature: GYAE6OF01EKO02.51.76.G10.1.454.CMB.1.raw
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgcccaccctctccngcgagggccagtcagagtgttagcagcgacttacgccgtaggtaccagacaacggtaaacctggaccgacggcctacccgaggcctcctactatctatgatcgacactacccgaacgaacgggccctactagactacgtccccagccgtaggttcgaggtcggacgtagggtcgggtacgtaggggaactacgggtacgtttacctaaccgttccgttacccaacccgtacgttacgaaccggtaccacgtacccgttaggaccgtaacggtttacgttaacgggttaaagttttaccgttttttaacggtaacctttttaaaagttttttaacgtttaacccggttacggtttaaccgtaacggtaaccggtttaaagtttaaacgtttaaaacgtttaacccgggtttacccggttacccccgttttaccccggtttaaaccgtttttaaccgggtttttacccgggggaaaccccgggttaaacgggggggttaaacccccttaaagggttccccggggtttaaaggggtaaacgttaaaacccggttaaacccggtaaaaacccgggttaacggtttacgggtacccgggtaccgttaaccggaacccttaccgtttaaccg

SEQ ID NO: 68817 - DNA, 649 bp, Homo sapiens
  misc_feature: GYAE6OF01EPXJD.51.76.G10.1.454.CMB.1.raw
  modified_base (325)..(325): a, c, t, g, unknown or other
  misc_feature (325)..(325): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagcgcccaccctctcctgcagggccagtcagagtgttagcagcgtacttagcctaggtaccagcagaaacctggaccaggcctcccgaggcctcctcatctatgatgcatccacgacggccatgactacncccagccgtagttacgaggtcggcgtagggttggtcgtaggggactaggacgttcaccttcgtacacctagtccgagccagtcccgtagtccgtacggtctaggtaagttagttttgacctttaattttacttacgttgtacagtacgtaagttaagtaacgttacgtcggttacccctttaccgttaaccgttccggttttaccgggaccggtaacggggtaaacccgtaacgggtaccggttaaggaacggttaaccgttaaaccggaaaacggttaaccggttcggggttacgtaccgttacggcccgtaaacccgttacg

SEQ ID NO: 68818 - DNA, 742 bp, Homo sapiens
  misc_feature: GYAE6OF01C6Z7G.51.76.G10.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaagtagtgactgacgcagtctccagccaccctgtctgtgtctccgaggggaaancgccaccctntcctgcagggccagtcagtagtgtagcagcgtacttagccgtaggtaccctaggacaacgaaaccgtcggaccctagggccttacccgaggtccttccctctaactccttataggacttcggaccactacccgaacggtaacgggcccctacgtacgactacctacccgaggccttacgggtttaccaaggtttcgggacgtaagggtttcggggtacgttaagggggaacctaggttacggttacctaacgttccgtaccaccgtataccgacgccgtacgcccgtagaccgtacgttaccgtaggttaacgttagttttcgaacctttaaacgttttaacgttacgtacgtttaacccgagttaaccgttaagttaaacgtaaacgtttaccggcggttaacccctttaccggttaacttacccggttttaccggggaaccggaacggggtacctaaacgggtccggtaggtaacggtaactaaccgaaacgtaccgttacgggtagtaccgtacgacccgtacgttacg

SEQ ID NO: 68819 - DNA, 531 bp, Homo sapiens
  misc_feature: GYAE6OF01BCDR3.51.76.G10.1.454.CMB.1.raw
  modified_base (345)..(345): a, c, t, g, unknown or other
  misc_feature (345)..(345): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaacgggccactgatagtcccagccaggttcagtggcagtggtcnggacagagttcactcgtacaccatcagctacgccngctagtctagagtatttagcgtaatttattactgtacagtctaagtactaatacgttacggcctaccgtactacgtttggaccgtaggggaacccaaggtcgtaggaaggacttacgaaacgtacgttaggtcgactcgctaaccgtaccg

SEQ ID NO: 68820 - DNA, 730 bp, Homo sapiens
  misc_feature: GYAE6OF01EXCBZ.51.76.G10.1.454.CMB.1.raw
  modified_base (95)..(95): a, c, t, g, unknown or other
  misc_feature (95)..(95): n is a, c, g, or t
  modified_base (284)..(285): a, c, t, g, unknown or other
  misc_feature (284)..(285): n is a, c, g, or t
  modified_base (293)..(293): a, c, t, g, unknown or other
  misc_feature (293)..(293): n is a, c, g, or t
  modified_base (633)..(633): a, c, t, g, unknown or other
  misc_feature (633)..(633): n is a, c, g, or t
tcagcgatcgtatacacgaccggtgctcgatttagtcactcatacagggggaggaactgctcagttaggacccagacggaaccatggaagccccngcgcagcttctcttcctcctgctactctggctcccagataccactggagaagtagtgatgacgcagtctccagccaccctgtctgtgtctccaggggaaagcgccaccctctcctgcagggccagtcagagtgtagcagcgacttagcctggtaccagcagaacctggccaggctcccaggcctcctcnnactctacngtagtacgtacgactacctaccaacggaaccggacccgtacgtacgtaacgtacctaccgtaccgaccgtacggttacggtacgggtacggtacggtagggtacgggttcgggtacgggtacggtacggtacgttaccgtaccgttacctacctaacctaccgtacgtacgtacgtaccgtaccgtacgacgttacgttcgtaacggtaacgttttacgtttacgtaactttttaagttttaactttacgtttacgttaacgtacgtacgtaaagttaaacttaaacgttaacggttaccgttacccgttaccgtaacccgttttaccggtttacccggntaaccggggttaacccgggtaaaccggtaccggtacgggtaacggtaacgttaaccgtaaaccggtaaaccgtaacggttaacgggtaccggtacgg

SEQ ID NO: 68821 - DNA, 541 bp, Homo sapiens
  misc_feature: GYAE6OF01CES57.51.76.G10.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (289)..(289): a, c, t, g, unknown or other
  misc_feature (289)..(289): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
tcagcgatcgtatacacgaccggtgctcgatttagtcactcatacaggggaggaactgctcagttaggacccagacggaaccataggaagccccagcgcagcttctcttcctcctgctactctggctcccagataccactgganaagtagtgatgacgcagtctccagccaccctgtctgtgtctccaggggaaanagccaccctntcctgcagggccagtcagagtgttagcagcgattagcctggtaccagcagaaacctggccaggctccaggctcctcatctatnatgcatccacaggccactgatactcccagccaggttcagtggcagtgggtctgggacagattcactntcacatcancagctagcagtctgaagtacttttgactaatttattactgttacagacgtaagtaataattaaaccgttggtacccgtaccgttactacgttttcggacctaggggaaccctaaggcttagggacgtacttaaccgaaaacgtaaccgtcggttaggccttagccgtaccgtaacg

SEQ ID NO: 68822 - DNA, 820 bp, Homo sapiens
  misc_feature: GYAE6OF01CTS27.51.76.G10.1.454.CMB.1.raw
  modified_base (195)..(195): a, c, t, g, unknown or other
  misc_feature (195)..(195): n is a, c, g, or t
  modified_base (391)..(391): a, c, t, g, unknown or other
  misc_feature (391)..(391): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctccagataccactggagaagtagtgatgacgcagtctccagccaccctgtctgtgtctccgaggggaaanacgcccaccctctcctgcgagggccagtcagtagtgtagcagcgactagcctaggtaccagacaacgaaacctggaccgacggcctcccgaggtcctcctccatcctagtgaactgacactaccgaacggtaacgggacccacgtgactacgtcccgagccgtaggttcaaggtcgggacgtagggtcgggttcgngggtaacctagggtacgtttaccaccgttcctactaccgtagttaccgacggtacgacgaccgttacggaccgtacggttaccgttaggtaacgtttaacgtttttacggaaaccttttaaacgttttttaacgttttaaccgtttacgggttaacctaaaggttaaccgttaaaacgtttaaacgttaaaaacggttttaacccgtcccgggtttaacccccgttttaacccgtttaacccgttttacccgggtttttaaccccgggggaaacccggtaaacccggggggttaaacccgtacgggtaaaccgggtttaaggggaaaaccggttaaaaccgttaaaaccgggtttaaaaaccccggaacgggtttacggggtttaaccggaccgttaacccgggtaacccttaaccggtttaacccggg

SEQ ID NO: 68823 - DNA, 562 bp, Homo sapiens
  misc_feature: GYAE6OF01BY29I.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggcctcccgaggcctcctcatctatgatgcatcccagaagggccactgatactcccagccaggttcagtggctaggtgggtctgggacagtacgttcactctacaccatcagcacgcctgacagtctagtaagtattttgacttaatttattacgttgtacgagtctaagtaataaattaacgtcggtacccttccgtacttacgtttcgggaccgtacggggaacctaacggtcgtagggacgtaacgtaccgaaaacggtacgtcggttacggactcgaccgtacccgtacg

SEQ ID NO: 68824 - DNA, 784 bp, Homo sapiens
  misc_feature: GYAE6OF01B4ZBW.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaanacgcccacccttctccctgcgacgggccagtcagtagttgtagcagccggtacttagcctaggtaccagcaacgaaaccgtggaccaggcctcccaggcctcctcatctatgactgcactaccaacgaacgggaccacgtagaactacctacccgagtaccgtaggttaccgaaggtcgggcgtagggttggggttaccgtacgggggaactacgggtacgttccgtacccgttacctacccgaaccctaacgtccgaacggccccgtaaggtcccttacgggtacctaacgggttacgttaacggtaaacggtttactttttaggaaccctttttaaaagtttttaaccgttttacgtttacgggttaaccgttaacgtaccgtttaaacgtttaaacgttaaaccgttttaaacccggttaccgggttaccccctttaccggtttaacccgtttaaccgggtttttccgggaaaccccgggaaacgggggtaaccctaacggtccggttaacgggtaacgttaaccgtaaccgtaaaaccggtaccgttagggtaccgtacgtaccggtacccgtacttaccg

SEQ ID NO: 68825 - DNA, 567 bp, Homo sapiens
  misc_feature: GYAE6OF01A1AO6.51.76.G10.1.454.CMB.1.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
  modified_base (550)..(550): a, c, t, g, unknown or other
  misc_feature (550)..(550): n is a, c, g, or t
  modified_base (561)..(561): a, c, t, g, unknown or other
  misc_feature (561)..(561): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtctccgaggggaaangccaccctctcctgcagggccagtcagagtgttagcagcgacttgcctggtaccngcaagaaacctggaccaggcctcccgaggcctcctcatctangatgcactccaacgacgggccacgtgatactcccgagccgtaggttcaggtcggcgtaggtcggggtactggggaactaggtacgtttccacgttccgtcctaaccatcagccacgcctgctagtctagtaattacgtttgacttaattttatactgtacagtctaagttactaaacgtacgtcgtacccttccgtaacttcggtttcggaccgtaggggacccaggtcgtaggacgtactacgaaagtacgtcggngacctcgaccncgtacg

SEQ ID NO: 68826 - DNA, 680 bp, Homo sapiens
  misc_feature: GYAE6OF01DWJNJ.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgccaccctctcctgccacgggccagtcagtagtgtagcagcgtacttacgcctaggtaccagcaacgaaacctgaccgaggcctcccacggctccctctaagtctagtgatgcatccgacgaacggccactgactacgtcccaggcctaggttacacggtggacgtagggtcgggttaccgtggaaccgtagggttacttccacctacgtaccacacgtccacgcctacgtcctagccgtacgtacgtaggtaagttacgttttacgtactttaaactttttacgttacttcgtactaacgacgttaaagttaaacgttaactaaccggttaccgttaccccgttacggttaccgtttaccggtttaccggggaccggtaacggggtaaccctaacgggtcgttaacgggtaagtaaccgttaaaccggtaaaccggtacgttacgggtacggacccgtacggtcccgttaacgttaccg

SEQ ID NO: 68827 - DNA, 740 bp, Homo sapiens
  misc_feature: GYAE6OF01B6P4B.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgcccaccctctcctgcagggccagtcagagtgttagcagcgacttagcctggtaccagcaagaacctggaccaggcctcccgaggcctcctcatctatgatcgcactaccaagaacgggcctagtgactactcccgagccgtaggttcaggtcggactagggttcgggtacgtaggggactagggtacgtttcgaaccgttctaccaacccgtactaccgaacgccgtaccgtcccgttggaccgtaacggttaccgttaaggtaaacgtttacgtttttacggaacttttaaacgtttttacgtttaacgtttacgtacgtaacgtaacgttaaaggttaaacttaaacgttaaccggttccggttaacccctttaacccggtttaaccctttaacccggggtttttaccggggaacccggtaaaccggggggtaaacccctaaagggttcccggttaaggggtaaaccggttaacgtaaacccggtaaaacgtaaccggttaggtaccgggtaccgttaccgaacccgtaccttaacgg

SEQ ID NO: 68828 - DNA, 651 bp, Homo sapiens
  misc_feature: GYAE6OF01DHS44.51.76.G10.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (300)..(300): a, c, t, g, unknown or other
  misc_feature (300)..(300): n is a, c, g, or t
tcagcgatcgtatacacgaccggtgctcgatttagtcactcatacgagggggaggaactgctcagttaggacccagacggaaccatggaagccccagcgcagcttctcttccctcctgcctactctggctcccagatacccactggagaagtagtgatgacgcagtctccagccaccctgtctgtgtctcgaggggaanacgcccaccctctcctgcgagggccagtcagagtgtagcagcgacttagcctaggaccngacacgaacctggccaggcctccgagcctccgtcattctagngatcgacactccaagacggccatgactacgtcccagtccgtaggttacgagtcggcgtagggtgggtccgtaggggaaccaaggtacgttaccacttcctacctaccacgtacacgacgaccgctcgactagtacgtaggtagttacgttttcgactttaattttacgttacgtagtacgaagtacttaaggtaacttaacgtaccgtacggttacccttaccgttacgtttaccgggtttacgggacccggtaacgggtaacctacgggtcgttagggaacgttaaccgtaaccggtaaaacgtaaccgggttcggtacggttaccgtaccgtccgttaacccgttaccg

SEQ ID NO: 68829 - DNA, 641 bp, Homo sapiens
  misc_feature: GYAE6OF01B76E6.51.76.G10.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (412)..(412): a, c, t, g, unknown or other
  misc_feature (412)..(412): n is a, c, g, or t
  modified_base (468)..(468): a, c, t, g, unknown or other
  misc_feature (468)..(468): n is a, c, g, or t
  modified_base (487)..(487): a, c, t, g, unknown or other
  misc_feature (487)..(487): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccagtggagaacgtagtcgatgacgcagtctccagcccaccgtgtctgtcgtccgtaccgaaggggaaacncgcccacctcgtccngccgagggccagtcagtagtgtagcagcgacttagccgtaggtaccngacacgaactggccaggcctccgagcctctanagtctangactcgactanacccgaacgacggcctacgtgactaccacccgtagacccgtaggttccaggtcggacgtagggtcggtaccgtaggacgtagtacgttcaccnctacgacagtcgagccacgtcctagtctaacggtacgttaggaacgttacgtttanacgtttaaatttctacgtnaaccgtagtaagttaacgtaagtaaccttacgtaccgtaccttaccgttacgttacggttaccggaccggacgggtaaccaacgggtcgtaacgggtactaccgtaacggtaaaacgtccggttaggtccgtagtaccctacgtacccgttacg

SEQ ID NO: 68830 - DNA, 641 bp, Homo sapiens
  misc_feature: GYAE6OF01A0ZYF.51.76.G10.1.454.CMB.1.raw
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (637)..(637): a, c, t, g, unknown or other
  misc_feature (637)..(637): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccacctctcctgcagggccagtcagagtgtagcagcgtacttcgcctaggtaccagacaacgaaacctggaccaggcctcccgaggtccttccgnactctatgatcgacactacccgaacgtaacgggccctaacgtagaacttacctacccgaacggtccgtaagggtttaccagggtcgggaccgtaggggttcgggtacgtacggggactaacgggttacttacccacttcccgtacctaacccgataccgacgcctaacgtcccttgaccgtacgtactacggtaagtttagtttacgtaactttaagttttacttacgttgtactaagtaccgtaattaactaaagttaccgtcggtacccttacgtacttcggttacggacgacgggtacagcgtaggactaagacgtaaacgtgtcgtagtacacgtccntacg

SEQ ID NO: 68831 - DNA, 615 bp, Homo sapiens
  misc_feature: GYAE6OF01ERWBD.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgattttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaancgccaccctctcctgcagggccagtcagagtgttagcagcgacttacgcctaggtaccagcaacgaaaccgtggcccaggcctcccgaggccctcctcatctagtgtagtgactactacccgaacggaacgggcctactgaacttacctcccgagtccgtaaggttcgaggtcgggacgtagggtcggggtctaggggaactaggtacgttcaacttccacgacctagtcgacgcgacgtccgtgaccgtacgttctaaggtaagtttagttttacgactttaagtttacgttacgtacgttacgagtactaagttaactaaagtacgtacgtccttacgtactacgtttcggaccgtaacgggactagtcgtaggacgtacgtaacgtaaacgtacgtaggtcgatcgacacgttacg

SEQ ID NO: 68832 - DNA, 946 bp, Homo sapiens
  misc_feature: GYAE6OF01E5EQ1.51.76.G10.1.454.CMB.1.raw
  modified_base (208)..(208): a, c, t, g, unknown or other
  misc_feature (208)..(208): n is a, c, g, or t
tcagcgatcgtatacacgaccggtgctcgatttagtcactcatacagggggaggaactgctcagttaggacccagacggaaccatggaacgccccagcgcagcttctcttcctcctgctactctggcctcccagactaccagtggagaagtagtgatgacgcagtcctccacgcccacctgtctgtcgtcgtaccggaaggggaaacnccgcccaccctctccgtgcgacgggccagtcaggtagtgtacgcgtacgccgtacgttacggccgttacggaaccagaccaacggtaaaccgtcggacccgacggtccctacccgacggtccctacctactaacttaccgtaagtacgaacttaccgaacccgtaaccgtaacccggaaaccgggtaacccgggtaccctaaaccggttacgtaaccctaaccccggtaccccggtaacggtacccgggtttaacggggtacgtaacggggggttacgggtaccggggtttaaggggttccgggggttaaccggtaaacgggggtaacctttacccgggtaccgttacccctaaccgttaaccccgttaaccaacccggtacgtaccccggaacggtacccgaccggttaccgtaacggttacgttaacggtaacggttttaaggttaacgttttaactttaacgttaaacgttttaaacttttaaccggttacgtaaccggttaacgtaaacggttaacgtttaaacgttaaacccgtttaacggttaacccgtttacccggttaacccggttttaacccggttaaccggttaaccggggtttaaccgggaacccggggtaaaccggtaaaccgggttaaccggtaccggtaacggtaaaaccgtaccggttaaaccggttaaaacggttccggtacgggtacccgtagtacccgttacccttccggttttaacccg

SEQ ID NO: 68833 - DNA, 575 bp, Homo sapiens
  misc_feature: GYAE6OF01EWPC8.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccagcagaaacctggccaggcctcccaggcctcctcatctatgatcgctactccaacgaacgggccatcgatactcccagccaggttcagtgcaggtggtctggacaggtacgttcacgtctacacctatacacgcacgtcctgactagtctagaagttatttacgactttaagtttacttacgtcgtacgtagtactaagttaactaactaacgtcggtacccttaccgttacgttaccgtttcggaccgtaacgggtaacctaggtcgtaggacgtaagtaccgaaacggtacgtcggtacggacctcggaccctagtacg

SEQ ID NO: 68834 - DNA, 686 bp, Homo sapiens
  misc_feature: GYAE6OF01AI7CP.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaangcccacctctcctgcagggccaggtcagagtgtagcagcgacttagcctgtaccagcaagaacctggaccagggcctcccgaggtcctccctctatccatgacttgccactaccgaagaaccgggcctacgtagtaactaccgtacccaggtcccgtaaggtttcaaggttcggaccgtagggttcgggtccgtagggaacctaggtacgtttccaccgtttcaccgaacctactcgaacgtccgaacggtccctagaccgttacggtaccgttacggtaagtttactttttacggtaacgtttaatttttaaccgttacgtttacgtaccgtaataccgttaagtttaacttaaacgttaaaggtccgttaacccgtttaccgtacgttaccggtttcggaacccgggtaccgggtaacctacgggtcgtaagggacgtacctaacggtaaaccgtacgttcgggtacgacttaccggcctacgttaccg

SEQ ID NO: 68835 - DNA, 750 bp, Homo sapiens
  misc_feature: GYAE6OF01EQ2ES.51.76.G10.1.454.CMB.1.raw
  modified_base (196)..(196): a, c, t, g, unknown or other
  misc_feature (196)..(196): n is a, c, g, or t
  modified_base (741)..(741): a, c, t, g, unknown or other
  misc_feature (741)..(741): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccacctgtctgtcgtctccgaggggaacncgcccaccctctcctagcgacgggccagtcagagtgtagcagcgattacgccgtaggtacagacgacgaaaccgtcggaccacggcctcccgaggtcctccgtcactctagtcgatcgacacgtaccgaacggaaccgggcctaacgtacgtaactaccgtacccgacgtaccgtaagggttcaagggttcggacgtaggggttcgggtacgtacggggtaacgtacggtacgtttaccgaccgtttaccgtacctaacctacgttacccgacggaccgaccggtacccgtcggtacgtacgttaccgtaaggtaacgttttacgttttacgaaccttttaaagtttttatttacccgttaagttaccgtaacgttaacttaaacggtttaaaccttaaagtttaacccgacggtttaacccccttaccggtttaacctttaccgggtttaaccggacccgggtaacgggtaacccgacggttaccggtaaggtaacgtaaacgtacccgtaaaacggtacgtcggtacgtaccgtccggtaacnccggttacg

SEQ ID NO: 68836 - DNA, 865 bp, Homo sapiens
  misc_feature: GYAE6OF01EARVM.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggctcccagataccacgtggagaagtagtgatgacgcagtctccagcctacctgtctgtcgtctacgagggaacncgcctaccctctcctgcgacgggccagtcagtgtcgttacgcgagtcgtacgttacgccgtaggtaaccaggtaccaacgggtaaacctcggacccgacggcctacccggaacggtccttacccgtactaacgttccgttaatacgtaacgttacgaccgtaccgttaacccgaaccggaaccgggtacctaacgttaggtaaccttaacccgttacccgaacggtaccgttaacgggttcctacgggtgggtaccgtaaggggttcggggttacgtaacggggtaactacgggtacgtttaccgaacccgttccgtaacccaaccgtacgttaccgaccggaccgtaaccgttccctacggtcgtaacggttaccgtaaggttaacgttttaattttacggtaaactttttaagttttaacctttacggttacgtaacgttaagtaccgtttaaaagttactttaaacccggttacggttacccgttacccgttttaccggtaacgttttaaccggggttaccggtaacccggggtaaccgggttaaaccgaaccggttccgggttaaacgggttaacccttaacgggtaaaacccggttaaacccgttaaacgggttcggtttacccggaaacttaccccgggtaccttaaacccggttacccg

SEQ ID NO: 68837 - DNA, 716 bp, Homo sapiens
  misc_feature: GYAE6OF01CI1EK.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgtagcagcgtacttagcctggtaccagcaagaaccgtggaccaggcctacccgaggcctcctcacttctagtgatcgcactaccaacgaacgggccactgactacgcccagccgtaggttcaggtggcgtagggtcgggtcgtggggaactacggtacgttccaaccgttcctaccgaacctactacgacggtaccgacgtcccgtacgacgtacggttaccgtaaggttaacttaacgtttttcgaaacttttaaacgtttttaacgtttaccgttaggtaccgtaaggttaccgtaaacggtttaacttaaaccgttaaccggttccggttaaccccgttaccggtttaccgttaaccggttttccggggaacccgggtaaacggggtacccgtaaacgggtccggttaagggtacgtaaccgttaaccgaaaaccggttacggttacgggttacggtacccttacggacccttaacccgttaacg

SEQ ID NO: 68838 - DNA, 601 bp, Homo sapiens
  misc_feature: GYAE6OF01CB59Z.51.76.G10.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
  modified_base (589)..(589): a, c, t, g, unknown or other
  misc_feature (589)..(589): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcgaggccagtcagngtgtagcagcgtacgtagccgtggtaccagcaacgaaacctggccacggcctcccgaggtcctcctcacttctagtgactcgactactacccgaacggaacggccctaagtacgtaactacctacccgagcccgtaaggttccgaggtcggacgtgggtcggtcgtaggaactagtacgttcaccgtctacaccntacganacgacgtcgagctcgtatagaatttntttacgaactttatttacttacgtgtaacagtactaagtaacttaacgtacccgtgtacccttacgttacgttcggttacggaccgtacgggaacctcggcgtaggaacgtacaacgtaaacgtcgtggtctacgngtaccacgttac

SEQ ID NO: 68839 - DNA, 654 bp, Homo sapiens
  misc_feature: GYAE6OF01ERWV2.51.76.G10.1.454.CMB.1.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
tcagcgatcgtatacacgaccggtgctcgatttagtcactcatacagggggaggaactgctcagttaggacccagacggaaccatggaagccccagcgcagcttctcttcctctgctactctgctcccagataccactggagaagtagtgatgacgcagtctcagccaccctgtctgtgtcctccgaaggggaaancgccaccctctcctggccgacgggccagtcagtaggttgttagcagcgtacttacgcctggtaccngacaacgaaccgtggccaggcctccgaggcctacctntactctatgatcgacactaccacgacggccactgactcncccgtagcctaaggtcaggtcggcgaggttcggtacgngggaactcggtatttaccgactttaccgactaacccgtactacgacgaccgacgtacccgtgaccgtacgttacgtaaggtaacgtttatttacggtaactttaattttacgttacgttacgtacgtacggtaactaaggtaacttaaacgtaccgttacgtccgtttaacccgtacgtttaccgttacgggtaacccgaggggtaacccttaggaccggtttagggaacttcgaaaccgtaacgtaggtcgacgggtacttacggacctacgttacg

SEQ ID NO: 68840 - DNA, 747 bp, Homo sapiens
  misc_feature: GYAE6OF01DDT15.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagccaccctgtctgtgtctccgaggggaanacgcccaccctctcctgcagggccagtcagagtgtagcagcgacttagcctaggtaaccagcaagaaacctcggaccacggcctcccgaggctcctgatctagtgatgacactccgaacgacgggccacgtagactaactcccagaccgtaggtttacacgggttaggcgtagggttacgggtacgtaggggaaccctaagggtacgtttacccgactttaccgtaccctaacctacgttaccgaacggtacccgtaacggtcccgttacggaccgtaacggtttaccgtaacgggtttaaacggtttactttttaggtaaccctttaaaagtttttttaccttttaaaccgttaccggttaacgtaaccggtaacttaaacgggtttaaactttaaaaccgtttaaccgttcccgggttaccctttaaccccgggtttactttaacccggttttaccgggacccgggtaaacgggtaaccgacggtacggtacggtaacgtaaccgtaaaccgtaaacggtacgtggtacgtctacgcgtacttaaccg

SEQ ID NO: 68841 - DNA, 623 bp, Homo sapiens
  misc_feature: GYAE6OF01D4J92.51.76.G10.1.454.CMB.1.raw
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (308)..(308): a, c, t, g, unknown or other
  misc_feature (308)..(308): n is a, c, g, or t
  modified_base (458)..(458): a, c, t, g, unknown or other
  misc_feature (458)..(458): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagcccaccctgtctgtgtcctccgaaggggaaancgccaccctctcctgcgacgggccagtcagngtgtagcagcgacttagcctggtaccagcaacgaaccgtggaccgaggcctcccgaggccctcctctactcgtagngtactgactactcccaacggaaggccctaactgactacgaccctagccgtaggttccaaggtcggactagggtcggtacggtagggaactagtacgttccaacgttccactacgataccgagcacgtctgtctacgtacgtagtaagttnttagtacttaagtttacttacgtagtacgagtactaagttaactaacgtaaccgtcgtacccgtaccgttacgtaccgtttcggaaccgtaacgggaccgtaaggtccgtaagggacgtacgtaaccgtaaactacggttaggaccggtacagtaccctagtacg

SEQ ID NO: 68842 - DNA, 807 bp, Homo sapiens
  misc_feature: GYAE6OF01B73HH.51.76.G10.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaagtagtgatgacgcagtctccagcccaccctgtcctgtcgtctccgaaggggaaacncgcccaccctctccngcgagggccagtcaggagtgtagcagcgtacttgcctggtaccagcacgaaaccgnggaccacggacctcccgaggtcccttccccgtactacgttacctaagtgaacttcgacccggtacttacccgaaaccgaacgggcccctaacgtgtaactacccgtcccgacgtacccgttagggttaccacgggttcggacgtagggttcgggtacgttcggggaactcggttacgtttaccaccctccgtacctaccgtactacgaacgtacccgaacggtcccgtacggtacctacgggttaccgttaaggtaacgtttaagttttcgtaaactttaacgttttaaccgtttacggttacgttaccgtagtaaccgtaaggtttaaacctaaacgtttaaccggttaccgggttacccctttaaccgggttaccgttaccggttttaccggggaaccccggttaaccggggtaacccggtaaaccggtcccgggttaaggtaaaccggttaaccgttaaacccggtaaaaccggttaaccggttagggttaccggtaccggttacgtaaccccgtaacggtttaacccg

SEQ ID NO: 68843 - DNA, 763 bp, Homo sapiens
  misc_feature: GYAE6OF01A02WC.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgcccaccctctcctgcagggccagtcagagtgttagcagcgtacttagcctggtaccagcaagaaacctggaccaggcctcccgaggtccttcctcgaatctatgactcgcactccgaacgaacgggcctactaggtactaaccgtacccgacggtccgtaaggtttccaagggttcggggacccgttaaggggtttcggggtacggttagggggaaccgttaacgggttaccggtttaccctaaccgttcccttacccgtaaacccgtacgttaccgaaccggtccgtaacggtcccgttaacggaccggttaaacggttaccggttaaggtaacgggttttaacgtttttacggaacccttttaaagttttacgtttaccgtttaggtaaccgtaaggtacttaaacggtttaaacttaacgttaccggttccggtaccctttaccggttaaccttacggttttacggaccggtacggggtaaaccgacggtccggtaggaacggtaactaaacccggaaaggttacgttcggtacggtaccgtacgtacccgtacttacgg

SEQ ID NO: 68844 - DNA, 735 bp, Homo sapiens
  misc_feature: GYAE6OF01C8D8I.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagactaccactggagaagtagtgatgacgcagtctccagccacctgtctgtgtctccgaggggaaancgccaccctctcctgcgacgggccagtcagtagtgtagcagcgacttcgcctagtaccagacacgaaccgtcggaccgacggtacctacccgacggtcctacccgtctactacgttatgacgtcgtccaactacccgaacggaaccgggaccctaacgtacggaaccttaaccgtccccgtaggtacccgttagggtttccgaacgggttcgggaccggttaaggggttcggggttcggtaacggggtaacgtacgggttacggttacctaccgttaccctaccgtacctaactccgacgtacctacggccgttcgtacgtacgtaccgttagtaacgtttagttttaccgtaattaactttttacgtttacgtacgttaccgtaggtaactaaggtttaaactaacgttacggtccgttacccgttaccgttacttacggtttaccggacggtaaaccgggtacgtacggtcgtaaggttaacgtaacgtaaaccggtaaacgtacgtcggtacggtacctacgcccgttacgttacg

SEQ ID NO: 68845 - DNA, 698 bp, Homo sapiens
  misc_feature: GYAE6OF01BEFSO.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaancgccacctctcctgcgaggccagtcagagttgttacgcgagcgtacttacgccgttggtaccagaccgaacgtaaacccgtggaccacggcctcccgaggccttccgtcattcctatcgtagtcgactacgtacccgaacggaacggcctaacgtacgtactacctcccgacgtccgtaaggttcgaggttcggaccgtgggttacgggtacgtagggacgtaacggtacgttccaacgttcctaaccaacctacgtccgaacgccgtacgtccgtagtaccgtagttaccgtaaggttaacgtttgttttaacgtaacttttaaagtttttacgtacgttacgtacgtacgtaacttaagttaacttaaaccgttaccgttccgttacccgttaacgttacgttacggtttccggaaccgggtacggtaaccgtaaggtccggtaggtaacgtaacgtaaccgtaaaccgtacggtcgtacggtacctacggccctacgtcg

SEQ ID NO: 68846 - DNA, 657 bp, Homo sapiens
  misc_feature: GYAE6OF01BVOLB.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcgagggccagtcagagtgttagcagcgtacttagcctggtaccagacaacgaacctggaccaggcctcccgaggtcccttaccgtcattacctatggatcgcactaccgacgaacggctactagactactcccagtccgtaggttcaggtggacgtagggtcgggtcgtagggacgtacggtacgtttacaccttccgtcaacctgtaccgacgaccgacgtccgtcgacgtagttacgtaaggtagttagttttacgtatttaatttatttaccgttagttcgtaacgtacttaagttaaacttaacgttaccgttaccggttacccttacgttaccgttaaccgtttcgggaacccggtaacgggtaaccacggtacgtaggtaacggtacgtaaccggaaacgttaccgtaggtacggtactacgtccgtaaccgttacg

SEQ ID NO: 68847 - DNA, 683 bp, Homo sapiens
  misc_feature: GYAE6OF01E0NC9.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcagggccagtcagagtgtagcagcgacttagcctggtaccagcaacgaacctggaccaggcctcccgaggtcctcctcattctatgatgctactccacgaacggccacgtgactactcccgagcctaaggttccagtcggctagggttcgggtcgtagggactaggtcgttcacttccgtaccacctactcgacgcgtacgtccctgacgtagtcgtaggtaacgtttcttttacgtactttaaacttttaacttacttacgttacgaacgtcgttaaagttaacttaaacgttaaccgttccgggttaccccgttaacccggtttaccgttaacccggttttacgggaaccccgggttaaccgggggaacccgtaaacggggttcccgttaaggggaacgtaacgtaaaccggtaaaaaccgttaacggttcgggtacggtaccgttaccggtaccgtaacccgttacg

SEQ ID NO: 68848 - DNA, 624 bp, Homo sapiens
  misc_feature: GYAE6OF01CKED1.51.76.G10.1.454.CMB.1.raw
  modified_base (301)..(301): a, c, t, g, unknown or other
  misc_feature (301)..(301): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccacgtggagaagtagtgatgacgcagtctccagccacctgtctgtgtcctccgaggggaaagacgcccacctctcctgcgagggccagtcagagtgtacgcagcgtacttagcctaggtaccagacaacgaactggccagcctccgagctctacatctatgcngcaactaccgaacgacggctaacgtgactactacccgagcctaggttcaggtcggacgtagggtcgggtacgagggactaagtacgtaccacttccgtaacacctagtacacgactacgcgtagactagtacgtgtaagttattttacgattaaattttgtaactcgtaatagtactaataacgttaaactacgtcgttaaccgtacgttacttacgtttacggaccggtaaacggaccgtaacggtacgtaggaacgttaaacgtaaaccggaaaacgttacggtacgggtacgacgttacccggaacgttacccttaacgg

SEQ ID NO: 68849 - DNA, 812 bp, Homo sapiens
  misc_feature: GYAE6OF01DD0J2.51.76.G10.1.454.CMB.1.raw
  modified_base (202)..(202): a, c, t, g, unknown or other
  misc_feature (202)..(202): n is a, c, g, or t
  modified_base (261)..(261): a, c, t, g, unknown or other
  misc_feature (261)..(261): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagactaccactggaagaagtagtgatgacgcagtcctccagccaccctgtctgtgtcctaccgagggggaaancgtcccaccctctcctgcgacgggccagtcagagtgtagcagcgacttgccgtgtaccngacacgaaaccgtggccaggcctccgaggtcctcctcatctatgaactgactactacccaacggtaacggccctaacgtagtaactaaccgttaccccgaaggtaccccgttaacggtttccgaaggggttccggggtacgttaacgggggtttcggggttacccgttacggggggaaccttaacggggtttaaccgtttcccctaaaccggtttcccgtaaccccaacccggttaaccttaccggaaccggtaccggtaaccggtaccccgttacggtaccgtaacgggtttaccgtaaacgggtttaaacggttttacgtttttaacggttaaaccttttaaactttttaacgttttaacgttacggttaacgtaacgtaacgttaaacgtttaaactttaacgtttaaccggtaccgttacccccggttacgtttacccgttaaccgggtttttcccggaaccggggtaaccgggttaaccgtacgaccgggttaggaacgtaacgtaaccgtaaacggtaacggtcgtagtacacgccctaccgtac

SEQ ID NO: 68850 - DNA, 564 bp, Homo sapiens
  misc_feature: GYAE6OF01EZCX9.51.76.G10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttagcagcgacttagcctggtaccagcagaaacctggccaggctcccaggcctcctcatctatgtanagcactcccactaacggggccactgatactcccacgcctaggttcagtcggctaggtgggtcngggacagagttcacgtctacacctatcacgtcacgaccctgactacgttcgtagaagttattttgacttaagtttatttactgttcgagctagttaataaactaacgttacgtacccgttaccgttaacgtacttttcggacccgtaacggggaaccaggtctagggatacgtacgaaacgactaggtacggatcgacctacgtacg

SEQ ID NO: 68851 - DNA, 660 bp, Homo sapiens
  misc_feature: GYAE6OF01EVZVT.51.76.G10.1.454.CMB.1.raw
  modified_base (196)..(196): a, c, t, g, unknown or other
  misc_feature (196)..(196): n is a, c, g, or t
  modified_base (529)..(529): a, c, t, g, unknown or other
  misc_feature (529)..(529): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctcagccaccctgtctgtgtctccgaaggggaaancgcccaccctctccgtgcgacgggccagtcaggtagtgttagcagcgtacttacgcctggtaccagacaagaaaccgtggaccgacggcctcccgaggtccctccgtactactctagtgtatcgacactaccgacggtaacgggccagtacgactaccgtcccgacgtccgtaaggttcgaaggtcggacgtaggggttcgggtacgtaggggaacgtaggttacgttaccgaacttccctaccgaacctataccgacggtcacggtcctagaccgtacgttacgtaagtaacgttttactttacgaactttaattttaacttacgtacgtanacgtactaagttaactaacgttaccgtcgttacccgttaccgttaacgttcggttaccggaccggtaacgggtaaccaggtacgtaggaactacgtaaacgaactacggtcggacgtactcgaccctgtcg

SEQ ID NO: 68852 - DNA, 710 bp, Homo sapiens
  misc_feature: GYAE6OF01D2LTX.51.76.G10.1.454.CMB.1.raw
  modified_base (198)..(198): a, c, t, g, unknown or other
  misc_feature (198)..(198): n is a, c, g, or t
  modified_base (702)..(702): a, c, t, g, unknown or other
  misc_feature (702)..(702): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcacgtctccacgccaccctgtctgtgtctccgaggggaanacgcctaccctctcctgcacgggccagtcagagtgttagcagcgtacttacgccgtacggtaccagacaacgaaccgtcggacccaacggcctcccgaggcccttccctactactcgtatgactcgactacgtaccaacggtaacggccaacgtagtacctaccgtacccacgtaccgtacggttacagggtcgacgtagggttcggggtacgtacggggtaaccgtaggttacggttacctaccgttccgtaccgtaacctacgtacccgaacggccgtaaccggtccttaccgggtactaacggttacgtaacggttaagtttaccttttacggtaaactttaacgttttaacttcgttacgttaccgtaacgtattaaacgttaattaaacgttaccgtaccgtaccctttaacgtaccgtttaacgtttccgggaccgtaacggggacctaacggtcgtaggtacgtactaaccgaacgttacgtcgtacggtatcccgntcgttacg

SEQ ID NO: 68853 - DNA, 708 bp, Homo sapiens
  misc_feature: GYAE6OF01AEL4L.51.76.G10.1.454.CMB.1.raw
  modified_base (199)..(199): a, c, t, g, unknown or other
  misc_feature (199)..(199): n is a, c, g, or t
  modified_base (639)..(639): a, c, t, g, unknown or other
  misc_feature (639)..(639): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaacncgcccaccctctcctgccagggccagtccagagttgtacgcagcgtacttacgcctggtaccagcaagaaccctgggaccaggcctacccgaggtcctaccctcagttcctagtcgactcgacctactacccgaacgaacgggtccctacgttacggaacttacccgcccgtaacggtacccgttaacgggtttccagggttcggaccgttaagggtccgggtagtacgggaactaggtcgtttaccaccgtttctaccgaacctatacgaacgccgaacgtcccgtaggaccgtacgtaccgtaaggttaactttagttttacgaacgttttaaactttacgttacgtcttacgaacgttaccttaagtacttaagtaaccgttccgtacccgttacgtaacttccggtttacggacccggttaaaggaccgttacggnggttaaccggaactacgttaaccgaaaccgtttaggtaccgttacggacaccggttacgaccttaccgg

SEQ ID NO: 68854 - DNA, 911 bp, Homo sapiens
  misc_feature: GYAE6OF01CR7H1.51.76.G10.1.454.CMB.1.raw
tcagcgatcgtatacacgaccggtgctcgatttagtcactcatacgagggggaggaactgctcagttaggacccagacggaaccatggaagccccagcgcagcttctcttcctcctgctactctggctccagactaccacgtggagaagtagtgatgacgcaggtcctaccacgccacccgtgtctgtacgtcctaccggaagggggaaactccgccccacccttcctaccgtggaccgacgggggtacccaggttacaagggtaggtttaggttaacgccgtaaacggccggtaaactttcggggaccccttagggtaacccaacggacgaaaccggaaacccgttcgggacccggaacggggtcccttccccgaacggggtccccttccccccgttaaagacctttaccgttaatacggttaagttccgaccttaaccgtacccggaacgaaccggggtaccccacgtaggtaaccttaccgacccccgagtaaccccggtaagggtttccgaaggggtcgtacgggtaacgggtttcggggttaaccggaggggttaacccgtaacgggttacggttaacctacccttcccgtaaccgacctaacgttacccgtaacggacccgtaccggtcccgttacgtaccgttagtaaccggtttaaggtaacgtttcgtttaaacgttactttaaagttttacctttaacgttcgtaaccggtacgtacgttaacgttaaccgtttaaacgttacccgttacggttacccctttaaccggtttaccgtaacgggttttacccggaccgggtaaaccggggtaccgtaacgggtccgggtaaacggtaacggtacgttaaaccgtaaaccgttacggtaacggttacgaccgtaccgtacccgtccgttaaccc

SEQ ID NO: 68855 - DNA, 733 bp, Homo sapiens
  misc_feature: GYAE6OF01ASG8D.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaanacgccaccctctccgtgcgacgggccagtcagagtgtagcagcgtacttagccgtggtaccagcaaggaacctggaccgaggcctacccgaggtccctcctacgacttcgtagtgacgtcgacctactaccgaacggaacgggcctaacgtcgaacttccgtacccgacggtaccgtaaggttcgagggttcggacgtagggtcgggtctagggactaggtacgtctaccgtctaccgtaactgtaccacgtacaccgtccgtagtaccgtaggttacgttaacggtaagtttcgtttaccggtaactttaagttttaccgttaccggttacgtacgtaacgttacgtaacgttaacttaaacggttaccgttaccgggttaccctttaaccggttacgtttaccggtttaccgggaaacccggttaccggggtaaacctacgggttaccggtaaggtaaccggttacctaaacccgggttaaaccgaccggtttcgggttaaccgaccgtttaaccgcccggttaaccgttaccggg

SEQ ID NO: 68856 - DNA, 745 bp, Homo sapiens
  misc_feature: GYAE6OF01C6407.51.76.G10.1.454.CMB.1.raw
  modified_base (200)..(200): a, c, t, g, unknown or other
  misc_feature (200)..(200): n is a, c, g, or t
  modified_base (382)..(382): a, c, t, g, unknown or other
  misc_feature (382)..(382): n is a, c, g, or t
tcagcgatcgtatacacgaccggtgctcgatttagtcactcatacagggggaggaactgctcagttaggacccagacggaaccatggaagccccagcgcagcttctcttcctctgctactctggctccagactaccacgtggagaagttagtgatggacgcagtctccagccaccctgtctgtgtctaccgaggggaaancgccctaccctctccgtgccacggggccagtacaggtagttgttacgcaggcgtacttcgccgtggtaccagaccgtaacgaaacctcggaccgacggcctacccgaggtcctacctactaacttccgtaatgaacgtcgacaccttaccgaagtaaccgggacctacgtagaccttaaccncccgaacgtccgtaggttccagggttacgacgtacggggtcgggtcgtaggggaacctgggttaaccgtaccgtacttaccgtacccactaagtcgacgcctacggcccgtagaccgttaactcgtaaggtacttagttttacgaactttaagttttacttacgttaacgctaagtaacgtaacgtttaaagtaaccgttacgcccggtttaacccgtttacggttaccgtttaccgggtttaccgggtaaccggtaaacggggtaccgtaacggtaccggttagggtaaacgtacccgaaaccggttaaaaggtaccgttaacggggtacgtaacccgttacccgaaacgtccgttaaccgg

SEQ ID NO: 68857 - DNA, 544 bp, Homo sapiens
  misc_feature: GYAE6OF01ESRVK.51.76.G10.1.454.CMB.1.raw
  modified_base (196)..(196): a, c, t, g, unknown or other
  misc_feature (196)..(196): n is a, c, g, or t
  modified_base (382)..(382): a, c, t, g, unknown or other
  misc_feature (382)..(382): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacgaagggccactgatactcccgagcctaaggttcaaggtggctaggtgggtactaggggacaggagttcacctctacaacctntacagtcacgcctgcagtctagagtatttgctaatttatactgtacagactagtataataactcggaccttaccgttactacgtttaggaccgtagggaaccctaaggtcctagggacgacgtacgaaaccggtaacgtcggtacggacttgcgtacctaac

SEQ ID NO: 68858 - DNA, 852 bp, Homo sapiens
  misc_feature: GYAE6OF01DYMQ7.51.76.G10.1.454.CMB.1.raw
  modified_base (201)..(201): a, c, t, g, unknown or other
  misc_feature (201)..(201): n is a, c, g, or t
  modified_base (246)..(246): a, c, t, g, unknown or other
  misc_feature (246)..(246): n is a, c, g, or t
tcagcgatcgtatacacgaccggtgctcgatttagtcactcatacagggggtagggaactgctcagttaggacccagacggaaccatggaagccccagcgcagcttctcttcctcctgcctactctggctcccagataccacgtggagaagtagtgatgacgcagtctccagccaccctgtcctgtgtctccgaggggaanacgccaccttctcctagccagggccaggtcaggacgtgttaagcngcgtacgttagccgtaggtaccagccaagtaaaccgtcggtccgtaacggccgttacccgacggtaccctccctacacttaccgtattacgacttgactaactacccgaagaaccgggcctacgtataacggtactcccaagcccgtaggttaccgagttcggaccgttagggtcgggtaccgtacgggtaccgtaagtacggtttaccaccgttacccggtacctacccgtacttacccggtaaccgaccgtaccggttaccgttccgggaactttaccggttaccggtttaaggttaaaacgggttttacgtttttaacgggtaaccttttaaacgtttttacgttttaaaccggtttaggtacccggttaagtaaccgttaaagttttaaaccgttaaaagttaccggttaccggttaacccgtttacccggtttaaccgttttaacccggttttaaccgggtacccgggtaaaaccggggtaaccgttaaaccgggttacgggtttaagggaacccggttaacgtttaacccggaaaaaacgggttacggttacgggtttaccggggttaactaccgggtaaccccgttaaggtaaccccgg

SEQ ID NO: 68859 - DNA, 551 bp, Homo sapiens
  misc_feature: GYAE6OF01D2LBX.51.76.G10.1.454.CMB.1.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (430)..(430): a, c, t, g, unknown or other
  misc_feature (430)..(430): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggcctcccgaggctccncatctatgatgcatccacgaacgggccatgatacgtcccagcctaggtcagtggcgaggtgggtcgtgggacaggtcgttcacgttcacaccatcacgcacgctgcagtctagaagttatttgattaatttatactgtacagtntaagtataactacgtgtccctacgtacttacgtttcggaccgtacggggacctaacggtcgtaagggataacgtaaccgtaaacggtacgttcggtacggtacttacggcctaacgttacg

SEQ ID NO: 68860 - DNA, 882 bp, Homo sapiens
  misc_feature: GYAE6OF01D8XEV.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccacgcccaccctgtctgtcgtctaccgaaggggaanacgccctaccctctcctgcgacgggccagtcagacgtgttagcagcgtacttacgcctaggaccagaccaacgaaaccgtcggaccacgggtcctacccggaggtcctcctactacgttctaacgtgtaatcgactaacctacccgaacggaaccgggaccctaagttacgtacttaaccgtacccgaacggtaccggttaaggtttccggaagggtcgggtaccggttaaggggttcgggggttaccgtaacggggtaactacgggtaacgtttacccaacccgtttccgtaaccaacccgttaagttacccgaacggtaccgtaccggtaccgttacggaaccgttaacggtttaccgttaaacgggtttaagtttaaccgtttttacgtaaaccttttaaaggtttttaaccttacggtttacgtaaccgtaacgttaacggttaaagttttaaacgttaaacccggtttaaccggttacccgggttaacccctttaaccgggttttaaccgtttacccggggttttaaccgggggaaaccgggttaaaaccgggggtaccctaaaacggggtcggttaaacgggaaacgttaaaccgtaaaaccccgggaaaaggtttaacccgggttgggtttaacccggaaccgtttaccggtaaccgtaacccgtttaaccggg

SEQ ID NO: 68861 - DNA, 810 bp, Homo sapiens
  misc_feature: GYAE6OF01DUH9S.51.76.G10.1.454.CMB.1.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtcgtctaccgaggggaaanacgcccaccctctcctgcgacggccagtcagtgtgttancagcgtacttacgcctaggtaccagacaacgaacctggaccgaggcctcccgacggtcctccctctacgtctatgatacgaactacccaacgtaacgggaccctagttacgaactaccgtccccgaacgtccgtacggtttacgacggttcgggtaccgtacgggtttacgggggttcgtaacggggtacgtacgggttaaccgttaccaccccgttactacctaacccgtataccgacgaccgtacgtacccgttagaccgtacggttccgttaaggttaacggtttatttttaacgttaacggtttaaacctttttaaacgtttaccgttacgttaccgtaacgtttaaccgttaaggtttaaacctttaaacgtttaaacccgggttaccggttacccccgttttacccgggttaacctttaccggggtttttaccgggaaccccgggttaaacgggggtaacccgtaaaggttccgggttaaacgggtaaacgttaaaccgttaaacgtaaacccggttaggttacggttaccgggtacctaccgggtaccctaacgtcgtttaccgg

SEQ ID NO: 68862 - DNA, 670 bp, Homo sapiens
  misc_feature: GYAE6OF01CQ4OD.51.76.G10.1.454.CMB.1.raw
  modified_base (143)..(143): a, c, t, g, unknown or other
  misc_feature (143)..(143): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactgganaagtagtgatgacgcagtctcagccaccctgtctgtgtactccaggggaaangccaccctntcctgcagggccagtcagagtgtagcagcgattgcctggtaccaggcaacggaaacctcgggacctagggcctacccgagggctccgtcaatctaatgattcggacaactccgaacgaacgggccctacgtagactacgtccccgaagccgtaaggtttcagggttggacgtaggtcgggtctggggaaccaggtacgttccacgtctacaccctatacaacgcaacgtccgttaggactacggttctagtaacgttagtttacgtaacttaattttacgttaacttgttaccgtaagtaccgttaaggttaacttaaacgttaaccgtcggttacccgttaccggttacgttaccgttttacgggaccgtaacggggtaaccaacgggtcgttagggtaacgtacgttaaccgtaaaacggttacgttacgggacggtaccgtacggtaccctaccggttaaccg

SEQ ID NO: 68863 - DNA, 664 bp, Homo sapiens
  misc_feature: GYAE6OF01B4SA3.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagcccaccctgtctgtgtctccgaggggaancgcccaccctctcctgcacgggccagtcagtgtgtagcagcgtacttagccgtggtaccagacaacgaaaccgtcggaccctacggcctacccgaggtcctccctacgtatacctagtgatcgacacgtaccgaacgacggtcccagtagaactacctacccgagtaccgtaggtacgaggtcggacgtggttacgggtcgtagggactagtacgttcacctcctaccacctactaccgacgcgacgtcgtacgacgtcgtacgtaggtaacgtttagttttacggacttttaagttttaccgtttacgttacgtaccgtagtaaccgttaagttaacttaacgttaaccgtcggttacccttacgttaccttacggttccgaaccggtaccggtaaccgtacgtacggtacggaagtaacgtacgaaacgttaccgtaggtaccgtactacgtcctaccgttacg

SEQ ID NO: 68864 - DNA, 739 bp, Homo sapiens
  misc_feature: GYAE6OF01C1NVR.51.76.G10.1.454.CMB.1.raw
  modified_base (197)..(197): a, c, t, g, unknown or other
  misc_feature (197)..(197): n is a, c, g, or t
  modified_base (310)..(310): a, c, t, g, unknown or other
  misc_feature (310)..(310): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagactaccactggagaagtagtgatgacgcagtctccagccctacctgtctgtgtctccgaggggaancgcccaccctctacctgccgacgggccagtcagagttgtagcagcgtacttacgcctaggtaccagacaacgtaaccgtggcccaggcctccgagtcctcctactatacttangtaatcgacactacccgacgacggcctagtacgtacttaccacccgaggtaccgttaggtttccgagggttacggacgtacgggggttacgggtcgtaacggggtaactagggtttaacccttaccgtaccgttccctaccctaaccgtactacgaccgtacgtaaccgtccgtcggacgtacgttacgttaagtaagtttctttacgtaacgtttaagttttacgttacgtcgtacgtacgtaacgtaattaacgtacgttaccgttaccgtacccgttaccggttacgttaccgggttttaccgggaacccgggtaccgggtaaccgtaacggtacgggttaacggtaacggtaaaccgttaaccggtaaaaccggttaccggttcgggttaccggtacgttaccggtaaccttaacccgttaaccg

SEQ ID NO: 68865 - DNA, 692 bp, Homo sapiens
  misc_feature: GYAE6OF01CQ0HD.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacaggggggaggaactgctcagttaggacccagacggaaccatggaacgccccagcgcagcttctcttcctcctgctactctggctcccagactaccactggagaagtagtgatgacgcagtctccagccaccctgtctgtgtctccgaggggaancgccaccctctcctgcgacgggccagtcagtagtgttagcagcgtactagccgtggtaccagacaacgaacctggccaggcctcccgaggcctcctactactctatgatgcactaccgacgtacggccactgactactcccagcccgtaggttcaggttcggcgtaggtcgggtacgtggggaacaggtaacgttcacttccgaccaccctaagtccgaagaccgtacgtacccgtcgtacgtacggtaccgtaaggttaacggtttacgttttaccgaactttaaacgttttaacttacgttacggttacgtaacgttaacgtaagtttaaacgttaaaccgttaacccgttccgggtacccttaccggttacgttttaccggttaccgggtaaccggtaaccgggggtaacctaaacgggccggtttaaggaacgttaaacgttaaccgaaacgttacggttcgtaacggacttaccgtacgaccgttacg

SEQ ID NO: 68866 - DNA, 644 bp, Homo sapiens
  misc_feature: GYAE6OF01C77FN.51.76.G10.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (440)..(440): a, c, t, g, unknown or other
  misc_feature (440)..(440): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccaccctgtctgtgtctccgaggggaanacgccacctctctgcagggccagtcagngtgtancagcgtactgccgtaggtaccagacaacggaaaccgtcggaccgacggcctacccgaggtccctccgtactactaccgtattacggactcgactactacccgaacgaacgggcctagacgtactacctacccgaggtcccgtaggtttccgagggtagcgtaggttcggggtcgtgggtaactaggtacttaccgtacgtctaccgaaccncgtaccgacgaccacggtcctggactacggtacgtagtacgttagtttacgtaacttaagttttacgttactacgttcagtactaagttaactaacgtacgttcggccttaaccgtcttacggtttcggacccggtaggtacaacggtcgtaacgacgttaacgaccgtaagacgttcggacgtacgtacgtccgtaacgtccg

SEQ ID NO: 68867 - DNA, 564 bp, Homo sapiens
  misc_feature: GYAE6OF01DN903.51.76.G10.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
  modified_base (527)..(527): a, c, t, g, unknown or other
  misc_feature (527)..(527): n is a, c, g, or t
  modified_base (551)..(551): a, c, t, g, unknown or other
  misc_feature (551)..(551): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctntcctgcagggccagtcagtgtgtagcagcgacttagcctaggaccagcaagaaacctggccaggctcccgagctccnatctatgatgcanccaacgaacggccacgtgaactactcccagccaggttcagtgggctagggtggtcgtgggaacaggtattccactctacgaccatcacgcagtcctgctagtcgtagtaacgtntttacgacttaaattttattaaccgtntaccgagtacgtaagttaaataaacttaacgtcgtacccttaccgtacttacgtttcggaccgaaggggaacctaaggcgtaagganaactaacgaaacgtagtcgtaggntacgctaccgtag

SEQ ID NO: 68868 - DNA, 818 bp, Homo sapiens
  misc_feature: GYAE6OF01EAA1H.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgacgacgggccagtcagagtgttagcagcgacttagcctggtaccagacaacgaaaccgtggcccaggtcctacccgaggcctccctctattcctaagttcgacgttaggcctaacttacccgaacgaaccgggccctaaccgtaggtaactaccgttccccgaacgtcccgttaagggttccaagggttcggtacgtacgggttcgggttaccgggtacgggacgtaacggtacgtttacctactttaccgttacccaacctaacttaccggaacgtaccgtaacggtccccgttaggaccgttaacggttaccgtaaggttaaaccgtttaggtttttaacgtaaccgtttttaaactttttaacgtttaaccgtttacgtacccggtaagtaaccgttaaagttaaacgttaaacgtttaaccggttacccggtaaccccgtttaacccgtttaaccgtttaccgttttaaccggggaacccggttaaaccggggtaaacccgtaaacgggtaccggttaagggtaacggtaaacgttaaacccggaaaacggttaaccgttacgggtaccggaccggttacgaccgttaaccggtttaacc

SEQ ID NO: 68869 - DNA, 677 bp, Homo sapiens
  misc_feature: GYAE6OF01A3GM3.51.76.G10.1.454.CMB.1.raw
  modified_base (201)..(201): a, c, t, g, unknown or other
  misc_feature (201)..(201): n is a, c, g, or t
  modified_base (638)..(638): a, c, t, g, unknown or other
  misc_feature (638)..(638): n is a, c, g, or t
tcagcgatcgtatacacgaccggtgctcgatttagtcactcatacagggggagaactgctcagttaggacccagacggaaccatggaagccccagcgcagcttctcttcctcctgcctactctggctcccagataccactggagaagtagtgatgacgcagtctccgagccaccctgtctgtcgtactccgaaggggaaancgccctaccctctcctgacacgggccagtcagtagtgtacgcgaggtacgacgtttacggccttacggtaaccaggtaccgaaacggtaaacccgtggacccgaacggtccgtacccgaaggtcccttaccctaccgtagttaccttagtcggaacgtcgtactaccgtacccaacggaacggtcctagttagaaccttcgtacccgataccggtagttacgaggtcgcgtagggtcgggtcgtacgggactaggtccgttacaaccgttcaacccgacgtacgtacgacgttccacggttacctacggtacgaggttcgttaagttaacgtttatttacggtaacctttagttttaactacgttacgttaaccaggtactaacgttaagtaactacgtcgtacttacgtacttacggttcgaccgaggtacgtagngtagagtccaagtacgtacgtgaggtcacgtccaattcg

SEQ ID NO: 68870 - DNA, 729 bp, Homo sapiens
  misc_feature: GYAE6OF01EVG83.51.76.G10.1.454.CMB.1.raw
  modified_base (327)..(327): a, c, t, g, unknown or other
  misc_feature (327)..(327): n is a, c, g, or t
tcagcgatcgtatacacgaccggtgctcgattttagtcactcatacaggggggtagggaactgctcagttaggacccagacggaaccatggaagccccagcgcagcttctcttcctcctgctactctggctcccagataccactggagaagtagtgatgacgcagtctccagccacctgtctgtgtcctacgaggggaacacgcccaccctctccgtggcgacgggccagtacagtacgtcgtacgcacgcgtacttacgcctagtaccagcgaacgaaccgtcggaccacggcctaccgtaggtcctacctcgtaacttctactgngtacgactacgtaccaccgacggcctacgtgtactaccgtcccgagtaccgtaggttcgaggttacgggacgtagggtcgggttaccgtgggaaacctacggtacgtttaccgactttccgaccgtacctacgtaccgacgccgtaacggtcctaggtacgtacgttacgttaacgtagttttaacgtttagtaacttttaagtttaccggttacttacggtaaccgtacggacgtttaacgttaaccggttaacggttaaccggtcccggttaaccttaccggtttaaccgttacggtttaacgggacccggttaaacgggaaccttaggtaccgtagggaaccgtacttaaccggtaaaccgttacggtcggttacgaccgttccgtacctaccgttacg

SEQ ID NO: 68871 - DNA, 564 bp, Homo sapiens
  misc_feature: GYAE6OF01AIIRK.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggggaaangccaccctctcctgcagggccagtcagagtgttagcagcgacttagcctggtaccagcagaaacctggccaggcctcccaggcctcctcatctatgatgcatcccacaacgggccactgatactcccagccaggttcaggtggctaggtcgggtcgtgggacaggtacgtttccacgttcctaccacctactcgacgcgacgcctgctagtctagaattagtttgacttaatttacttacgtcgtacgtagtctaagttaataacttacgtcggtcccttaccgttacttacgtttcgggccgtacgggaccaggtcgtaggacgtagtaccgaaacggtacgtggtagaccgtcgtaccacgtcg

SEQ ID NO: 68872 - DNA, 773 bp, Homo sapiens
  misc_feature: GYAE6OF01ECWO3.51.76.G10.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
  modified_base (455)..(455): a, c, t, g, unknown or other
  misc_feature (455)..(455): n is a, c, g, or t
tcagcgatcgtatacacgaccggtgctcgatttagtcactcatacagggggaggaactgctcagttaggacccagacggaaccatggaacgccccagcgcagcttctccttcctcctgctactctggcctccagactaccacgtgggaagaagttagtgagtcgacgctagtcctaccacgcccacctgtctgtcgtcacggaagggaacnccgccacctctccgngacgaggccagtcgagtagtgtagcagctagttacgccgtacgacacgacaacgaaccgnggaccgacggcctacgacgtcctccgtactatctagtnagtccgactacctaccgaacgtaccgggtcctaacgttacgactaccgtaccgacggtaccggttaaggtcgtacggtcggggtaggtacgggttcgggtacggacggtaacgtacggtaccgtttacccncgtacctaccgaacctacgtaccgacgtccgacgtccgtacgtaaccgttacgtagtaacggttaacgttttcgtttaacgtacgtttttaatttaccgttacgtttacgacgttaacgttaactttaacgtaaacgttaacccgttacggttaccggttacccgtttaccgtttaaccggttaccggtttaaccgggacccggggttaaccgaaaccggttacgggtacggtaaggtaaacctaaacgggtaaacccgttaaaccggttagggttaccggtaccgaaccgtttcccgtagtaaccggtttaacccgg

SEQ ID NO: 68873 - DNA, 797 bp, Homo sapiens
  misc_feature: GYAE6OF01DJT0L.51.76.G10.1.454.CMB.1.raw
  modified_base (144)..(144): a, c, t, g, unknown or other
  misc_feature (144)..(144): n is a, c, g, or t
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgganaagtagtgatgacgcagtctccagccacctgtctgtgtctcgaggggaaancgccaccctctcctgcgacgggccagtcagagtgttagcagcctacgttacgccgttaggtaacccagtaccgaaacggtaaacccgtcgggaccctaacgggtacccttaccccgaacgggtccccttaccccgttactaactttaccgttaagttacggtaacgtttcggacccttaaccgttaccccgaaaccgggaacgggtaccccctaagttacggtaacttacccgtaaccccgaacggtacccgttacggtttaaccgaggggttccgtaccggtagggtttcggggaaccgttaggggaacctacgggttacgtttaccaaccgtttccgacctaaccgtacttaccggaccgaccgtacgtcccgttacgacgtacgtacgttaaggtaacgtttacgttttacgaacgtttttaagttttacttacgttacgttacgacggtaacttaaagttaacttaacgtacgttccgtacccgttacgttaccgttacgtttaccgggaccggaacggggtacctaggtacgtaggaacgttaaacgaccgtaaaacggtacgttcggtacgtaccgtaacgtaccctacgttaacg

SEQ ID NO: 68874 - DNA, 647 bp, Homo sapiens
  misc_feature: GYAE6OF01A6W8H.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcaagaacctggccaggcctccgaggcctcctcatctatgatgcactccgaacgaacgggccatgactactcccgagccgtaggttcaggtcggacgagggttcgggtcgtggggaactagggtagtttccgacttccgtaccaccgtataccgaacgtccacgtcccgtgacgtacgtcgtagtaagttagttttacgacgtttaattttactttaacgtcgtacgtaagacgttaagttaacttaagtaaccgttcggttaacccgtaccgttaacgttaccgttttacgggacccggtaaacggggtaaccgtaacggtcgtaagggtaacggtaacgtaaccggtaaacgtacgttacgggtagtaccgtacgtcccgtaacgttaccg

SEQ ID NO: 68875 - DNA, 734 bp, Homo sapiens
  misc_feature: GYAE6OF01DM6S8.51.76.G10.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccacgtggagaagtagtgatgacgcagtctccagcccaccctgtctgtgtcgtcgaaggggaancgccctacctcncctgcgaggccagtcagagttgtagcaggctacgttagccgtaggtaccagccgaacggtaaaccgtcggacccgacgggtaccctacccggacggtccttccccgtactaacgttccgtaaatcggtactaccggtactaccgtacccgaaccggaacggtccctaacgtacgtaactaccctacccgtaacggtaccgttacggttcgacgggtcgggacgttagggttccggggtacgacggggtaaccttaggtacggttacctaccgttaccaccgtacctacgtccgacgtccgacgtccgtacggtactacgttacgtaacgttaagtttacgtttacggtaacctttaacgttttacgttacgttcgtaacgtacgtactaagttaacttaacgtaccgtaccgtccttacgttacgttacggtttcgaccggtacggaaccgtacgtacggtagtacggtaactaccggtaaaccgtacggttacggtacggtactacggacctacgttaccg

SEQ ID NO: 68876 - DNA, 805 bp, Homo sapiens
  misc_feature: GYAE6OF01AOL51.51.76.G10.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggcctcccagatacccacgtggagaagtagtgatgacgcagtctccagcccaccctgtctgtcgtctccgagggaaancgcccaccctntcctgccgacggccagtcagtacgtgtagcagcgacttgccttggtaccagcctaagaaccctggccacggcctaccccgtaggcccttccctacacttacctacgttaaccggagttaccgaccctaacgtaccccgaaaccgggtaaaccggggcccctaaaggtttaccggaacctttaaccccgacccccggaaggtaccccgttaaggttccgaaacggggtttcgtaacggtacgggggttacgggttccgtaaggggaacccttagggtaaccgtttttcccaacccgttccgtaacccgtaacccgtacgtacccgtaacgtaccgaccggttcccgttacgcccggttaagttaccggttaacggtaacggttttacttttaacggtaactttaaacgtttttacgttaccgttaggtaccctaaagggttccttaacgtttaaacgtaacgttaacccgttccgttacccgttaacccgttacgttaaccgtttcggaccggtaaccggtaccgtaaacggttcgtaacgtacgtaactaccggtaaaccgtaggtcgtacggacttccgaacgtcccgtag

SEQ ID NO: 68877 - DNA, 585 bp, Homo sapiens
  misc_feature: GYAE6OF01DV9L4.51.76.G10.1.454.CMB.1.raw
  modified_base (569)..(569): a, c, t, g, unknown or other
  misc_feature (569)..(569): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaagacgcccacccgtctcctgcagggccagtcagagtgtagcagcgacttgcctggtaccagcaagaacctggccaggcctcccaggcctcctcatctatgatgctactccaacgaacgggcccacgtgactactcccgagacctaggttcagtgggctagggtcgggtcgtagggactgacggttccactcgtacaccataccgagccagtccctgcgtagtctagtagtatttgactttaatttacttatagtccaagtactaagttaacttaacgtacgttccgtacccttacgtacgttaccgttcgggacccggagggtacccgaaggtccgtaggaagtcgtaaccgaaacggacttcggtacggtntaccgccttacgtacg

SEQ ID NO: 68878 - DNA, 802 bp, Homo sapiens
  misc_feature: GYAE6OF01DJ7RL.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagagtagtgatgacgcagtctccagccaccctgtctgtgtctcgaggggaagcgcccaccctctccgtgcgaggccagtcagtagtgtagcgagcgtacgttacgccgtaggtaccgagaccgtaacggaaaccgtcggaccgacggtcctacccgaggtccctccctacacttctacgtgtactcgaccacgtacccgaacgaaacgggccccaaacgttcgtaaccttaccgtaaccccgtaaggtaccccgtaagggtttaccgaacgggtttcgggacccggttaagggggtttccggggtacggtaacgggggtaaccgtaggttaccgtttacccgtaaacttcccgtaacccgttaacccgacgttaaccgacggaccgtaaccggtcccgttacgaaccgttaacggttaccgttaacggttaaacgtttcgtttttacggaactttttaaacgttttactttaaccgttacgttacgaacggttaattaaacgttaacttaaacgttaaccgtacccggttacccgttacccgttacgttaccggttttccgggaccggtaaaccgggaacccgtaggtaccgtacgggtaacggtacctaaacccgtaaacggtacgttccgggtagtacgtaccgtacctaccgttacg

SEQ ID NO: 68879 - DNA, 538 bp, Homo sapiens
  misc_feature: GYAE6OF01BGQCJ.51.76.G10.1.454.CMB.1.raw
  modified_base (197)..(197): a, c, t, g, unknown or other
  misc_feature (197)..(197): n is a, c, g, or t
  modified_base (320)..(320): a, c, t, g, unknown or other
  misc_feature (320)..(320): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctaggtaccagcagaaacctggccaggcctcccaggcctcctcatctatgatgcatccacgacggccatgactacnccgagcctaggttcagtcggctaggtgggtctgggacaggtacgttcacttctacacctatcacgcacgcctcgactacgtctagtaagttatttagtacttaatttattactgtactagtctaagtaataattacgtcgtcctacgtactcgtttcggaccgtaggtacacgtcgtaggacgtactacgaacgacgtcgtacgagtcgcgacgtacg

SEQ ID NO: 68880 - DNA, 611 bp, Homo sapiens
  misc_feature: GYAE6OF01BMZEA.51.76.G10.1.454.CMB.1.raw
  modified_base (198)..(198): a, c, t, g, unknown or other
  misc_feature (198)..(198): n is a, c, g, or t
  modified_base (568)..(568): a, c, t, g, unknown or other
  misc_feature (568)..(568): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgttagcagcgacttagcctggtaccagcaagaaacctggccaggcctcccgaggctcctcatctatgatcgcactccaacgaacgggccacgtgactactcccgagccgtaggttccaggtcggacgtagggtcgggtcgtaggggtacaggtacgtttcaccgttccgtaccaaccgtatccgacgccacgtcccgtagaccgtagtccgtaagtaagttattttacgactttaagttttattacgttgtactatacgtaagttaagtaacgtaccgttcgtacccttaccggttaaccttcgtttacgggacccgtaacgggaacctaggcgtagganacgtaacgaaacgtacgtggtaccgtagtacgtccgtcgtacg

SEQ ID NO: 68881 - DNA, 668 bp, Homo sapiens
  misc_feature: GYAE6OF01C42BY.51.76.G10.1.454.CMB.1.raw
  modified_base (203)..(203): a, c, t, g, unknown or other
  misc_feature (203)..(203): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaagtagtgatgacgcagtctccagcccaccctgtctgtgtcctccgaagggggaaanacgcccacccgtctcctgcgagggccagtcagtagtgtagcagcgacttgcctaggtaccagacaacgaaacctcggacccaggccctacccgaggtcctccctcattacctagtagactgacctactaccgaacgacggaccccagttacgactaacctcccgagtaccgtaggtttccaggtacgggcgtagggttacgggtccgtaggggaactacggtcgttaccgaccttccgtaccaccgtataccgacgaccacggaccttgactagtactaaggtaacgttacgttttcgaacctttaagttttacttacgtacgttactacggtaactaagtttaaagtaacttaccgtacgttacccgttaccgtacgtttacggttaaccggaccggaacgggtaccaaggtcgtaagaacgttactaaaccgtaaagacgttgggactcaacggcctcgtacg

SEQ ID NO: 68882 - DNA, 634 bp, Homo sapiens
  misc_feature: GYAE6OF01ERFLF.51.76.G10.1.454.CMB.1.raw
  modified_base (203)..(204): a, c, t, g, unknown or other
  misc_feature (203)..(204): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (622)..(622): a, c, t, g, unknown or other
  misc_feature (622)..(622): n is a, c, g, or t
  modified_base (628)..(628): a, c, t, g, unknown or other
  misc_feature (628)..(628): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgggagaagtagtgatgacgcagtactccagccacccgtgtccctgtcgtctccgaggggaaannccaccctntccngccagggccagtcagtagtgttagcaggccattacgccgtggtaccagccaacgaaccgtcggaccacggctcccgaggtcctcctacatctacgtgatcgcaactaccacgaacgggtccagtgaacttccgtacccgagccgtaaggttccaagggtcgaccgtaggtcggtcgtggggaacaggtacgtttccacgttcctaccgacctatccgacgacgaacgccgtagccgacgtcgtaagtaacgttcgttttacgactttaactttaccgtttacgtacgtctaacgtctaaacgtttactaaacgttacccgtcggtaccttaccggtaacgttacggtttaccggaccgtaagggacctaaggtcgtagactagtaaccgaacgaactgggtacgtnacgtcncgtacg

SEQ ID NO: 68883 - DNA, 730 bp, Homo sapiens
  misc_feature: GYAE6OF01A8BDU.51.76.G10.1.454.CMB.1.raw
  modified_base (198)..(198): a, c, t, g, unknown or other
  misc_feature (198)..(198): n is a, c, g, or t
  modified_base (441)..(441): a, c, t, g, unknown or other
  misc_feature (441)..(441): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccacctgtctgtgtctccgaggggaaacncgcccaccctctcctgcgacgggccagtcagagttgtagcagcgacttacgctggtaccagcaacgaacctggccaggcctccgacggcctcctacactctagtgtactcgcacctaccgacggaaacgggtcccaacgttcgaacttacccgtaccccaagtacccggtaggttacgtaagggttcggaccggtacggggtttggggttaccggtcggggaactagggttaccggtttaacnccttaccttacccgaacccgtactaccgacgtaccgaccgtccgttaccgacgtacggttacgttaacggtaacgttagttttacgtaactttaactttaacgtttacgttacgtacctaaggtaccgttaagttaaccttaaacgttaaccgttaccggttaccgttacccgttaaccgttacgttttaccgggaccggttaaccgggaaccggtacgtaccggtagggtaacgtaacgaaccgtaaacggacgttacggtacggtacgtaccgtacgtaccgttacg

SEQ ID NO: 68884 - DNA, 814 bp, Homo sapiens
  misc_feature: GYAE6OF01DY5ZT.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcgagggccagtcagagtgttagcagcgacttagccgtggtaccagacacgaacctggccaggcctcccgaggctcctcatctatgatgctactccacgacgggcctaacgtgactacctcccagtccgtaggttcgaggtcggcgtagggtgggtccgtagggtaacgtaggtacgtttaccgtaccttccgtaccaaccgtactaccgaacgaccgtacggtcccgtacggccgttaacggttaccgttaacggttaaagtttagttttttaaccggtaacttttaaaacgttttttaacgttttaaccgtttacggttaccgtaacggttaaccgtttaaacgttaaaacgtttaaaaccgtttaaacccggtttaccgggtttacccccgtttaacccggtttaacccgttttaaccggtttttaacccggggaaccccggggttaaaaccggggggtaaaccccgttaaacgggttaacccggggttaaggggttaaacgtaaacgtttaaaaccccgggtaaaaccgggttaaacccgggttacgggttaacccgggttaccgttaaccggtaccccgtaacccgtttaaacccgg

SEQ ID NO: 68885 - DNA, 695 bp, Homo sapiens
  misc_feature: GYAE6OF01ETGRM.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgcccaccctctcctgcgagggccagtcagagtgttagcagcgacttagcctggtaccagcaagaaacctggccaggcctcccaggcctcctcatctatgatgcactacccaacgaacggggcccaacgttagaacttaccgtacccgaacggtccctaagggtttccgaagggttcgggctaaggggtcggggttaccgtaggggacgtaggtacgtttaccaccgttcctaccgaacctataccgacggcctacggccgttacggacctacggtcgtacggtaagttactttttacggactttaattttaacgtttacgttacgttacaacgttacctaaggttaacttaaagttaaaccgttcgggtaccccttaccggttaaccgttaccgttttacggggacccgtaaacgggggtaaccctaagggtccgtaagggtacgaacgttaaccgaaaacggttacgtggtacggtacgtacgaccacgttaacg

SEQ ID NO: 68886 - DNA, 704 bp, Homo sapiens
  misc_feature: GYAE6OF01CTJML.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagccaccctgtctgtgtctccgaggggaacacgcccacccgtctccgtgccgagggccaggtcagtgtagtagcgaagcgtattgcctaggtaccagcaacgaacctggaccaggcctccgagtcctccgtcatctatgatcgactactccaacggacggccctaagtgtaactaccgtaccccgaggtacccgtaaggtttccgaagggttcgggaccgtaaggggttcgggttacgtacggggaactagggttaacttccacgttacccgttaccgaacctacgtaccacggaccgtacgtccccgtgtaccgtaacgtacgtaggttaacgtttacgttttacgtaaactttaagttttaacgtttacgtagtaactacgtaacgtaagttaacgttaaacgttaccggtcgtacccgtttaccgtacgttacggtttaccggaccggtaacgggtaccaacggtcggttagggaacgtaaccgtaacggtaaaccgtacgtacggttacggacgtaccgtactaccccggtta

SEQ ID NO: 68887 - DNA, 758 bp, Homo sapiens
  misc_feature: GYAE6OF01CDGMH.51.76.G10.1.454.CMB.1.raw
  modified_base (149)..(149): a, c, t, g, unknown or other
  misc_feature (149)..(149): n is a, c, g, or t
  modified_base (232)..(232): a, c, t, g, unknown or other
  misc_feature (232)..(232): n is a, c, g, or t
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagagtagngatgacgcagtctccagccaccctgtctagtgtcctccgaggggaaacacgcctaccctctcctggcacggggccagtcaagngttcgtagcagcgattagctgtacagnagaactgcaggctccaggctcncgatctatgacgtgtacgactccgaacgacgggacctaacgtgaacgttaccgtacccacgtaccgaacggttccgtacggttacggcgtaacggtttcgggtccgtaagggtactacggtaacggtttaccctacttccggtaccaaccgtacgttacccgaacggtccgtaacgtcccgtacggtaccgttaacgtttaccgttaaggaaacccgggtttaggtttttaacggtaacctttaaacgttttaacgttttaacgttcggttaaccgtacgggttaccgttaaggtttaacgttaaacgttaacccgtttacggggttaaccttaccggttaaccgttacggttttacccgggaaggttaacccgggggaacgttaaaccgtcggtaacgggtaacgtaacggttaacccggtaaaacggtaccgttacggaccggttaccgtaaccgggttcccaacccgttaacgg

SEQ ID NO: 68888 - DNA, 705 bp, Homo sapiens
  misc_feature: GYAE6OF01CVU26.51.76.G10.1.454.CMB.1.raw
  modified_base (361)..(361): a, c, t, g, unknown or other
  misc_feature (361)..(361): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagccaccctgtctgtgtctccgaggggaaagagcccaccctctcctgcgacgggccagtcagaggtgttagcagcgacttagcctggtaaccagacaacgaaacctcggaccgacggcctacccgacgggtcctccgtactatctacgtgtactgacctacaccgtaacgaacgggacctacgacgtactaacncccgagaccgtaggttcaacggtcggacgtagggttcgggttacgacgggtacgaagggtcttacgactccgtaccacctactcgaacgctacgtcgtcgacgtagtacgtagtaacgtttacgtttacggaactttaaagttttattacgtacgttacgtaagtaccgttaaagttaactttaaacgttaccggttaccggtaccctttaaccggttaccgtttaacggttttacgggaacccgtaaaccgggggtaacctaacggtacgggtagggaacgttacgtaaacggtaaaacgtacggttaggtacgggtacctaacggtaccgtaccgttaaccg

SEQ ID NO: 68889 - DNA, 872 bp, Homo sapiens
  misc_feature: GYAE6OF01AEOZL.51.76.G10.1.454.CMB.1.raw
  modified_base (203)..(203): a, c, t, g, unknown or other
  misc_feature (203)..(203): n is a, c, g, or t
  modified_base (336)..(336): a, c, t, g, unknown or other
  misc_feature (336)..(336): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagcccaccctgtctgtgtccgtccggaaggggaaancgaccctaccctcgtcctggacgacgggccagtcgagagtagttacgcagtacgtacttacgccgttacggtaccagacgaacgtaaccgtggacccacggcctacccgagtccctacctacgacttctaagngtacgtccgactaccgtaccgaaccgacgggtacctacgttagaaccttacacccgacggtaccgttaacggttaccgtaagggtcggtaccgttaggggtttacgggtacggtaacggggacttacgggtacgttacccgtactacccgtaccgtaacccgacgttacgaaccggtcgtaccgtcggttaaccgacggtagttaccggtaattacgggttttaacgtttacgtaacctttttaaacgttttacgttaaccgttacggtttaacgtaacggttaacgttttaacggtaaaacctttaaccgggttaaaccgttacccggggtttaaccccttttaaacccggtttaccggtttaacccgggttttaaccgggaacccggtttaaccgggggtaaaaaccccgttcgggttaacgggttaacccggtaaaacgggttaacccgtttaaaacccgggtaaacgttaaacggggtttacggtacccggggttaacctacccgggtaaaccgtttcgtttaaaccccggg

SEQ ID NO: 68890 - DNA, 665 bp, Homo sapiens
  misc_feature: GYAE6OF01EQ98R.51.76.G10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccacctntcctgcagggccagtcagagtgttagcagcgacttagcctggtaccagcaagaacctggccaggctccaggcctcctnatctagtgatgacactccgaacgaacgggccaacgtgaacttacgcccgaagccgtaagggttcaacgggtggacctagggttcgggtcgtagggactaggtacgtttcaacgtcctaccaaccgtatccgaagcgtacggtcctaggacctaggttctaggtaattacgttttacgacgttaaattttacgtaacgttcgtactaacgtcgtaagttaacttaaacgttaacgtcgggttacccttaccgggttaaccttacgggttttcggaaccccggtaacggggtaaacccgtaaggtaccggttaagggaactaacgttaaccggtaaaaccggttacgttacgggtacgtaccgtacggtacccgacgttaaccg

SEQ ID NO: 68891 - DNA, 724 bp, Homo sapiens
  misc_feature: GYAE6OF01CT6NY.51.76.G10.1.454.CMB.1.raw
  modified_base (502)..(502): a, c, t, g, unknown or other
  misc_feature (502)..(502): n is a, c, g, or t
  modified_base (550)..(550): a, c, t, g, unknown or other
  misc_feature (550)..(550): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacggcagtctccagcccaccctgtctgtgtctccgaggggaaacgacgcccaccctctcctgcacgggcagtcgagagtgttagcagcgtacgtgccgtgtaccagaccgaagaaacccgtgaccgtaacggccttccgaggccttccctacgtacttcctatgatcgacaccgtaccaacgaacgggcccatagactactcccgagtccgtacgttcgaggtcggacggtagggttcgggtccgtagggtaactacggttacgttaccgtacgtacctaccgacctattaccgaaggtccaccggtcgtagtacctacggttaactacgggttaatcggtttttanaaccgttttaatttacgttagtcgtacgaaagttcgaacgttttaaanaaacccggtttacgtaccggttacccttaaccgtaccgttttaacggttacccgggaccgggtaaaccggggtaactaaaccggttcgggttaaagggtaaccgtaaaacgttaccccggtaaaaggttaaccggttcggtaacggacgttaacccggtactaccgggtttacc

SEQ ID NO: 68892 - DNA, 607 bp, Homo sapiens
  misc_feature: GYAE6OF01B404Q.51.76.G10.1.454.CMB.1.raw
  modified_base (195)..(195): a, c, t, g, unknown or other
  misc_feature (195)..(195): n is a, c, g, or t
  modified_base (473)..(473): a, c, t, g, unknown or other
  misc_feature (473)..(473): n is a, c, g, or t
  modified_base (492)..(492): a, c, t, g, unknown or other
  misc_feature (492)..(492): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaanagccaccctctcctgcagggccagtcagtagtgttagcagcgacttagccgtaggtaccagacaacggaaccgtggaccaggcctacccgaggcctcctcatctactgatcgactactcccaaggaacggcccatacggactaccgtacccgagaccgtaggttacgacggttcgggcgaggttcgggtacgtgggactaggtacgttcacgtctacactatcagcacgtctcgacgtagtcgtacgaattatttacgtacttaagtttactacgttntccgtaagtctaagttaanaacgttacgtcgtacctaccgttataccggttacggaccggaggaaccgtaacgtcggtagggacttaacgacccgtaaaacggtacgtcggtacggtacctcgaccgtcctacg

SEQ ID NO: 68893 - DNA, 746 bp, Homo sapiens
  misc_feature: GYAE6OF01BAXZ7.51.76.G10.1.454.CMB.1.raw
  modified_base (197)..(197): a, c, t, g, unknown or other
  misc_feature (197)..(197): n is a, c, g, or t
  modified_base (232)..(232): a, c, t, g, unknown or other
  misc_feature (232)..(232): n is a, c, g, or t
  modified_base (289)..(289): a, c, t, g, unknown or other
  misc_feature (289)..(289): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaancgccaccctctcctgcagggccagtcagagtgtancagcgtacttacgcctggtacagcaagaacctcggccacggcctaccgaggcctccncactctagtgactgcctactaccgacgaacgggccactcgactactccgacgcctaggtccaggtcggcgtaggtcgggtcgcggaacgagtacgtctacgtctaccactactacgacgtcacgtcgtacgacgtacgtacgtacgtaagttacgttttacgtacgttaaacttttacgtttacgttacgttacgtaacgtacgttaaacggttaacgttaaacgttaaccgttaacggtttacccccgttaacccgtttaaccggtttaacccggtttttacccgggaacccgggttaaaccgggggtaaacccgttaaaccggggttaacgggttaaccggggtaaaacggtttaaaccggtttaaaacccgggtaaaaaccgggttaaaccgggtttacgggttacccggggttaaccggttaaccggtaccccggttaaaccggttaacccgg

SEQ ID NO: 68894 - DNA, 591 bp, Homo sapiens
  misc_feature: GYAE6OF01A6519.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaanacgccaccctctcctgcagggccagtcagagtgttagcagcgacttagcctggtaccagcaagaacctggccaggcctcccaggcctcctcatctatcgatgcactccgaacgaacgggcccactgactactcccagccaggttcaggtgctaggtgggtctgggacagtacgttcactcctacacatcgacgcacgcctggacctagtctagaagttatttcgacttaattttattaacttctacgacgtactaagttaactaaagttaaccgtcggtaccctttaccggtacttaccggtttcgggacccgtaggggtaacccagggtccgtaggtaacgtaaccgtaaccgtaaacggaacgttcggtacggaccttcgaccctccgtaacg

SEQ ID NO: 68895 - DNA, 560 bp, Homo sapiens
  misc_feature: GYAE6OF01D6HA6.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (309)..(309): a, c, t, g, unknown or other
  misc_feature (309)..(309): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagagtgttagcagcgacttagcctggtaccagcagaaacctggccaggctcccggctcctcatctatgatgcatccacaagggccangatatccagccaggttcagtgctagtgggtctgggacagcgttcacgtctcaccatcagcagcctgcatcgtagaagtatttgactaagtttattactgtacagactagtataagtaacttcgtaccttaccgtacttacgttttaggacccgtacggggtaacctaaacggtccgtagggtaacgtaactaccgaaaaaccggtaaccgttacggttacggaccgttaggaccctaaccgtacgttaccg

SEQ ID NO: 68896 - DNA, 851 bp, Homo sapiens
  misc_feature: GYAE6OF01CFI4I.51.76.G10.1.454.CMB.1.raw
  modified_base (600)..(600): a, c, t, g, unknown or other
  misc_feature (600)..(600): n is a, c, g, or t
tcagcgatcgtatacacgaccggtgctcgatttagtcactcatacagggggaggaactgctcagttaggacccagacggaaccatggaacgccccagcgcagcttctcttcctcctgctactctggcctcccagactaccacgtggaagtaagtagtgatgacgcagtcctccacgcccaccctgtctgtcgtcctaccgaaggggaaacgcgcccaccctctccgtgaccgacggtccacgtcgaacggtaggttcggttacgaccgtacggtccgtaaccgtttaccggacccgttacggggtaacccgaacggtaaccgaaaccggtaaaaccccggttcgggacccggtaccgggtcccgttaccccggacgggtccccttaccccgttacctacgtttacctaggtacgtaccgttacggacctaacgtaacccgaaccggtaaaccgggtaccctaacgtaggtaaccttaccgtaccccgtaacggtacccgttaaggttaccgacggggtacggtacggtagggttcgggttacggacgggtacgttaacgggtaccttccctacgtaccgttaccaacgtactccggaccncgtaccggtcccgtagtacgtacgttacgttaagttacgtttacgtttacgtaactttaaacgtttcgttaccgtacgtacgtaacggtacgttaacgttaacgttaacgttaccgttaccgttacccgttaccgttacggtttaccggtaccggtaaccgggaaccgggtaaccgtacgggtagtaccgggtagtaaaccgtaacgtaaacgttcggtacggttacgaccgtacggtacgttcctacggg

SEQ ID NO: 68897 - DNA, 771 bp, Homo sapiens
  misc_feature: GYAE6OF01EFAV3.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaaangccaccctctcctgcagggccagtcagagtgttagcagcgacttagcctggtaccagacgacgaaacctggccaggcctcccgaggcctcctcatctagtgatcgacactacccaacggaacgggcctacgtagtaacttacctacccgagaccgtaggttcgaggttcggacgtacgggttcgggtacggttacggggactaggtacggtttccaaccgtttccgtaccaacctattaccgaacggtccgaacggtccctacgtacggaacggtttaccgttaaggtaagtttaacgtttttacgaacctttttaaacgtttttactttaacgttcggttaaccgtaacggttaacgttaaacggtttaaactttaaaccgtttaaccggttaccgggttaacccgttttacccggtttaaaccgtttaccgggtttttaccggggaaccccgttaccgggggtaaaacccctaacggggttccgttaaggggaaccgttaacggtaaacccgtaaaacggttaacgttacgggttacgggtaccgtttaccgaacccgttaacccgttaccgg

SEQ ID NO: 68898 - DNA, 762 bp, Homo sapiens
  misc_feature: GYAE6OF01DLC24.51.76.G10.1.454.CMB.1.raw
  modified_base (206)..(206): a, c, t, g, unknown or other
  misc_feature (206)..(206): n is a, c, g, or t
tcagcgatcgtatacacgaccggtgctcgatttagtcactcatacaggggaggaactgctcagttaggacccagacggaaccatggaagccccagcgcagcttctcttcctcctgctactctcggctcccagactaccacgtggaagaagtagtgatgacgcagtcctaccagccaccctgtctgtcgtcgtacgaaggggaaacncgccctaccctctcctgccgagggcctagtacaaggtgttagtacgacgacggtcgtaacgttacgccgttaggaacccagtaccgaacgtaaacccgcggaccacggtccctacccggacgtcccttcccgtactaacgtccttaagcgtagtaccgacctaccgtaccgaaacgtaccgggactaacgtacgtactacccgaccgacgtaccgtacggtttgaggtcggtacgtacgggtcggtcgtacggaactacggtacgttactaccgtaccgtaccgatacctacggacgccgtaacgtccgtaagtccgttaagttacgtaagttaacgtttatttacggtaattttaacgtttcgttaacgtacgttaacgaacgtttaacgttaagttaaacgttaaccgttaacccgtcccggtttaacccgttttaaccgttccgttaaacgggtttaccgggaaccggaaaaccgggttaaccaaggttcggtaagtaacggtaacgtaaccgtaaacgtacgtacggtaacgccgtagtaacctaaccggtc

SEQ ID NO: 68899 - DNA, 689 bp, Homo sapiens
  misc_feature: GYAE6OF01EUFBV.51.76.G10.1.454.CMB.1.raw
  modified_base (199)..(199): a, c, t, g, unknown or other
  misc_feature (199)..(199): n is a, c, g, or t
  modified_base (307)..(307): a, c, t, g, unknown or other
  misc_feature (307)..(307): n is a, c, g, or t
  modified_base (675)..(675): a, c, t, g, unknown or other
  misc_feature (675)..(675): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtcgtctccgaggggaaanacgccaccctctcctgcacgggccagtcagagtgtagcagcgtacttagcctggtacagacaacgaaacctggaccacggcctacccgaggtcctcctacactcgtangtatcgctactccgaacgaacgggtccaaccgtagtaacttaccgtaccccaacggccccgtaagggtttaccgaagggttccgggacggtaacgggggttttcggggttaccgttaggggggaaccttaacgggtacgtttacccgaaccttccgtaccctaacctaacgtaccgaacgacgaaccgtcgtacgacgtacgtacgtaagtaagttagtttacgtatttaactttacttacgttacgtacgagtactaagttactaacgtaacgtaccgttactaccgttacgtacgtttacggacggtacgggaacctaggtaccgtaggtaacgtaacgtaaccgtaaacgtacggtagtaccggntcgactaccgtacg

SEQ ID NO: 68900 - DNA, 811 bp, Homo sapiens
  misc_feature: GYAE6OF01A961W.51.76.G10.1.454.CMB.1.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (490)..(490): a, c, t, g, unknown or other
  misc_feature (490)..(490): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtcctccagccctaccctgtctgtcgtctaccggaaggggaacncgcccaccgtctccgtgacgacgggccaggtcaggtagtcgtacgacacgcgtacgttacgccgtacggtaccagacaacggtaaccgnggacccgacggacctacccgacggtcccttacctacgtacttactagtacgtacacgacctaccgaccgaaccggacggtaccctagtacggtactacctaccgaaccgtccggttaacggtacgacgggtggacggtaggggtaggttcgaacgggtaactacggtacgttactaccgttccacctaaccgtacnccgtaacggccgtacgtcccttacggacgttacgtaccgtaagttaagtttacgtttactaaacgtttaacgttttacgttaccgttagtaccgaaacgttacgttaaaacgttacgttaaaccgttacccggtacccggtttacccctttaaccggggttaacccgtttaccgggttacggggaaccccgggtaaacggggttaaaccctacgggttacggggttaacggtaaacgttaaaccggtaaaccggttaaaacccgggttcttaaccgggggttaccgacccggttaaaccttaccggtaccgttttaaccgg

SEQ ID NO: 68901 - DNA, 813 bp, Homo sapiens
  misc_feature: GYAE6OF01CD4SL.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcgaggccagtcagagtgttagcagcgtacttagccgtggtaccacgacaacggaaacccgtggacccacggccgtccccgaacgggtcccttacccctactacttaccgtataggtactcggacctaccgtaccccgaaacggaaccggggtaccctaacgttacggtaaccttaccgtaccccgtaggttaccgttaacgggtttcgaagggttcggacgttaggggttcggggtacggtacggggaacgtaacgggttaccgtttcctaaccgttccctacctaccgtactaccgacggtaccgaacgtcccgtacggtaccgtacggttccgtaaggttaacttaggtttttaacgaacctttttaaagttttacgtttacgttacgttaaccgtaacgtaacgtaaacggtttaactaaaccgttaacggttacccgggttccctttaacccggttacgttttaccgggtttaacccgggaaccgggttaaacccggggtaaccgttaacgggtccggttaagggtaaacggtaaaccttaaaccggtaaaaccggttccgttagggttacccgtagtacccgtacctaccgttaccg

SEQ ID NO: 68902 - DNA, 817 bp, Homo sapiens
  misc_feature: GYAE6OF01A4CKY.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctgctcccagataccactggagaagtagtgatgacgcagtctccagcccacctgtctgtcgtctacggaaggggaacacgcccaccctctaccgtgccgacgggcctaggtcgaagtaggttagttacgcgacggacgtacgttacgccggtacggtaaccagaccgtaacggaaacccgtggacccgagggtccctacccggaacggtccccttccgtactacgttacgtagtacggtactcgacctaaccgttacccggaaacggaaccgggccctaacgtacggaacctttacccgacccgtaaggtccccgttaaggttcgagggttcgacggtggggttacgggtacgtacggggtaactaggttacgttacctaccgtcctaacgtacctacgacgaccgtcgtacgtcccgtagtaccgtacgttcgtaaagttacgttttagttacgttaactttaaagtttccttagttaccggtaacgtacgttaacgtaactttaacgtaaacgtttaaccggttccggttaacccgtttaaccggttaccggtttaccggttttaaccgggggaacccggtaaaccggggtaaccttaacgggttacggaacggttaacggttaaacgtaaacccggttaaacggtacggttcggttaaccggtaccgttaccggtacccgtcggtttaaacccg

SEQ ID NO: 68903 - DNA, 620 bp, Homo sapiens
  misc_feature: GYAE6OF01B5K1O.51.76.G10.1.454.CMB.1.raw
  modified_base (195)..(195): a, c, t, g, unknown or other
  misc_feature (195)..(195): n is a, c, g, or t
  modified_base (464)..(464): a, c, t, g, unknown or other
  misc_feature (464)..(464): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaancgccaccctctcctgcagggccagtcagagtgttagcagcgactagcctggtaccagccaagaaacctggcccaggcctcccgaggcctcctcatcctagtgatcgcactccaacgaacggccactgaatacacccagccgtaggttacagggtcggacgtagggttcgggtacgtagggactaggtacttcgacttcctacaccgtactcgaagtccagccctgactacgtctaggtagttatttacgaactttaagtttattacgtntacgtagtactaagttaagtacgttaacgtccgttacccgttaccgttacgttacggtttaccggaccgggtaacgggaacccgtaggtcggtacggaacgtaacgtaaccgtaaaccgtacggtacggtcggtaacctcggacctaaccgttacg

SEQ ID NO: 68904 - DNA, 809 bp, Homo sapiens
  misc_feature: GYAE6OF01D5RXE.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggcctcccagataccactggaagaagtagtgatgacgcagtctccagcccaccctgtctgtgtctcgaggggaancgccaccctctccgtgacgacgggccagtacagtagtgtagcaggccgacttacgccgttaggtaccagaccaaccggtaaacccgtcggacccagggtccctaccccgacgggcctcccgtaccacgttccttagtcggaacgttcggacctaacgtaccccgaaacggtaacgggtccctaacgtacgtaacttaacccgtaccccgacggaccgttacgggttccgtaagggtcggtccgtaagggttcggggttaccgtagggggaactagggttacgtttcccaacggttccctaaccgtaaccctacgttaccgacgaccgtacgtacccgtaggtaccgtacggtttacgtaacggttaagtttacgttttacggtaacctttaaacgtttttaacgtttacgttacgttaccgtacgtaacttaaaggttaacttaaacgttaaccgttacccgggttaccccttccggttaaaccgttacggttttaccgggaacccgggttaaccgggtaaccggtacggtaccggtaggtaacggtaaacgtaaccgtaaaccggtaacggtcggttacggtacccgttacgtaacccgtcgttaaccg

SEQ ID NO: 68905 - DNA, 929 bp, Homo sapiens
  misc_feature: GYAE6OF01DLLKR.51.76.G10.1.454.CMB.1.raw
  modified_base (204)..(204): a, c, t, g, unknown or other
  misc_feature (204)..(204): n is a, c, g, or t
tcagcgatcgtatacacgaccggtgctcgatttagtcactcatacagggggaggaactgctcagttaggacccagacggaaccatggaacgccccagcgcagcttctcttcctctgctactctggcctccagactaccacgtggagaagtagtgatgacgcagtctccacgcccacctgtctgtcgtcctacggaaggggaacncgcccacctctccgtggcgacgggccaggtacgaggtacgttagtacgacgtacggtaccgtacgttacggccgtacgggtaaccaacggaccaacggtaaacccgtcggacccgtaacgggtcccttacccggaggtcccctacctacgtaacgttccgtaagtacggtacttaccggaccttaaccgtaacccggaaaccggtaaaccgggtccctaaacgttacggtaaaccttaccgtaccccggtaacggtacccggtaaggtttcgaacggggtcggtacggtacggggttcggggtaaccgtagggaaacgtaacgggtttacggttaacctacccgtttaccgtaaccgtaaccgtaacgtaccggtaacgcccggtaaccggttaccggttacgtaccgttaaacggttcgtaaacgggtttaagttttaccgttttacggtaaaacctttttaaacgttttacgtttacgttacggtaaacgtaacggttaacgtttaaagttaaaccgttaaaccgtttacccggttcccggttaacccgtttaaccgtttaaccggtttacggtttaaccggggaacccggggtaaacccgggttaactaaaccgggggttcgtaaacgggtaaacttaaaccccgggtaaacgggtaaaacccggtttacggggttcggtaaccggtaacccgttaccggtaaccccgttaccgtttacggg

SEQ ID NO: 68906 - DNA, 631 bp, Homo sapiens
  misc_feature: GYAE6OF01EL2P4.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagctagcgacttagcctggtaccagcagaacctggccaggcctcccgaggctcctcatctatgatgcactccacgacgggccactgactactccacgccgtagttcaggtcgcgtaggtgggtcgtggggacaggtacgttaccaccgttcctacctaccgtatccgacgccacgcccgtggacctaggttctaggtaagttattttacggtactttaaattttacgttaccgtttagttacctaggtaccgttaaggttaacttaaagttaaccgttccggtacccttacccggttaaccttaccggttttccgggaccggtaaccggggtaaccctaagggtcgtagggaactacgtaaccgaaacgtaaccgtgtacggtcctacgtccacgttacg

SEQ ID NO: 68907 - DNA, 908 bp, Homo sapiens
  misc_feature: GYAE6OF01CC403.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggcctcccagataccactggagaagtagtgatgacgcagtctccagcccacctgtctgtgtctcgagggaancgccaccctctcctgccgagggcctagtcgagagtgttagcagtccgtacttacgccgtacggtaccagcgaacgtaaccgtcggacccgaggtcctacccgaggcccttccctacgacttaccgttatcggtacgtccgtcctaacgtacccgaacggaaccggggtcccctaacgtacgtaaccttaccgaccccggaacgtcccggtaacgggtttaccggaacgggttcgggtacccggttaggggtttacccggggttccgggtaaacggggtacccgtaacggggtttaccgtttacccctaacccgtttcccgttaaccctaacccgtaaccgttacccgtaaccggacccggtacccggtacccgttaccggtaccgttaccggtttacgttaacgggtttaaccgttttacgttttttaacggaacctttttaaacgtttttaccgtttaacggtttccgtaaaccgttacgttaaacccgttaaaggtttaaacgttaaaccggttttaaccggttaaccccgggtttaccccgtttaaccgggttttaaccggtttaccccgggttttaaccgggaacccggggtaaaccgggttaacccggtaaaccgggttcgggtaacggtaaacggttaaaccggtaacccgtaaaaccggttccggttacgggttacgtacccgtacgtaacccgtaccgttaccg

SEQ ID NO: 68908 - DNA, 582 bp, Homo sapiens
  misc_feature: GYAE6OF01DYNNW.51.76.G10.1.454.CMB.1.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
  modified_base (288)..(288): a, c, t, g, unknown or other
  misc_feature (288)..(288): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctaccgaggggaaancgccaccctctcctgcagggccagtcagagtgtagcagcgacttagcctggtaccngacaagaacctggaccaggcctcccgaggctccncatctatgatgcatccacgacgggccatgactactcccagccgtaggttccaggtcgacgtaggtgggtcgtgggaactaggtacgtttccacttcctaccgacctacgtaccacgacctacgccttagctacgtctaggtaagttagttttacgacttaattttacttactgtacagtactaagttaactaacgtacgtacgcccttaccgttacttacgtttcggaccgtacgggaacacggtcgtaggactacgtaacgaacgtacgttggacggtctacgcctacgtacg

SEQ ID NO: 68909 - DNA, 740 bp, Homo sapiens
  misc_feature: GYAE6OF01CL5K7.51.76.G10.1.454.CMB.1.raw
  modified_base (166)..(166): a, c, t, g, unknown or other
  misc_feature (166)..(166): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagactaccactggagaagtagtgatgacgctagtccncacgcccaccctgtctgtgtcctaccggaagggaatacgccctacctctcctgacgacggcctagtcgagtgtagtacgacagtccgtacttacgccgtagtacccagacctaacgtaacccgtcggacccaggtccctacccgacgtcccttcccgacttaactccgttatacggtactcgtacctaccgtaccgaaccggaacggtacctacggtactacctaccgtacccgagtaccgtacggttacgaggtcggtacgtagggtcgggtacggtaacggtacgtacggttcttaccgtcccttacgactaaccgtactaccgacgttaccgacgtccgtacgtaccgtacggtacggttaggttaacgtttcgttttaacgtaactttacttttaacgtcgacgtttaacgacttacgtaagttaacttaaaccgtccgtaccgttacccgttaacgttaccgttaacggttaccggaccggtaccggaacgtacggtacgttacgggaaacttaccggtaaacctaaacggtacgttacggtaccgtacgtaaccggcttaacgttccg

SEQ ID NO: 68910 - DNA, 596 bp, Homo sapiens
  misc_feature: GYAE6OF01D1SLT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgacttagcctggtaccagcagaacctggccaggcctcccgaggcctcctcatctatgatgcatccacgaacgggccatgatactcccagccaggttcagtggcaggtgggtctgggactaggagttccacgttctacaccatcagcacgccgtgcgtacgtcgtagtaagttattttcgaactttaattttaactttacgttagttacgtagtactaagttaattaaagttaaccgttacggtcccttaccgttaccgttacgttttcggaccgtaacggggaacctaacggtccgtagggaacgtacgtaaccgaaaccggtaacgtacggtacggtaccgtcggaccgtaccgttaccg

SEQ ID NO: 68911 - DNA, 805 bp, Homo sapiens
  misc_feature: GYAE6OF01EH99K.51.76.G10.1.454.CMB.1.raw
  modified_base (230)..(230): a, c, t, g, unknown or other
  misc_feature (230)..(230): n is a, c, g, or t
tcagcgatcgtatacacgaccggtgctcgatttagtcactcatacagggggaggaactgctcagttaggacccagacggaaccatggaagccccagcgcagtcttctcttcctcctgcctactctggcctacccagactaccacgtgggaagtaagttagtagatggaccgcgtacgttcctaccacgccctacccgttgtcttggtcgttcctaccggaaggggaaacnccgtacccctacccgttccgtccgtcggaccgacgggaccctaggtaccgaggtacgttagtacgacgagtccgttacgttacgccgtacgtaccagaccgaacgtaaccgtcggaccgacgtcctaccgacgtccctccgtactactacgtagtacgtacgtccgacctaccgtacccgaacggtaccggacctacgtacgtaaccttaccccgaccgtaaccggtacccggttaggttaccggagggtacgggtacggttacggggttcgggtacgggtaacgggataccgggttaccgttaccgtaaccctttccgaaccgtaccgtacgtaccgaccggtactaccggtcgtatacggtaacgttacgttaaggtacttttacgtttaacgtacttttaagtttccctacggttactacgtaagttaacgttaaagttaactaacggttccgtaccgttacccgttaccggttaactttcgggtaaccggtacccggacgtaaccgttggaccgttaaggacctaaacgaccgttaacgtacgtcgtacgtaccgtactacctacggttcg

SEQ ID NO: 68912 - DNA, 769 bp, Homo sapiens
  misc_feature: GYAE6OF01ER0ZU.51.76.G10.1.454.CMB.1.raw
  modified_base (200)..(200): a, c, t, g, unknown or other
  misc_feature (200)..(200): n is a, c, g, or t
  modified_base (557)..(557): a, c, t, g, unknown or other
  misc_feature (557)..(557): n is a, c, g, or t
tcagcgatcgtatacacgaccggtgctcgatttagtcactcatacaggggaggaactgctcagttaggacccagacggaaccatggaacgccccagcgcagcttctcttcctcctgctactctggctcccagataccactggagaagtagtgatcgacgcagtcctccgagccaccttgtctgtcgtcctacgagggaanacgcccacctctcctgcgacggccagtacagtagttgtacgcagacgtacgttacgccgtacggtaccacgacgaacgtaaccgcggtaccgacggaccgtccgacggtccttcctacgtactcgtagttcgacttacgacctaccgaccccgtaaacgggaaccggtacctaacgttacgtaacgttaccttaccggtaacgtaaccgggtaaccgttacgggtttaacgcggggtacggttaccggtgggttaccgggggtttccgaggggtaaaccgtacgggtacgtttacccgtacgtacctaacccgtaacctaggtaccgaacggtcgaaccgttccgacgtacgtagtnttaacgggtttaacttaggtttaactaccgttttaagtttaccgtatacggtactaacggtaataacgttaacgttaacgttaccgtccgttaacccttacgtttaccggttccggtttaacggacccgggaacggttaaccgtcgtaggtacggtaaactaccgggttaaataacccgggtacgtttacggaggttacctaccgcgttacc

SEQ ID NO: 68913 - DNA, 773 bp, Homo sapiens
  misc_feature: GYAE6OF01EB78F.51.76.G10.1.454.CMB.1.raw
  modified_base (324)..(324): a, c, t, g, unknown or other
  misc_feature (324)..(324): n is a, c, g, or t
tcagcgatcgtatacacgaccggtgctcgatttagtcactcatacagggggaggaactgctcagttaggacccagacggaaccatggaagccccagcgcagcttctcttcctcctgctactcgtgcctccagtactaccactgggaataagtgtgatgaccgcgtagtcctaccgacgccctaccgttgtcgttgtcgtccgtaccggaaggggaaacccgtccctaaccttctccgcggcgaacgggcctaggtacgagttagttcgttaacgcgacgtccgttaagtttccgaccgtacggtaccaggacaaaccggtaacncggaccgaggtcccgtaccgcgtcctcgtactattacctagcgttacgcgactactaccgaacggaacgtcctagtacgtactaccgtaccgacgtcgtaacgttgacggtcgtacgtaggtcggtacgtacggaatacggttaaccgtcgtacttacccgtaacgaaccttagccgaaccgggtctaccgttacgtacgacgtacgtccgttaaaggtacgtttagttttacgaaacgttttaacgtttacttaccgtagttaacgtaacgtccgttaaaggttaaacctacgttaaccgttacggttaaccctttaaccggtttaccgttaacggggttccgaaaccggggttaaccggaaccctaagggttccggtaaagaaacgttaccggtaaacgtaaaccgtcgggttacctacggaacctccggttaacaccggtttaccg

SEQ ID NO: 68914 - DNA, 667 bp, Homo sapiens
  misc_feature: GYAE6OF01B7VAT.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagngcccaccctctcctgcgagggccagtcagagtgtagcagcgacttagcctggtaccagacaacgaaacctggacccgaggcctacccgaggcccttccgtaccattaccgtagtgactcgcctaacgtaccgaacgaacgggccctaacgtgaacttaaccgtccccaagtcccgtaggttccaggtcggacgtagggtcgggtacgtagggaacgagtacgttcgaccttactaccgtacctagtaccacggacacgtcccgttacggcgtacgtcgtaagtaagttacgttttacgtacgtttaatttttacttacgtcgtactacgtacgtaagttaacttaaagttaccgttaccgttaccgtaccgttacgttacggtttcgggaccgtagggaacctacggtcggtaggtaaggaccttaaccggaaacgttacgtaggcggtaccgtacgaccgtaccgtacg

SEQ ID NO: 68915 - DNA, 825 bp, Homo sapiens
  misc_feature: GYAE6OF01BO1E8.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaacacgtcccaccctctccgtagacgacgggccctaggtcagtagtgttacgcgagacgtactttaggccttacgggaaccacgacgtaacggaaaccgtggaccgaacgggtcctaacccggaggtcccttacctacgtaaccttcgtaatcgtaattcggaccaactacccgaaaccggtaaacggggtacccctaacgtacggtaacctttacctaccccgaaggtaccccgtaaaggttttacccggaaggttacggggacgttaacggggttccgggtaaccggttaggggaaccttacgggtaacgttttacccaacccgttacgttaccccaacgtaacttaccgaacgtaccgtacgacccgtagtacccgaggttaccgtaggtaaagttacgttttacgtaacgttaacttttaagttaacttacgtaccgtaaagtaccgtaaagtttaacgtaaacgttaaaccgtaccggttacccgttaacccgttaccgtttaaccggtttacgggaaacccgtaacggggtaacccgtaaacggtcgtaaagggaacgttaaaccgtaaacgttaaaaccggtaccgtagggtaccgtacgttacgaacccgtaccgttaaaccg
